United States Patent 9,932,637 (GENETIC POLYMORPHISMS ASSOCIATED WITH CARDIOVASCULAR DISORDERS AND DRUG RESPONSE, METHODS OF DETECTION AND USES THEREOF) - sequence listing, part 4

SEQ ID NO: 13254 - DNA, 65931 bp, Homo sapiens
accaccacgcccagctaattttttgtattttttagtagagatggggtttcaccgtgttagccaggatggtctcgatctcctgaccttgtgatccgcccrtctcggcctcccaaagtgctgggattacaggcgtgagccactacgcccggccacagagcagtacttatttcattttaaactctcttggtttagtatattcattaaaataaaataagtaaatatattasgttggtgtaaaattgtggttttcaccattaaaagtaatggcagaaattacttttgcaccaacctaatattaagcctaagaagtttcagattcttttgtagtttataagcctgatgattgggttttcatgtgcatgtgtgagatgtgcctcccgcaaaccttgttacgacgttggcacattacccatctgatgtgaaaaaatttttctgtacacttttcaagtttaaaaagacagcataaaactattgtaatgcccaaccttgtttttactaaccctgtttttaggcttgtttccacctgaattgactctcccttagctaagagagccagacagactccatcttgactctttcactggcagccccttcctcaaggacttaacttrtgcaagctgactcccagcacatccaagaatgcaattaactgataagatactgtggcaagctatatccgcaattcccaggaattcgtctgattgataacacccaaagccctgagtctatcatcttgtaatagtcttaaagcccctgcacctggaactgtttactttcctgtaaccatttatccttttaactttttgcctactttatttctgtaaaattgttttaactagacccccctcccctttctaaaccaaagtataaaagaaaatctagccccttcttcggggcagagagaattgtgagcgttagctatctctcggtcgctggctaataaaggactcttaattcgtctcaaagtgtgtcgttttctctaactcgcttgggtacaacgctatgacattagaatagtggtcagttatgaccttccaataactggatgggaggagggcccttttggggtactggtcattttctgtttctttttttttttaagacagagtctcactttgtcaccaggctggagtgcagtggcgtgatctcagctcaytgcaacctctgcctcccgggttcaagcgattctcatatctcaacctcccgagtggctgagactacaggcgtgtgccaccacgcctggctaatttttgtatttttagtagagactgggtttcaccacgttggccaggatagtctcaaacttttgaccttgtgayctacccgctttagcctctggcctcccaaagtgctgggattacaggtatgagccaccgcacccagactattttctatttctttcttttttttttmtttttgagaccaagtcttgctctgtcacccaggctggagtgtagtkgctcactatacaaccttggctcactacaatcttggctcactacaacctccgcctcctaggttcaagccattctcctgcctcagcctccccagtagctgggattacaggaatgcaccaccaagcccagctaatttttgtatttttagtagagatgaggtttcaccacgttggccaggctggtctygaactcctgacctcgtgatctgcccgccttggcctccggaagtgctgggattactggtgtgagccaccgtgccaggccttctgtttcttgatatagatgataaacatgaatgtgttcattttgtcaaaaattttcaggctgtactcttatggtatgttgatttttctgaatatacattcttcaaaacattttttgaaatagcagtcataatggttttgagttttgttgctatgaaatgaatttctcttgtcttctagtttggaaatttaagttcatttttcattctcacctcattttgttaagtgaatttcaatgtagcttaacattcttcatttttagacatttaattatttttaattttggtgaattaggtgctatcaggttacaaaggttttaacacaggcagagaggctgtcctcaactcaccactgagttaatatctaatttttaaacatttcaaagtcatttagtgttaataatgaaaaatataaaactaggggactagacttaaagtagtaccaagaacagaggaggagaaattaaccttttaaaagtaaaggggcctttcttcctctgagtggggaaaagagaaagaggataaatatctatttgcttcctaagttggagaaaagtcaaggatgctcacaaatgatggtcttgattttaagggagtaaaacaaggttctgtactaagaataaatgttacggtggggctgatagctcaaggaaaaaggaaatagttaggaaatagcctgataaggtaaacatagctgaaggtcaagggaactgaagakaatagtgcagttaaaatggttgataaaagggttcttggggggcggtggctcacccctgtaatcccatcacttttaggagttgagatcagcctggccaacttggtgaaaccccgtctgtactaaaagtacaaaaaattagccaggcatggtggtgagcacctgtaatctcagctacttgggaggctgaggcaggagaatcacttgaaccagggaggcggaggttgcggtgagccaagatcgtgccattgcaccccagcctggacaacaacagcaaaactccgtctcaaaaaaaaaaagggggttcttactggtaagtaagataaaaaatgataggaaacagctgataaactatgagaagaaagactggctgtcaggctgtcacattgaggacaaattacagattcaatgggaatgaccacagaatagagatagatgggggtaggtggctgtaggtacagagagggaaactcacaatccagcattttggaggggaagtaatttcattgatgactaggttgaaggtgtggctccatctgtgggttgctgatacagagtgaagttgaagatgattggaaaagaaaacgatgagaaattgtgaggtcagagtgctaatgagtcatgaacatggatgctgaaatcattaaggtgatacagaacatgaggataattccagggctgacacagaatttcagaaacataactgggcacagacaaggaagtaaagggatatcctagtcagcaccagatttagggaattagaaatgcaggcaaagtttgtctttgacatttatcacctttgttccatggcacaatttcctaagctttgctcacttactcccaagtaattgtaattttggtgccttcatgttactttctcactgtacagtttcctcaatctctttttttttttttttttttttttgagaaggagttttgctctgtcacccaggctggagtgcagtggcaggatctcagctcactgcaacctctgcctcctgggttcaagtgattctcrtgcctcagcctcccaagtaactgggattacaggcacccaccrccatgcctggctaatctttgtatttttaatagagttggggtttcaccaggctggtcttgaattcctggcctcaagtgatccgcctgcctcagcctcccaaaatgctgggattacaggtgtgagccactgcacccggcctgctcttgacatatctaaaatctcaaatggtcacaggacacaaatggagagttctccattaatatactactttcccctacttacctttgcattttgacaaggctttctagtaacaaatccttaatctgaaattcgtaatttcaaggccaatactctacagaggtatctgcaaagtcatgtaattccagcacagcagaggtcttccgtcctgttgctctgaaaaatacttctccaatattgattcatccttttggcctcagactttaactactcccataaaatgtgagtttcttgggagcaggacctgagctgagccaataaaaagacacccataaaagcactaactcagtcatttgttttcctaatggtgccaaggcaggctggtgtgttgtgacatatcaatccacttctgtgtacctgcccttccccgtccagcaaaatatcatcatttttaatatatgttgtgatactaaaatatttcagaagtgttgaccgagtagacattcaataatgattatagctgatacttacagagcacctactatgtgccaaacactgtatgtattttaactcatttaatccttgcaacaatcctgttaggttggtattgttattctcattttgcagatgaagaaatttgaaaagacttgcccaaggtcacagagatgagaaatagaggcatcagcatttaaacctaggcaatctagaaccagagggtacatttaaccactatacatctcccctaaatacatctttgcatcacacctgttatctcagcactttgggaggccactaaggccggaggatcgtttgttgccagcagttcaagaccagccgggtcagcataccaaaatcttgtctctccaaaaattttaaaaattggccaggtattgtaggggcacctgtagtctgagatacttgggaggttgaggtgggaggatcgctagagcccaggaatttgaacgtgcggtgagcatgatccagccactgcactccagcctgggtgacagagtgagactgtgaacaacaacaaaaaaatcaagtttcctggatctayacaaaattttcaatttaacaaatttttataaaaatttgtyttaaaataaacacccctctaaatggcaaagctagaacagaatctggtcacaatctataggttagatataggatgacagggaggagcaagagctgaacacatcagctgcagcaccatctactttgcctgcgactccgttagcaggcccactttgcccttttataaattatctgatcaacaactaagagattaaaattcgatctatgttttactctatctgaatcctcaatataatgaagaactttataattgttaatttatggatataatttaagttcattaaaccattatttccttcctatatcctctcattcttccacaaaaacctctacctttgggtgtttacttttacagacacccacgcamacaccccacacgcacgcacgcacatgccttatcttttaactcaagattctcatcttcctttggggagaaacaaacatcatgagccttgaggtccattttctgagggaaaggggggggcggaggcgggatgaataggtttttacccggtattttttatcataaacggggaggtacaaaccgcaaagaaacactagtcgcttggtgggccaccacctctggggctcactgatcaatcgcacccaaactcatttactaatttaaaaaagtactgtggcaaggctcgtttacgtaagtcttggagagaagccgccgccacaatctgccgcagtctcgtgcggagtcacggccaccgagctcttcactttccccaakaggctcccacgccttccccatccccaagggagctaggcggtccctcgcggctctgagtccctcggggaaggccgcgaagagaggccgcaggcgccctggcgagaagggagggcgggggcagcgggcggcgggcagcacccgggctccagttcatgaccccgttattccacagaaaaatggaacattccgctctttccgcccacagaggggaggtggggggaacccttcgatctagtctgggagaggcgacgcggacgcagccaccggaatccgggacgcgaagagccgcgttacgggaatcgctacccctcggagtcccgccccctcgtcgacaggcggccactggaccaatgcctgggcgcaaagggtctctcaggggccaatcagcgcctaggtcccggtagggggcggggcgcagcgttggccggccgggggcgcagctgggcgggattggggagcgccccgccccgccgcgggactggggtggcgcgctacctctgcggagaaggatctgacagtgttccggagccggggcgagcagccaaaaggcccgcggagtcgcgctgggccgccccggcgcagctgaaccgggggccgcgcctgccaggccgacgggtctggcccagcctggcgccaaggggttcgtgcgctgtggagacgcggagggtcgaggcggcgcggcctgaggtgaggaggggccgggtgctgggtcgcgtagctggagttagagtgtcggtggtttcggacgggctatctggcactcgaggagacctcccttccccctgagagcagcgcccggaacttgtcagcccagcctggaaatccccacattccttccccttcctgctcccgsacctccgaattctacttccacaactttgtcacctcgattatcgcagccctgagtacaaacttcacccaggcgcacgcacgcacccctcttaacgcccgccccgcagaacgcccttcaagaacaaacccccctttttgttaccagatcccacgtttttcccaatccccttttcatctcccctgaaattctattcgctccgcacttgtcttcattctcgaggtggatttcccttccccaaagccgttttttcatcttgaaatcgtaacgtttcagctttgttgaaagttcacaatgcttataaacactattaacgtttctttccttcttttgatcttttctattaataattatcattcctaacgaattccacatctcactgtatcccaaggagaacaaatcagtttttaaaattttacctyytccgacctaaacttttgaagatagtgcaggaagcaagggtctgttcttcagtggatgaacagcattttatttcataatccgaaactgaaaaaaaaaaaaaatcacaggttaaaaataagacgtcaccttttttttttttttttttttttgccttcagaaggaaacgcattttggcttagtttgtgaagtatttcaacaattatactgccttaaaataactagttattagaatgccagggtgaattttctgaaagattgtggtatttgcttttgacagtgctgtaaacaaaccctttaaactgtgtatgactgccagcttcaagttggaacaactcttaatttgaaattacggactcagatcatcagtttagctgtgtgccattatgttaatttcttaaattcatgttaattcctatttggaagtatttttgaactatgaactgaaatattacatttatagaaccaacttgctattaaattgtgctttccaactatttctctttagggataatcttgaacgtttgtttttaatcttgagtgaaagaaaaaaattacaggaaggagaaagtgtcaaaaaggacagactgtagtgggatttttttcttattttaagtatgtattgacaataccagtttaattttctcacaggcaatttagattattataaatactgctgccacctaatttaatataatatagtcttacgtaactaaaaatgttgttctcactyttatttgtgaattgcagtattttcaatttatttaaatttgtttccaaggctttgcacttcagttcagtgttagggcgaaagttaaatacatgtgaagtaggtgttaaaatgtcccctttatagagaaggaaacaggagtctckctgaaamctagatctgtgtgactccaaatcctgtgctctgaatcattttgtcatgttgacacgtttctcataaaaaccccagtgccacaatttggtttgggaacttaagggcaacccataaatcctctacagtggcagggagggattccccgctccctcctttcagagctgctcattttaatgggagtcagaattctctggccctaatacatttgcagcttggctcctagagaagcatggaatgttctcacagyttctccgtttctttgattgcaaaggcagaatgatcagagttgaggttcctattgtgctttattattttacacagcaaatactaagcaatyactacctgctgtacgaactcacaaaggtgcaggagatgtaatcaggaccttcaaagagtttataataattggattgacaaacttatacgaaaaaaactacaaggatgcaaagcagttttaattaaatgcagagtgatgcagaaaatcctgtagatattaaaattagggaatgatcgtttaaggattggagtgarcatttaaggattggaatgagcaaaggatttaccagaagttggccttgaaacctgggtaggatttggataaagggaaaaatgaagacagcccattaataatagcgaatggaggacaaaatgtagaatggagaatatagaacataatataggactagcttgtggaaaggatcagcagtaactaaggtctattaattaaaacaggcaatatatttagtgcttatgttgtgccagttgctgttttgagcactttgcccatattaaggcatttaatcttcataatattatgaagtaggtctaataataataggataaaatcctctttttacacatagggaaacccaggcacaagaaggttaattaatttgcccagctaagtggtagatctaaaggtcatacatagacagcctggcttcagaatctgacctcttaaccatgatacatcctgcgtctccatacagtacgcttgagcgacagcgagtagatagaaaataagatcataccagaaagtctataaaaacccacccttaattgtccaccaggtgcctcaaactatggtagattctgaggatatcaagatatgtgaaacaattactgtgcagtgttctgagtcctgttagggaatgatgtaagagtacactgacagcaaagatgtttgaagtggggggaaattccatataagagatgatacttcaaaagcagtttgtagtgcacagcagagtcaggaaagacattggaataatatatgtagaagcacagactgaaagaacaaggtatgttagaggaagtctagtggtttgctgagtctacagggatggttagtagggagtgatgaaagataagaccgaattataaatggcatggtgtggtcaagcaaaatgaggagcttaagtatttgctttgcagtttggaaactacaagaataatttcagcattattggagtaaaaaagccagattgcttgcaattgcaagcagttctctctagaagtatagtagtaaggtagcttgagggaggagtctgaggaaaggatttttttttttttttagaatagagaaacttgagtattggaaaagatagattggataggcacatcaaagccaaaattttaggttcttaaatagttagaatatttggcattattattcaccctttaaaaagctgttgaggagaagaatgacaggtttaaagttgtgttgtagagagagtgatccaccaacaatgttcagaatgcttggtggggaggaaagagactggaagcaggaacacagttgaaattattgaggtgatcaatgtccaaattaggttagtttgtggtagagagtaaaaagaagagatgggtgggaaagatattatgggagagaagacaggataagatttgtaactgagaaaagctaaaatgtactgcrtagatgagagaaacgatggactccattgacttaggcagttgaagaggatgagttgtttgtagatagggaaaaatggtaagtccttgtgactttttaaaaagtgtgtgggcattcatcccattactkggcatatacccaaaggattataaatcatgctgctataaagacatacatgcacacgtatgtttattgcagcactattcacaatagcaaagacttggaaccaayycaaatgyccatcaatgatagactggattaagaaaatgtggcacatatacaccatggaatactatgcagccgtaaaaaaggatgagttcatgtcctttgtagggacatggatgaagctagaaaccatcattctgagcaaactgttgcaaggacagaaaaccaaacaccgcatgttctcactcataggtgagaattgaacaatgagaacgcttggacacagggtggagaacatcacacaccagggcctgtcatggggtagggggaggggggagggatagcattaggagatatacctaatgtaaatgactagttaacgggtgcagcacaccaacatggcacatgtatcatatgtaacctgcatgttgtgcacatgtaccctagaacttaaagtataataaacaaaaaaagtgggtgggcatttatgtgtatatgtgttcatgagcatgtacctatggtgtattgtttttagacctcttaaattgataagactcagagacagaatatctaagaagatgaaatgtaactggaattaaaagaaagatccaagccaaaattcttgaaattattttgtttgaaggtagtagttgaagtcatgtcttcaaagaagttggtatttaaaaagaaaagtcgatgcccagtactttatctttgggtaccttcatagcctggagataaaagctagcagagaattcagtaaaggagacaagaaagaggataaaggaaagaattcaactacattatctggttacatagaaaccaggatataggagaaattcaagaaccagggatggtcaacaatgtgaaaggcttcagaaacacttgtgatatatatagtcaaaatggctacagtctcttcttcttcttttttttttaaactttgcggctatctagtgtatcttagtaagatttaataagaaattagctgattgatcgtgaataagagagctacattggctgaaaaatggctatagtatatagatgattgttttaaagctgtgtgtatacatatccagagcaggagattcattcctttcagcactgtaaatctgttgccctgttacatttggaatgttctgcctccaaagtttcattttcttttaagcaatcagcttcaccctttgctctaaggttgattgatctgctcagtctttttttgtttggatgttctgttttatgtattacccccaaccccaccccctagtgcaaagtgagttaatcagagctatgtttcagatagcatarctctggttagactggcatgctctgggattttgtcattggtaatcttcacttgacaattagagtcaaagatgatgtagagttcatatgtgtgctattttctctatctaggaacccctacccttattttaagactgggcgctyctggcccctgtctgaattgggtattttctgtgctcctgtggcactttgtgcatattctgcatctctaaactttggacttcttaaaggcaagaactatttatatggcttcaattatgtttgtaacggaataaaaattgaataaaagcttgagcttttatttcttaagcaatggtgagaacatggatgttcatcaaagtgctctgtaaaccttttcatttggctaaaatagtctaattttaaaaggccctaaggtcataagcatattctatgtgtttttcaatatgcttataattttgcttttgcatttaggtccttaatctggagagagagtgtatgcttatacatgcatgtgcacgtgcatgagtgtgtgtctttttgtctgatgaaatggggttcttttttttcttttttgcttatggagccagttgtcccaatactatttattgaatagtcctttattttcccagcaaatgagcaaccttttaaaaaatcagatactaaattcttatatacacttgagtgtgttttgttttgtaccattgatttagttgtctattcatttgccaatcagtgctatgtttactttacctttagactgccctttttttttttttctgcgagactttttttttttttgagacagagcctcrcactgttacccaggctggagtacaatggcaagatcttggcttcttagcttgctgcagcctctataagcccaggctcaagtggttgtcccacctcagcttcctgagtagctgggattacaggcatggtccaccatgcccggctgatttttttttttatttttttttwattttttatagagatggggttttgccatgttgcttaggctggtcttgaactcctgggctcaagcaatctacctacctcggcctcccaaagtgctgggattacagccgtgagccactgcacccagccttctgttacattttctaattagttattactggtatgtaggagagcttttttttttttttttggagatggagttttgctcttgttgcctgggctggagtgcagtggcgacatcccggctcactgcaacctccgcctactgggttcaagtgattctcctgcctcagcctcccaagtagctgagattacaggtgtgcgccaccactcccggctaattttgtattgttattagagacagggtttctctatgttggtcaggctggtctsgaactcccaacctcaggtgatctgcctatctcggcctcccaaagtgctgggattataggcgtgagccaccgcgccagctggagagctattttttgatgatgttttgtttgactgttatgttaaactctaaatagtcctattattttttgatgatgttttgtttgactactgtgttaaattctcaatagtcctaatagtttgtcatgtgattctcactctttcttgatagatgatcatatcattcacaatttattttccatttttagatcttatttattatatttttgcttaagccctttagagcagtggtgaataactgatgacttcaagcatcttgtctgaatcttgacattaataggaacgcttctaatttttacctttaaacctatagatgcttattataggtttctttcttccttttttttttttttttggaggcagagcctcactctgtcgcccaggctggagtgcagtggtgcattctcggctcactgcaacctctgcctcccgggttcgagcaattcttctgcctcagcctcccaagtagctgggactataggtgcccaccaccacgaccagctaattttcatatttttagtagagacagcgtttcaccatattggccaggctggtctcaaactcctgaccttgtgatccacctgcctcggcctcccaaagtgctgggattacaggcgtaagccaccatgcctggccttgtaggtttcttatagtagtacctgtggcagcaacagcaagagctgcactaataataacagctgttaaccttttattgagtagttacaatgagccaaatgattctaagcactttatgtataatgagttatttaatcatcataacattcctagatgggtaggtggtggtggtaccccatgtttacagataaaggaagtaaaagtgaaggctatttaaaaacttgcctaagatgttaaaatatagggactgaaatttgaacacaagcaatctggttctagagtccctgtatcatctttgttatccttcaccaaggtaaggatggtctctttcagtcttagttttctgacactttgttgttatttttaagttttagatgaacagttgttgaatgttatcagatgcttttcaaacatctgttggaatgaccctgtcattttcctttggtctgttaatatagtaattagcagtatcttttctcattttgaactgtgcttattttaggctaaatacttgttagcattcacactttggttttgttttcaaatctatttagacttttctctaaccatactacaaaaaaatgttaaaggcagtttttcaggcccaaggaaaatgataccagatggaaatacggatctatacaaaggaattaaaagctctagaaatggtaaccacacgagtaaatatgtgccagtctcactctgtcacccaggctggaatgcagtagtgcaaccacaactcactgcagcctcgacctccaaggctcaagcagtcctctcacctcagcctcctgagtagctgggacaacaggcatgcaccaccacagctgtctaactttttattttttgtagaggcgagagtcttactatattgcccaacctgatcttaaacttctgggcttaagtgatcctcctgccttggcctcccagagtgatgggatttcaggtgggagctaccaatgtgaagttttaatatatgcaaaagtaaaatatatgctaaaatagcacaaaggtctggggggagaaatggaagtatactatwatatactatgcctgaggtracataatattacttgaagatagattgtgaaaagttaaagatgtacactataaacctaaagcaaccaataagaaaacaaagaattatagcttattagctaacaaggaaaagagaataaaaaataattaagaaaaataaatgcagaaaagtaaacaggaacaaagaacagtcaagaagaaaacaaatatgaagctgatagctttaaacctaatcatatcacaaattatattaaatgtaaatggtctgaacacccaattggaaagcagagattatcagattggatacaaccacatgctgcctaccccctaaagatgccacttaaatatgaagaaacatacagattaaacaaaaaagaatgggagaggatatgtcatgataacactaatcaaagtaagacagaattggctatagtaatatcaaagtagatttcagagaatgttaccagtggtaaagaagggcatttcctaatgataaaagggtcaatttatcaaaaggatctaccaaataacatagtttcaaaacacaacagggtaaaaactgcaaggagaagtaaatccacagttatattcagggatttcaatatccctttttgaacaatgatagaagtagtagtcagaaaatcagtaaggatatggaagatttgaacactatcaaccaaattcacgtaatgaccatttatgtaacactctaccagcagcagcagtgctttttaagtgcacacagaatattgatttcaagatttataaggctaaagtcatcacgacagtgtggtggtagcatataaataagcaaattgatcagtggaacaaatagagtaggagtcatcctaccttctgttttcataaagtactgttagaacacagccacccctgtttgtttatgtattttctatggttgcttttgtgtcgtaacagtagattggtagctccaatagagaccttatggctcacaaacctagaatatttacctcctacctcatacatgaaaagcttgcccaccctggaattgagagtagccaaatagacccacacctgtgaacaactgatttttaagaaagacgcaaaggcaattcacttgagaaaggataattttttcagcaaatagttttgaaacaattatccgtatatacaaaatgaactcaaatttcagcttgacaccacacataaatattaacttgaaataactgagacctaaatgaccctaaaactataaaacttgtaggaaaaaacctttttgactttatttttattttttatatttttttttttttgagaaggagtctcattttgtcacccaggctggagtgcagtggtgctatctctgctcacttgcagcctcctctgcctcccgggttcaagcagttctcttgcctcagcttcctgtgtagctgggattacagatgtgcaccaccacacccggctaatttttaaaatattttagtagagacagggtttcaccatatacccaggctggtctcgaacttctgaactcaggtgatctacccacttcggcctcccaaagtgatgggattacaagtgtgagctactgcgtcgggccctttatgattttagattaagcaaagacttcttagatacatcaaaaacacaaattgatgaattgaactttattaaaattaaacctcctattcgtcaaaagatactgttaaaagaatgaaaagacaagcatacaagaaaataatgcgtaaatccattttctaataaaggccagaatatcttcttagaactttcaaaacttaatgagaaaacaggaaacccagttgatcaatatgtttgaacagacacatcatcaaagaagatatagccaagcacacacctgccgtagggcctagccattccactcttcacttaccttctattttggggacacacactatgtgttagtttcctaggggctactgtaatagagcatccctttgttacagtatcccttacctgaaatacttagtaacagaagtatattggattttggatttttttttttcagtttgtgttgtatttgcattatatacttaaagttaagcatcccaaatcctaaaatctgaaatccaaaatgccagagctcaaaacgttttggaattagagcatttcagtttttagatttgggatgttcaacctgtaccacaaattgggtggctcaaaacaacaaatttattctctcaaggttttggaggctagaagtccttttgagactttggatagaatcttcctttgcctctcctagcttctggtggtagccatcgtcgttgagattccttagcttacagctgcataactccaatctctgcctgtgtattcacatggtattcttcctggctctgtctctttaaagacaccagtcatattgtactaaaggcctattatactccactataacatccaattaaatctgcccatagagtaacattttgtgctactggggttaagacttcaacatattttttggggggaacagttcagcccataacaaacaaaaagaaaattaatttaattatattgtatttagaacaggggttggcaaactatagcccataagccaaatccagcttgcagccatttttataaataaagttgcatgggaatatacctatgcccacttatttacatattgtgtatggctgcttttgcactttaataacggagttaactaattgcaagagagaacttaaagcccacgaaatctaaaatatttattatctggccctttacagaaaatgtttgctagcctattttagaaggtgttaagtgttgtagaaaaaaaaaaaatcagtaaaggggtataagaaacacagggtggttagggaagatctctatgaggaggtgaatttgagcaaaggctacaaggaattactctmtatatattaacttatgaagatgtccactatgtagtgttaagtgaaaaaggttataaaacatttctcacttacatgatcccatctttgtaaaatagaaaagtgtgtatatttatacaatgtaaagttatataatacatgtataaaaaattttgcaagaatatccaccaaaatgttcatggtagttatctcttggtgggattatagtgcactttcacatggcattttttcagtttcttttcattagacatttaaaaaatatttttataaatttaattccttatgtgttattaagttatatcaaaggcttaatgtgtatgaaacaataatggaagattcaactccttgcctaagtttgaagttacttgttgtatttcaaagaggagcactagtacttaagytagaatttaagtgaacaaatcttaaaatggatttttatctctggttacatagaatagttgttagcaggcttaatttagtgctagtagaagaagaaatatgtgattgttaaagaactccgtctgtcataaatgttcctgtcatgtttctgtgacattacatagacgtcagggaagtttgcattaggtgtgggtgagccaataatgtttgcaagcgtatatcaaatcatagcactagggctgggcgcggtggctcatgcctgtaatcccaacactttgggagtctgaggtgggcagatccctttgagctcagcctgggcaacatggcaaaacactatctgtactaaaaataaaaaaattagctaggcatgatggtgccatctcyagtcccagctactcgggaggctgaggtgggagaattacctgagcctgggaagttcaagctgcagtgagctgtaattgtgctactgcactgcagcctggtgatgggagtgagacattgtctcaaaaaaaaaaaaaaaaagcactagaatatttgaatactcttatacaagtgtttatgggtttattttattctgaagctcagaacatatctaaagtaggatactttctgcaaacccaaaagcctaagagcagatggggatttttaaagtacacatataataaaattatcaaagccagccttctgaacaagactctcctctctttacagtgaaacccaatggaaaaagcatgacatttagaagtagaagacttagcttcaaatccctactccttcacttactaattttgtgatttgggtaagtaattgatcttgtctgaattttttgtttttttattttacaaagttccaataaataatccctgccctactcacctgattctttaggatattaggagactaaagtgaaataatttatgtgacaacattttgtgtaatgtaaaataatatcctagtgttaattgttatgaactcataattgatactaatggaagagaacagagtggataatttaaaaactaatttaataattagttaattttgtgtaggtattaccaacttctggcagtttattcacagtaacaytgtactgtgaaagatatatagaaattttcttcatcttgatccccacgcaacttattaattcaacaagcattattttgccttctatttggcaattttagttcatatactgttctacaattgtaatagtaatgttaccatagtaacaaagtttatattgacattctttttcacatgcaatgtaaatctaaatatattcgtgctttttatttcatccttaggttaagttagaaaatgaaaaaaaaatcacaatccataggtgacaaaaataatttataaagagcctaaccattaaatatttatccattgtaactctactgctttttctctcacttgagaaaacatatggaaatgaaagtaaatgagaatgaacaactatagggataatcttgaatttattctattttaaataaatcatttatgaactttgtttctctaacattaaaagtagcaatacttgttatacatcatctagctcctttcggcacactaccatgttatatcaccatagttgaggaatgattacagcttttggttttcagaaataatctttcctgtatttatggttactagttaggttttggcttcatagaagcttctcaagttacctgcaaatttcaaggaaggttagtgtatgcaatgtatggttataatatatgcatagaaaactctgcaagaggtgaggtaatagtgctattaatataattttaaattaaatattagtatcaacagaaggaaaggagggaaaaaataagcaaactactgtcaattctgtcaatttttttttttatttttttgagatggagtctcgctctgtcacccaggctggagtgcaatggcacgatcttggctcgctgcaacctccgcctcccaggttcaagtgattctcctacctcagcctcctgagtagctgggactataggtgtgcgccaccatgcccggctaatttttgtatttttattagagacggggcttcatcatattggttaggctcgtcttgaactcctgaccttgtcatccgcctgccttggcttcccaaagtgctgggattacaggcatgagccaccgcacccggccataattctgtcaatttttaagcaagccccaagtgaagttaactgtattgcatataatattttatatagtgttactgtgtcttcatctcttagatttggactatgaaatcaagtcccataatagatgtttcttcatcacctctccattacaatcttttaaaaattaggaaagattactttctaaatgtgaaatgtggaatctacctttgcctagttcgctttgcttgtgttccatggtactactcaaacaaatctaattgctttgaagtaatcataaattctttcatggacctcttgttctggagcagctttgttgcaagaatatagtacatttggcttggcacagtggctcacacctgtaattccagcactttgggtggccaaagaaggaggattgcttcagaccaggagtttgggacctgcctgtgcaacatagtgagacccccatctttacagaaaaatttttaaaaaattagctgggcatgctggcaagctgttacatgattagggagtgcataaaatcaagttagtatgtatatttaataaaacaatattgtgttccaagtgcagaactaggaagccatttctcatcaagaagagttaatagttttatttagaagaaaaaaattacacattaagtattttgtctttaataattttagcttttattttaggttcagggagttcatgtacaggttacatgagtatattgtgtgatgctgaggtttggagtacgattgaactgtcacccagttggtgagcatagtacccaatagtttgaaccttaagtatttatttattttatttattttttgagacggagtttcactctgtcgcccagcctggagtgcagtggcgccatctccgttcactgcaacctccgcctcccgggttcaagtgattctcctgcctcagcctmccaagtagctgggattacaggtgcccaccaccacgcccagctactttttgtatttttagtatggacggggtttcaccatgtaggccaggctggtctggaactcctgacctcagatgatccacccacctcggcctccctgagtgctgggattacaggcgtgagccactgcacctagctgacattaagtattttttaatttaaatttattttttgcataagtactaaagattcacatggtcaacattgcaaggctgcagagtatatggtggagcgtctccctaccaccctgatctctcaaataccctgtcacagccagtatttgaacttttatcctcctagagatactgtgcatatatwaaaaaacgaatgtgtgttttgttttcttgtatattgttttgcccacaaataatagcaaatgcgttgttctgtaccttaacaatgtaacaatgtattttagataactttatgtttctgtacatatagagcttcctcattttttttaaatggctacaagtatttacatttacatggttttggtataccatcatttaactagtgtcccatcataatcaggttgtttcagccttttactgttaaaaacaatgcagtgaataactttgtacatgtgttgttttattcatatctgtaggataaaataaagtagaatcattagaatcaaatgtgtgtgttttaattttgattgatattgccgaactggctctctgccttgtttgggtagagcttttttctttgtttttaagtgaggtctaatttacaaacaacaaaactgaccatttttaaagtgttcaatgtattgggaagcttatgccaatttacactataacctgtagtgtgtgacgatactttcgttgcttagtctcacaacaccctgttgatactttttgggtttttatatttttgccaacactaatatgtaagaatggtattgggataatttttggtttgtttaccttttgttacatactgcaaaacagaactcataagtgtacagctcagtgaatttatcactgtccagatcaagatacagaacatgctcagcacccagaatgtccccttttatacccttcctcacaaaaaacaactgctctgacctctgtcamcaaacaccgtagacttttgcctctttttgaacttctgtaaaataaatcatgcagagcgtactttcttgccttttttctcttttaaaatttttttgtagagtcagggtctcactattttgtgcaggctggcctcttaactcctggcctcaagcaattcttccccctcagcctcccaaagtgctgatatgacaggtgtgggccactgcacccaacctgtctgatttctttcattctgtattatatatgagattcatccatgatgcatgtatctgttgttatttttcattgctgtgattcaattacttgaatataccataatttatcctagtgttaatagatatttggttgattttatttttcatctattttgaataaaacttctgtaaacattcttgtagatgtctttggaggtattaagcactcgtttcttttggttataccttatctgggcagattttgtttgtttttaaggtctaatttrtaaacaataaaattcaccattttttagttacaacttgataggaaacccatgagtctaacatttctgcrtttcttatcagcaaaaaccctgatggctgccttttttctgaactttgttttgagacggagtctcgctctgtcacctaggctggagtgcagtggtgtgacctcggctcactgcagcctccgcctcccaggttcaagcagttctctgcctcagcctcctgagtagctgggattacaggcggccgccaccacgcctggctaatttttgtatttttattagggacagggtttcaccatgttggtcaggctggtcttgaactcctgacctcatgattcactcgcctcagcctcccaaagtgctgggattataggcgtgagccaccatgcccagccaacttaccttttaaagaatgttggaaggtagactctcagagccgtggagcaaaggacaggcttacttacagtcttcaaagatacagataatgtctccctctagagtaaatggcagacatgcttcctgcatatttttcaagtttagggttacttaagatctgtctttctttcctgtgaagcagcctgttcaggtgtcatctgacttcacaatgccctgtgacagttgggactcaagcagctggcgcaagaaaatgctgatactctgactactgttatgagtaatacagtcctttgcttctgacgcaaaaatgtcatgccttttgccagtatccatgacactgtggtaggctgacttgttagcttgaaagtaaggtaaaatctcagtgcctttgaaacagttgacacagaattcagtgaattttgacaaatgtrgtctttttttttttttaaatagaatttcgctttgttgcccaggctggagtgcagtggtgccatctcagctcactgcagcccctgccttccgggttcaaacagctctcctgcctcaagcctcatgagtagctgggactgcaggcatacaccaccacacctggcgtgtgtgtgtgtgtgtgtgtctgtgtgtgtcggggtctcgctctgttgcccatgctggagtccagtggcatgatctgggcttactgcaacctctgtttcacgggttcaaacagttctcctgcctcagcctcccgagtagctggcatcacagacrcccgccaccacgccaagctactttttgtatttttaatagagatggggtttcaccatgttggccaggctcgtctcgaactcctgacctcaagtgatctgyccacctcggcctcccaaagtgctgggattacaggcgtgagccatcgcgtcctgccaaatgtatagagtcttatagtcaccaccacaatcaagtcatagagtatttttatcaccccagatttcctttatgcccttttacgtgtgccttctctacctcagccctaggcaaccctggatctgctttctgtcaccttagttttgccgtatcaagaatttctgaggcacatgcctgtaatcccagtgctttgggaggctgaggcaggaggattgctcgagcccaggagtttgagacagcctgggcaacatagtgagacccccatctcttaaaaaaaaaaagaatttcctgtaaatagagttatacaatgtataacctgttgtgtctggcttcgtttattcagtgtaatgcttttgagattcattcatactactgcatgtatcaccagttcatactcttttttttttgtttgctgagtagtattctattatatgtctctaccattgtttgaatgtatgtttatacattcagcagttggtggacatttggattgtttccagtttgggacttatgaatgaagctgctgtgaacatttgagtataagtcttattgtgggcatatgtttttattttggggagtacgctctttggagtggaaataccaagtcttatggtgtgcttttaacttggtaacgaactatcaaattgtttaccagagtgtctgtatcattttgcgttcctatctgagtagttctaatttatatctctcattttgagtgaggttgaaagtatcttttcacatgcttgatttacttgtatttccttttctataaactaytcaaatatgtttgcctgttctattaggtgttagaattttttagtgatttgtaggcattctttatatatcgggaaaatttttggccatgctatgaattacaaacatttttttccatttgtcaggtatcttttaaggatacatattatggtgagttttgccatgtagaaatttgtcagtctgaagttcttaatctcacagttatttactaatataagacttcacataagaaagaaacaagatatctcttttaattaaccttaaagtataaattatgttttctagcagtgttttccatagccataacttcagtgggaataaagaaaaataatgtgaagacttaagttttctacattctcataagaattttaccaccttttagaaacacagctacagcatggaaacaagattgtgtcttaaattatgtgtatataagagaaaaaatattaaaagtaatattacatgtgtctgttgcagaaatatccgcgcaagatgttgacgttgcagacttggstagtgcaagccttgtttattttcctcaccactgaatctacaggtaaggttcatgaaataccctatcttctaacttcacaaattaggtttatatatttttatattattatataattaagcttatgtttaattattatgttcatatattctttctaggataatcgagagaataatatcttaaattgattttaataaaaatattcttgataatctgtttttgtataatttgagttgtaacagtcatcttacatgctaagtcagtaatttaagtcagtaatcttaaatgctgtatatcaatactaacaataactttaaaatggggaaggaaagaagtgtgtgggtttttttttttttcttcagtaaatgaataggagaaaatttgttaaatcttgttaaattttacgtcattcatactacatgctcttcaggtattgaagggctgctttcctgtgtctgtaagtcctygtccccaaattacagttacccagatatctaatcattctataggatctggtttttaaccctgtgcatgctgattaccctactgattcttctcttagttgcctgtattacatttaaaatagaatactggctggacatggtggctcacacctgtaatcccagaaccttgggaggcataggcaggaaaataacttgagtccaggaattcagtctgggcaacaaagcaaggccccatctctacaatttttttttttaattagccaagtattagtccattctcacactgctataaagaaatacctgagactgggtaatttataaagaaaaggtttaattgaytcacagttctgtaggctgtgcggaagcatggtggcatctgcttctggggaggctttgggaagtttccagtcatggcagaagacaaagggggagtgaggcatctcacatagcgagaacaggaggaagagagagagaaagggaaggtgctacaaacttttaaatgaccagagctcacaataactcattcctcatccaccatctcgaggcagtaccaagtgagaaatccacccytatgatttaatcacctctccaccaggccccacctccaacactggggattatgatacgacatgagatttgggtggggacacagattcaaaccatatcatgcctctagtcccaactactcaggaggctgagccaggagaatcatgagccctggacctcgaggtcacagtgagccatggtcacgccattgcactctatcctgggtaacagagcaagaccctgtctcgtaaaaatatttatgtgtacgtgtgtgtgtgtgtgtgtgtgtgtgtatgtgtgtgtgtgtgtrtgtatgaataatactatcccagctgtcccccttactagctgtaggaccttggtcagtcattttctgtacctcaatttcctgatctatgaaatggtgataataaaggccactacctcctagggttattagtgaggattaaagaagttaatatagaggccaggcatggtggctcatgccagtaatccaagcactttgggaggccgagatgggtggatcatttgaggttaggagttcaagactagcctggccaacatggtaaaaccccgtatctactaaaaatacaaaaattagccaggcggtagtgccgcacgcctgtaatccccactactcaggaggctgaggcwkgagamtcgcttgagcctgggaggcggaggttgcrgtgagccaagattgcaccactgcactccagtctgggtgacagagtgaaaccctgtttccaaaaaaaaaaatctgagcttggtagcacatgcctgaaagtctcagctacttgggaggctgaggtgggagagtcacttgaacccgggaggcaaaggttgcrgtgtgtggagattgtgccactgcactccagcctagggtggcagactgagaccctatctcaaaaaacaaccaaaaataagttaatatagaggaaatatttggacagtgtttggcctacagtaagcattataaaaatgatagttactgcatatttattataaaggttattgttgtctttgaataaaagtttctttatgaaaaaaataaacgtaatataccaaaaccartctgactrcagtggcactcatacttactttgatctgaacatcatttttataaagttacgtaactatgtggtagctgagatatacccttgtttcatgttgagctagtgatcagtgaaaattctcaggtggtttttacatgagttactcttaaactagttctccctcacccaatgtatatttcttattacctaaataggatatatttcctctgttgctaatttcattttatcagttttagcctggtgttctactctttcagcataattttaaatcccaacattttcatccgaagtgttggcagttgtttgtagtcctgtcctctgctaatttgataagcatgtgtgtctgtcttttcccaagttgttgattaaaatgttgaaaataacaggactgcattagctacctgttgctgcctcacaaatactccaaatcttcaaggcttaaaatgataataatacctctcatgatttgtataggacaagactatagataggcaggcacaatcagacgtattcatctttgctgtacaatgtctggggcctcagctgcaatattcagactgggggctggagtcatcttcagactccttcgcttatatgtctgttgttaatggtatctgcaggctgagggctttgctggggccattgtccaaaacaccatacgtggcctctttttatggccctggctttcttacaatgtgtggctgggttctaagggcagatatcccgggagagagaaagaaagctaattggagtctgtattcttttaatgatctagcctctgaagtctcatagcacactccattggctggagtggacacaaggcacccatacagatctgatgtggttgggggaaatgcagtccccacctcttcatgaaaagagtatgcgtgacatcgtaagaaaaacatgtgggatgggataaatatgtaggtgtggccattcttaaaatacagtcttctccaaggattgagggcatgcacttcagcatattctacttaagactatcctctaattgacttttttcttaagtcagtttttttatatatgggtaatcaaatataaatttgagtatgaacctataaaagtagcaaaatatcagcaatttcataatgttcattgtaatatcggttatagtatattctttttttttttgctttttttctttttttttgagatggaatctcgtttcgttgcctaggctggagtgcagtggcacaatctcagctcactgcaacctctgccccccaggttcaagcaattctcctgcctcagcctcctgagtagctggaattacaggtgcaggtcaccacgccygrgtaatttttgtatttttagtagagacgggatttcaccatgttggtcaggctggtctagaactcctcatctcaggtgatccatccacctcggcctcccaaagtgctgggattacagacgtgagtcactgcgtccaacccagttatagtgtattctaattcacatttcttcatcttgccctataaacattcaaaataactttatcagatacctttcttaattaaaatactttctttttacaatttaatctcagcctggtagccctgtaaaatgggattaatttgacatgggatggtattattgaagctgtgtctcactttgaaaaacggaacatttgccccttttttttcgagactgaatctcactctgtcgctcaggctggagtgcagtggtgtgatcttggctcactgcaagctccgcctcctgggttcacaccattctcctgcctcagcctcccaagtagctgggactacaggcgcccgccaccacgcccggctaattttttgtatttttagtagagacagggtttcactatgttagccacgatggccttgatctcctgacctcgtgatccacccacctcggcctcccaaagtgctgggattacaggtgtgagccactgcgcccagcccatttgcccatttttaatatttctcttattctgtgtgattaaaaattattcatactgagtctctaattatatctttttagaactctagagtatatttcatatttaacatccctatgattactttagagaaagtataacaagtgattttgccaaagaataaagtgatgtctagggaattgtaaggtctgacccagtatcagagagtaacttagtagagattctccactggatgaaggaccatgctrttggaaattgagagtaatatatgcactaagatttacagtaggcatttataaataacagcaagatgatataaacagaccacattataagtttgaaacaaagaaatacacattccagctctgggttttacaggctttgtgagaggtcctgggattccatttggggatacaattttgactgcaaaaactgtttttaattttttctgggctcactgcagccttgacctcttgggctcaagcaatcctcctgcctcagcacacgaccctcacccccaagtagctgggactacaggcgtgtgccaccatgcctggctaatatttatattttttttgtagagatggggttttgccatgttgcccaggctagtaatttttaatctcaaaaacacttcatgggtaactacccaggaaccccacagcaaataggattcattgaggaaagccaccttaaaattgtggacattgaagctagagaaaaagaataaaatcatgtcaaatagttgggacttttatcttggtagtaggtagccactaaataatttaaagtagacaaatgtcctaattattttagaacagtaactgacagtagtatgtaagataaactggaaggaggtcagactgatatagtatcctgtgcttcagcagtcaaagtagcattggaaagaagatgttgatatgcttattaagcatatagaaccaatacagtgcactattgttaagttggaggttagaggaggctaattggagatgttggaagatgactacagagtatctgtcctggatgtctggatgggagtggtgctgttagcagaggcagagaaataagaataaaaaataataagtttgaaaagattatgatacataatagttttggacatgctcatttaaaaatagctatgggatatctcaggtagatatatgtctaatgggctattgaaagcatgggggtttagtgctagagatagggattgagatgtcatcaatgtggagtaggtgataggtaaagcatgtagttgtgtttaattctcttttacccaatctgattctttgtgttttgttttgtttgttttgttttgttttgttttttgagactckgtctcactctgtctcccaagctggagtgcagtggcgtgatctcactgcaacctccacttcctgggttcaggtgattctcatgcctcagcctcccaagcagctgggattacaggtgcccaccatgacacccagctaatttttgtatttttagtagagactgggttttagcatgttggttaggctgattctttgtttttaaataggggatcytatcccatgcatttattttcactctgttgtccagggtggagtgcagtggcttactacatccttgaccccttgggctcaagccatcatcccacttcagcctcccgaatagctgggactataggcgtgcaccaccatgctcggctaattttttttgtttttagtacagatggcatctccctatgttgcccaagctggtttcaaactcctgagctcgagcgatcctcttgcctcggcctcccaaaagtgctgagattatagacgcaaaccatcatacccagggccatgcatttattcttaaaactaaactatttggccatcttgttctattcttcctgttttgtattggtcccttgctgtttcctttgttgtstgagttttgatgtgtggacaatgtatactgtctgtgaccccaaytgtactccacaacagcattcaggactgtagaggagaccaccactgcctgttttctggagagtttagtttagacctgggatctaaatggagggacaggatacgttgtggggcaagtatgaatcatgctgcaggcagtctgtgtttcttaaagaaatagtttataccatgggctataaagcatgaatgggtttttcttaattcagctctattatctttataatttgtatatttctttacaaattcaggcattaaattctaaccatattaattttcagttgtgtattgtctttttctgtgtctttagggatattttagtgacggttgagggactctacattgagtgctaccagctagatatcattttgtaccagaaaaattcagtccatttatatattttctattgttcctttttaggtgaacttctagatccatgtggttatatcagtcctgaatctccagttgtacaacttcattctaatttcactgcagtttgtgtgctaaaggaaaaatgtatggattattttcatgtaaatgctaattacattgtctggaaaacaaaccattttactattcctaaggagcaatatactatcataaacagaacagcatccagtgtcacctttacagatatagcttcattaaatattcagctcacttgcaacattcttacattcggacagcttgaacagaatgtttatggaatcacaataatttcaggctgtaagttttgtttttgtcttatttcagactttgtcatgactattgaactgcatttttaatgttgtcctttcatctttataaaatgtagyaacttgtggacttagtgacttggacatgtttggtttttaaaaaataagcttagaagtaggaaccacaagtctcctgtctttcctgaaagtcaagcagtttcactttactagagaaatatttgacatgagaccccccccaccacaggaaagtattgttgaattgacataatgatggtaattctcagtatcycttaattgctgagaaaatgcacgtgtaaagcagctacctgaagaaagcgaacaaatactggagtaaatcctttttttttttttggtgacagagtctcgctctgtcacccaggctggagtgcagtggcatcatctcagctcactgccctcccgggttcaagcaatcctcctgcctcagcctcccaagtagctgggactacaggcatgagccaccacgcccggctaatttttcatatttttagtagaaatggggtttcgccatgttggccaggctggtctcaaactcctgacctcaggtgatccacttgcctcgggctcccaaactgctgggattacaggcgtgagccactgtgcctggccttggagtaacaaagtaaacaaaataaacttactatgatccaaaagtgggttatctaatttgtggatcacccagackttactgttttggcatttgcttttcttccaacgagtttgggaaagcaataagaagagaaatataaatgaatcattttggcttctacttagttgcctcttacaaacatatgtatatattacttttaaaaatatacttaatggagaaatcagttgatatttttttccagttataaatkaaagttgattttacatagaaaattaatgtgaaacaaaccagttgatgacagttaggatggatgtatatatattacttcctgaaaagaagtgtaagagytgggatagaaaagaaattgtcatcagcctttcattgtgtccatactttttgcttgggtttgatttttttcatctaatttagatcgcaaatgccttgggtagtatataaattgcataatatttgtggatataaagctttctgaaagatgctaattaatcccttttagtgcctccagaaaaacctaaaaatttgagttgcattgtgaacgaggggaagaaaatgaggtgtgagtgggatsgtggaagggaracacacttggagacaaacttcactttaaaatctgaatggtaygttattttaaatttgtttcatgttagatttattaaagttagtcatttttgctggaatttttattttaccaagtaataatattaaatgctattttaaaacatttaattttttattctgtaacatttcaaatatatgtaaaagtagaggccaggcgcggtggctcatgcctgtaatcccccaggcgcggcggcccatgcctgtaactccagcacttacggaggctgaggtgggcagataacttgaggtcaggagttcgagaccagcctggccaaccagagcaaaaccctgtctctaccaaaactacaaaaattagccaggcatggtggcgggtgcctgtaatcccagtgactcggaggttgaggcaggagaatcacttaaatccaggaggcggaggttgcagtgagcccggattgcaccactacactccagcctgggtaacagagtgagactccatctcaaaaaaaataaataaataaaaaataaaagtagaaagaatagtagaatacccatacatacccatcactcagcttcaacactggtcagctcatgaccagtcttatttcaaaggtactctttgcctatattgtcttgaagagagaatcgcrggcatcatatttcatccaaagatatttcagtatgcgtctctaaaagatgaggacattttaaaaaaaagcataacaacataccactgttacactcagatataaaatattacattttcagttartgttgatttcccctattgtctcatgaatatgcmtatatgtataattttttttacatttgtttcagtcaagattcgaataagctccatacttygtgaatttatgtcttgtctcttaaattataggttctatttgttcttttttcttacatttcagttgttaaactgttatacattgtacattgtttaacatattcccttgtctttttttttttttttttttttttttttttttttttgagatggagtcttgctctgtcacctaggctggagtacagtggcatgatctctgctcactgcaacctccgcttcccaggttcaagcaattctcctgcctcagcctcctgagtagctgggattacaggcatgtgccaccatgcccagctaatttttttctatttttaatagagagggtttcaccatgttggtcakgctggtcttgaactcctgacctcgtgatctggctgcctctgcctcccagagtgcttagatgatagacgtggccaccgcgcctggcccccttgtctttttctttccaaaaaattgcttttagatctacagatttcatcagatttgggtttgattttttttttttccccaaaaaaatattttgtaggagtgatgtgtacttctgtcaggaaagaccagataatgtttcactgtttttcttttttctgatactaagattgagcagtggtttcgggtgttgtcagcctyattcctttatttactaagtttcccatttgttttttccaaacagaaaagttgaaagagttttacagtgaacactcttgcataccctagattctacaattaacattttactatctttgctttatcacctatttatctatgcatccttctctccatctctcaatctatctcttttttatgtatttcatagtgagttgcagtcattaatatacctcacccttaatcacttcagtatttcatagtgagttacagtcattaatatacctcattcttaatcacttcagtatttacatgaactagagttcagtattatgtttttaaataaaatttacatatagtgaaaacacaartcttagtgtatcattcagtgagttttgacaagtacagacacctgtgtaactcaatcagtatcaagacatagaacatgactaacacacctaaaaagttccttcctgctccttcagtcaatcccagcaagtgccccaccccatgagcaactacctgtctgatattcttcaccatagattattttttcctgttacagaatgtctcatataaatgggattatatagtatatactcttctgtgaaaagttttataactcaacagaatgtttccgaaatttaatcatgttgttttcccactagtatttcccttacagctttgagcagtcatcagtgattataatttgtatataaattacaaaactatggtattctgtgttttgttttagctgaaatacttaaagaaaaacttgcctttatcaactgtggtttaccctgaagtacagttcagataggagaagcaagataggtttaatatttttccttaattaccagttttataattagttgattccctagtatcctccaaaggtagaataatgagggcttttctttctcattataaatttatatttaaacatatttgatatgttttaactcattatggattgtcccatctttgatcagtggcagtttactcaaattggctcattcatccttttttttttttttttttgagacagagttttgctcttttgaccaggctgtagtgaagtggcgtgatctcggctcactgcctcccgagtggctgggattataggcacccaccaccccgcccggctcattcatcgtcttgacacaacttccttagcctttgatagctctctgatataacatgcttttacagggtcatcatgtatttcctcacccagacctggaatcaaccttttcccaaaactctctggtttcatttagtgtgaaataatatttacagactacaatctgggtgctacaggaattcatcactactggtttgtcatagttwttagattttttagattttttcagtsgaaagagctaggacatgttttgtggtttgagatataatactatcttttaaaaatacaaattcatactgatattttcagtttaaaattagggctataggtttttacataattatatttacctgacgtctacatcttctttcttatgaactgaaaaacatagttgacaacaacactaacataattattcatttgctttatcctacggttaatacagcagctgcagaataataacaacagtattagcaccaacaaaatgattaccaagaatgattttaagattgtttttctctgtgaaggatgtgtaatagtcagattactgtgttttaatgttacttggaatagttcttttctatgtggttatactacatactcagtacacaagttcatatgtttcattttgcttttaatttttaggaatttttcttaataattatataaaacaatccaaaaagtcaaatctattaatagtattaaggcttgttcagaaaagtctatattctattcctgaatcctctaccttatttccttctccttagaggctaaccatttttgttttggttcaatttggggtttggtttatcctatttttaaaaacagtgttgtatatgaatatttttaattgaggcataatttatataattgtaaataaatatagtaatattacttgaaactttccatggtgatagaaatcagaaagtagttgcctaagtttgactagaaagaggctaagagattttagccctaagactaaaggctaaggggtaatagaaattcttacccctaacctcctgtcaccttctagcatattgtgcttaaagaaatttgtggtacagtaagggttctgttttaggaaaaagaaaaaacagcactgggatcacaaggaaatagataatttttggagaggagtaagtggggatggagcataaaattttaaagcacaatatttttagactacaaatttgaaaataattttatgttttaagatatagatcaaagttaattttaaagaaaggtttatttttaagaaattttgttagtgaccagcagttatattgcaaagtttgctacaacaatctaggtctcatcaaactctttgcaagtaatttttttcactctaattttttcagatgtgtttttaatgactgattcttcaattttttgtatttagggcaacacacaagtttgctgattgcaaagcaaaacgtgacacccccacctcatgcactgttgattattctactgtgtattttgtcaacattgaagtctgggtagaagcagagaatgcccttgggaaggttacatcagatcatatcaattttgatcctgtatataaaggtagttataaacctgaatttgagagtttatttgacactgtagtcgtttacaaattaaagtagtttttatatttagattttttaagattttaatgtagatttttagattttaattaatgtagtttttagattttacttttttagattttaattaatgtagattttagattttaattaatgtagaaacaagcatttatcttagtgatttttatgaagtcattttatcaataatatcaaatagaatttggaaaaagaaaaatatccataatccaaccacacttaacagctgttttcactttgaatgttttctgttctcaaacatcttacaccattgtaattacagtatgtatgttccatttttattcttttttaaaaatttgatatcataaatatttgtcttttgacatatgaacctgaagagattaacaaatgtaaattaacaaggagaactgaagattctttagaaatctttttttttccattataaggtatatagcatagcataattttcagagaaattagttcatttggtaaggataaattattgtaaaataaaggaaggacaatataaagagtatatttgagtttgtatatgaaattggaaaacatrataaaccttaggatttattttatttttcagtgaagcccaatccrccacataatttatcagtgatcaactcagaggaactgtctagtatcttaaaattgacatggaccaacccaagtattaagagtgttataatactaaaatataacattcaatataggaccaaagatgcctcaacttggagccaggtaaattgaaagttaccgtttattcaaatagtccttctttcaaccctctaatcttaaaaagtttcagtcattttctaaatgtctttaagtttctggttatgtgaaatattttgcttgataacctcttctgggttgttatttcaaacaaggggaatcaggaagatatccagatagaaaatacagctttgctaaatacagtagcctttaagtaaaacatgaaaatgatatagggtgataggaaatggcttttttttttttttcttctagagacagggtctccatttgcccaggccgctggctcactgcaattttgaactcgagcttaagtgatcctcctgccttagtctcactacaggtgtgcaccaccacacctggctttttaaaattattattattttttgtggagatggagtctcgccgtgttgcccaggatggtctcaaactcctggccttaagcgattctcctaccttggcctcccaaaatgctgggattacagatgtgagctaccactaccagcctagaaatggcatttttgatgggtgttacaaagaatacaagtaataaagcaaattaagtagaggagcaaaaataaagagattataaggataaggtagctagtgtagggattggtgtgctgcagtccaccaaaatcagcctgtgacttgtttttgtaaataaagttttactggaacacagccacactcatttctttacatattgtctctattctacagtggaagagttgagtagttgcaaaaagagtctctggcccacaagcctaaaatattagtaaatattttatctacctttttatagaaagtttgccaaccactgaggtagaggaagggattgatagggagcttgtaagactgaaaatgatagtatacccaaagatgatgctaccagcaaaagaaatacttggagcttttaaaaaggctatcaccatagcattcagctrtccatactcttctctgttttgattccatttatcacaaacagtatgtctttgcttttgttgctctggtcacagtgagcttgttagggaattgggctaatgactttactacttctctccttaccccacttatctaaagtgctcagaatacaatcagaaaaagcaataaaacaaaattggattaatgcttcatgttgtacagagaatatacatacctgaagttcttcaaaatgtggtattaagtatagaatcttaattcagtgctacaaaaaagactgatgtttattttgtatctaatactaaattatcagagtaatatgaccagttatttatctgtatttaatctcctctttttttctgaaarccaagtttaaaagccaggaaaacttttgtttttcttgattgggctggatatcttccttttgcctgtccacatctacgctctacccttctctttgttgtgtcatgctgacctgtatagatttcatctgtgggtttccattctttctagcttccttgtgactgtggttaatggaaggaagggactaggcaggagagaagacagaagaaaagtgaaattggcatgttgattttccctgcttccttccaggaactggctgtctttttttttttttttgagatggagtttagctcttgttgcccaggctggagtgtaatggcatgatcttggcttactgcaacttccayctccctagttcaagcgattcttctgcctcagactcccgagtagctgggattacaggtgtgtgccaccatgcccagctaatttttgtgtttttagtagagatggggtttcaccatgttggccaggttggtctcgaactccagacctcaggtgatccacctacttcagtctcccaaagtgctgggattacaagcgtgagccaccgcacccagccggctgtctttcaacttagggtcactacctgtcaagacagccctctctagctgaccggcttctttcaggttctggtacttcccctcatccctttgggcctagaggtagaaacagctctaagccccagagtactaactgcactgtctaaggattccatatactctgcatgtagtccctttatgaagccctccttgaattattctaaatggagtgtgccatctgtttcctgcagaaatcctaagttatattacaggccctgtggaagaaataaagggaaaaaaggaaagataatagatgtttccatacttctaaaaccaaataactttactgatttggactgctttttaacttacacttatttctctccagaggttgagtttaatgtattagtcttgtgtcaataaaatagtttcaagaggctgaggcaatagaatcacttgaacctgggaggcggaggttgcagtgagctgagatcgcgccattgcaccattgagctccagcctgggcgacagagggagactctgtctcaaaaataaatagtttctaggctgagcgcagtggctcacatctgtaatcctggcactttgggaggccgaggcaagtggattgcttgaggtcaggagttacagaccagcccggccaacatggtgaatcttgttgatactaaaaaagtacagaaattagctgagagtggtggcgggcacctgtaatcccagccactcaggaggctgaggcaggagaatcgcttgaacctgggagaggtagaggttgtgttgagccaagatcgcaccactgcactccaacctgggcaacagagcaaggctgtgcctcaaaaaaaaaagtttctgaattttaacacaatttagaagaccttactaattgaggttttctgttgtttggtttgctttgtttcagattcctcctgaagacacagcatccacccgatcttcattcactgtccaagaccttaaaccttttacagaatatgtgtttaggattcgctgtatgaaggaagatggtaagggatactggagtgactggagtgaagaagcaagtgggatcacctatgaagatagtaagtacataagtatatgaagaagtaaagctattggaattccagatgtgaactggttctggttttaataatatagcctcattgcttcttagtttgtgatcattttattcaaactgcagtattttaacgttttaatttttaaggacattaagatgtaaaattgaatatggatcattgatagtataagtctatttgatacctaattaaattatcatggaggccagatgcggtggctcacacctgtaatcccagtactttgggaggccgaggtgggcggatcacaaggtcaggagtttgagaccagcctggccaatatggtgaaaccccttctctattaaaaatacaaaaattagccgggcgtggtggtgggcgcctgtagtcccagctactcgggaggctgaggcaggagaatcgcttgaacccaggaggtggaggttgcagtgagccaaggtcacgccactgcacttcagcctgggtgacagaacgagactccgtctcaaaaaaaaaaaaaattcatcatggaatggtgacttagatacatctatcagaaaaccgttaactgttgataagtctagaacattttattcaaggagacttgtccagagatactcctaactagagaatcatatcctgaatcattaaaaccacactgtctagcaaactahaccttagatccccactatcaaaaatatacttgtattataccttttattcattttttttctaatagcacttgataagcccctgggaagcggttgatcctggaattttggttggttagtttttattttccttttttctcctatagataatatatatgatatagaataaaaaaggcacaaaaagagtgtacagtctaaagtaagatcctcactgcaaagcatctgatgttactaagttcaagaaataatcccgtggcatagatttttcattttgagaccttcctatcacagactcatctcttagttatcaatggcagtagctgtggctgaaaaaatcccctaccacctatatccctttacttccagctcttctagaggtttaggtcatgtgacttgagaacatcaaaggcagaaaagtacccttctgccctaagatttctctcataaatgctgagaaagaaatcaattttgctattgctgctgtgggagtcctcagccagattgctttgtcttgaccaggaattcttaaaatgagatacatggggaggagttcatgaaatagtttaaaatgtaggtaaaatattgtggttagtgcctgtgtgcatttttaatggacaagtgtacataatctttgtcaaatcaatgcgtgaatgaagtctctgggttccctttatgttaggaaatatttccagctcataatttttttttaataatttcatgttctttattctgtttgagtgctgcactgtactcatgtgaatttatctattttaacttctgtaccagcagcctttttcccagccttcctggtctgcctgtcctatcctttctgttttgctgtctgtaattgcctcttcatgattaacatatcagtacttaaatttttttttttttttttttggaaatagtgcctcactctattgcccaggctggagtgcagtggcatgaacacggctcgctgcagcckctacctccaaggctgaagcgatcctcatgcctcagcccccaacatagctgggactataggcacgtgtcaccatgcccagcaaatttttgtatttttttgtggagacaaggttttgtcatggtgcccaggctggtcttgaactactgaactgaagtgaaccacatccctcggcctcccaaagtgctgggatcgcaggcacgagccaccacacccagccttactgcttagattttattcaactcctgtcttattctactgactaccatatcttgttattatattcataaaaattttgagaaatcagttaatgccattgatttttttaagacaaactttttacaaaaagcttaacaatgataagtaaaaatgaaatgtcagttgatattacttattgctaaaaaattaaaaattatatgctacatttaatggctattataagttttgaaaaattaatactacaggtatttttaaaaccgaatttaattactggtatttaacaatttatgttttggctgggtatggtggccaaaccccagctacttgggttgctgaggtgggaggatcacctgagcctaggagctgaaggttatagtgcactatagtcatccactgcactccagcctgggcaacagagcgagacactgtctctggaaaaaaaccactatgttttatggattgctttttcagatggttagtgattatcacaacaatactgtgaatttgtttttattacatcccatcactctcaatcatccttatataaagtaataaacttattttagtacatttatcttaatttgttttattattcttgtgaatatttaggagtaagcaatgtgtttaaatagattttccagtttgattttcagcgataagtagtatcaacttatgtttatttcatttttattttttactgttaaaaactttattttaaaaagtttttttctttaaaaaatcatattaactaatttttcaaaatttttataaatataattagaagacctggtatttaatagaataagagaggagttgaataaaatctaagcagtgatgtgttgatcatgaagaggcaattacagatgacaaaacagaagtgaggacaggcagaccaggaaggctgggaaaaggctgctggtacaggagattcaagtagataaatacagtgccagcacacaaacagaataaagaacatgaagttataagaaagagtgatgcctctttagttgttgctcagaatacatttttacctttacaattttgaggttagaaaagagttccagtataattgatcaggctatcaccctgactaaaggaagagccaggtgttttgtgctgggttgggaaaatgctggtataaagaggtagagacaccatgcaattggagggcaagagtattaagaacaaagtaaaagaataatttgcagaattttattttactgttaaaacctttttattttaaggagtttatgtcttttctttaggaccatctaaagcaccaagtttctggtataaaatagatccatcccatactcaaggctacagaactgtacaactcgtgtggaaggtaaaaaatcacatttatattttatctcttataaatctttttttttttttttgaaaccgagtctcgctccattgccaggcaggagtgtagtggcgtgatcttggctcactgcaacctctgcctcccaggttcaagtgattctcctgcctcagcctcctgagtagctgggactacaggtgtgcgccaccacgccccgctaatttttgtatttttagcagagacagggtttcaccacggtggccaggatgatcttgatctcttgacctcatgttctgcctgcctcggcctcccaaagtactgggattacaggcatgagccaccgcgcccagcccttataaatacattttgtatggtattatgaatggaggtcttttaaatagataaatttttattcattttaatagcaaagcatttgattacwatttttwctaaatagaaaggtaatgctttatatgtattaatattatatagaagtcaggttcataaactacaaataataccttataggtatttaagtacagttctgtgaaagtataagttcyataagaagaggaatgttgtttttgtactttggaattttccagagtaactcagaaaataataaaagtttgtgataatcaaaatgtatgctggtaagtgcatgagtagatcatactaaaaaagaaggtagaaaaatactcaagcataaaataaataatttagacctacatagccacagtgcagaattgatacagaaccaaaagctaacggaatgatgctacttacccttttttagttgaggtcatgcttttactcttcatttagtatgtactagttttattttagaaccaaatttaaaatggagattgtgaatcctttccagttaaatatttagagatttgacataatggcatgatttgtgaatatgaagaaaaactgattttttattcaagatttatgagattatttttaaaaataaactattttattacagacattgcctccttttgaagccaatggaaaaatcttggattatgaagtgactctcacaagatggaaatcacatttacaaaattacacagttaatgccacaaaactgacagtaaatctcacaaatgatcgctatstagcaaccctaacagtaagaaatcttgttggcaaatcagatgcagctgttttaactatccctgcctgtgactttcaaggtttgtatctgtgagatggagcctractcttgggtggaaaaatggtggttaggtatggacagggctcccataaaaaacacaagttatctaagactgtctcctcagtatcagggataatcacttgtttattttttaattttttaaattttataaataatgattttctttttttcagagactgggtctcgccaggttgctcaggctggtctcgaactcctgagctcaagcgatctcccctggcctcccaaagtgctgggattaacaggcatatgccaccaaacccagctagtgatcgcatttttaggaatcagtcagcagacaaatttcatcaggatgcaagaacatttccatcactacatgctcacttaaacttcacagtaagctacttcattcatttaagcatattctgattacttacctggtttttaaaatattatttcaagattttgagaactttgtatacatatgactgaaacgtttatctgtagctttattcgtagctttcaaagaagaaaaattgcaattacaaaccgaaagcatttgaagaatttagggaaagcaaatttttttttttctttttgagacagtcttgctctgtcgcctaggctggagtgcaatggcacgatctcrgcctctgcctcctggcttcaagcgattcttgtgcaccagcctcccaagtagctggaattaaaggcrygcaccacaatgcctggctaattttgtatttttagtagagacggggtttcaccgtgttggccaggctggtttcgaactcctgatgtcaagtgatccacctgccttggcctcgtaaaatgttggaattacaggaatgagccacagtgcccagcggggaagcaaaatctaagtttaaaaattgactactttacctgtaagttataataaagkgcttttaggcaaggaagtatatgctacaaaaattgataaatcacatgttttggaaatgactgtaaaatatggaaatttcaaatttgttaatatttattatttcaatattcaaactttgttttaaagctactcaccctgtaatggatcttaaagcattccccaaagataacatgctttgggtggaatggactactccaagggaatctgtaaagaaatatayacttgagtggtgtgtgttatcagataaagcaccctgtatcacagactggcaacaagaagatggtaccgtgcatcgcacctatttaagaggtatacctggctagaaacatctaaattgatatcctttttctaactctttaggcagctttttcttytgcttatagtgttttggtccgttgaaacgacttccaatttatcatagcctcactacttactagatgtgtgactttcagcaagtcatacttaacctctctgaattacagtctctttatgaayagagtggggttaatactttcttctttttgtaccccaatatgattttatcgtcaagggaaaactcctaaaactatagagtatagagaaatataagagtccaacctttgctgctgattagttatatgttctctgtacctcatccttcacatgagaaaatagtttcctagagcatctggatgacttgtgtaatgtcttagaaccatcagatagaggaagcagaactagaactcagatttccttatgtctttcaattggaagtagtaacaaaggacagaagtaatgaatcgtagcgctccagtctgtgtgttatggtgctgcttaagtggttataaagtgatacaacaactttgaagasaaaaaaactcagtttatagtcttttgttgataattaataattagaattcagctgtgaataatatggttaattagagaaaagccctaagcagagagattcctgccataaagtttttgagctttagtcataatacaggctgtttggacttacatgttattagtgtacagttttaataagcttggttatctagtttactgactttatcaaattaaaaacatggtggagcttaggaagtcctgaaacaggctggaaataactatagraacttcttaaaaaaaaataaatacagggtctcactctgttgcctaggctagagtatggtggcatgatcatggctgactgcagccttcaactcccaggctgaagtgacccttctgcctcatcctctggagtatctgggactacaggcacatgctgccacactcagctaattttatttttttgtagagagggaatctcactgtgttgcaaaggctgatctccaacacctggcctcaagcgattcttttacctcaaactcccaaagtgctggtattacaggcgtgaaccactgctcagagccaatagaaactttttaaagcagcagccgatgcggtggctcacgcctgtaattccagcactttgggaggctgaggcgggcaaatcacctgaggtcgggagttcgagaccagcctgaccaatgtggataaactccgtctctactaaaacaaaatcagctaggcrtggtggcacatgcctgtaatcccagccatttgggaggctgaggctggagaatctcttgaacccgggaggcggaggttgcagtgagccaagatcatgccatygcactccagcctgaacaacaagaacgaaactccatctcaaaaaaaatagaagctagcataagttstggagacattaagtttgggtaggtagtcgtatgttgctcagtaaccctgaaagcatcacattagagtagaatataaaaattgttcattttttggtaatattgaatcattaagaaaaggtaaaatctgtttaagaaggtaaaggagcatgtaacttcatgagtaatagttaaggaatatacattcttattgaaggtataaatttcaataaaacattttctaatatgtacagataatatactgtataaataagaaaaattttagtgktgcatgctaaaaaagataaaaataaaggaagtttgttttggtttttgtttttttgagacagagtctcactctgtcgcccaggctggagtgcagtggtgcgatctcggctcactgcaagctccgcctcctgggttcaagtgattctcctgccacagcctcccaagcatctgggactacaggtgcccaccaccatgcccagctaatttttgtattttcagtaaaggggggtttcaccatgttggccatgctggtctcaaactcctaacctcaagtgatcctcccaccttaacctcccaaagtgctgggattacagacgtgagccacagcgcctggccgaggaaattttttaagatacccttttttccaactcgcaaactaggaccgttagtgctttcccctaggtcttactgctttagtcgtcttgctccttaggctgttctctcttgtaggtaagacatacaaaaattgtcagactctataaaatccagagtaatttgagatcattgttttataaattctaaatgtaaataccatcattgttcttaacaatgtattttttatccactgcattggcaatacttttacagacagttttacctgattaagcttgaatccagtacacaaaagacaatgcttacttagaaaactgcagttttaaaagaaaattaagtggtcatgaaattataatgtaaaaataaattacggtattaacttgactttttcattatggaaaaacatgcttaatctgctattcttgctttagggaacttagcagagagcaaatgctatttgataacagttactccartatatgctgatggaccaggaagccctgaatccataaaggcataccttaaacaagctcgtaagtccaaactcacttctttgaaaaaaaaagtttagggctttgtattaacagaaacattttatcgcttttaaataaagatgtatctcattatgttcaaatgattttatgacaaggaaattttactagattgtaaatgattttcagttagcaaatgtgttcactctgttacagcaccttccaaaggacctactgttcggacaaaaaaagtagggaaaaacgaagctgtcttagagtgggaccaacttcctgttgatgttcagaatggatttatcagaaattwtactatattttatagaaccatcattggaaatgaaactggtaataaaactgtatcagttattaagaatcagttattttttccttaagcttttaagtactaatttaagtctgttcttcttatacatcttatagtatattggcctcaggagacacctgagaatttgccttatggttactttcatggatttattgaaaaagtattgtgttgtgctttagaacataaaattatgtcagaacattataaaagttgttttccaacaaaaatacttyrcttcttttttaacactttcacaatgccaaatataggccaaataagcaaaagcattgaatagttgaatgaagcacagttcttatttcttccagctgtgaatgtggattcttcccacacagaatatacattgtcctctttgactagtgacacattgtacatggtacgaatggcagcatacacagatgaaggtgggaaggatggtccagaattcacttttactaccccaaagtttggtaagaaataatgaagtttggttttttttctttctcaaacttaggttagaaatgaacttagtttatgtgctaaaattgtgttaaaaagtacatctttggattcatgatgatttttatattatctggctttggttggtggtttctttatagaaagtgttattcctcacctttttggtattttattaactgcttctgactatattcagctgtactaaaaatcctaaaagaatttgtgtatctttccatgtgggttcatttttttcactggtttgggtgtgttctttccttctctatcctcatttctttcttttattgagagattacttgaaggactagtccactttacagtcttcacttccgtacctcccactcagtatttaacatactgaaattaggggtcctaccccacccctgcactgaaacctctctggtgtcactcagaagacctcttgatcatcatatgtactgcatgctttttagttttcatcttttttctactttttttttttggaggcagggtcttactctgttgcccaggctacagtggagtgcartggcatgaacatggcacactgcagccttgacctcctgggctcaagtgatcctcctacctcagtttctcaagtagctgggaccagtgccaccacatccagctaattttttttatagagatggctggtctcaaactcctgggctcaagtgatccttctgccttggcctcctaaagtgctgggattatagacataagccactgcctccagccttttctgcatttgactctgttggccttccatccttgaaactccctcctcccttgggttttctaaccatactttttctgctagcacagtctcctgagtctccttgttctttggtgttttcttcttcttctcctttttttgctttktttttttttttttttttttttgagacagagtctmgctctgtcacccaggctggagtgcagtggtgcgatctcagctcactgcaacctccacctcccaggttcaagtgattctcctacctcagcctcccacgtagctggggtagaggtgcccactaccatgcctggctaattttttgtatttttgtagagacggggtttcaccatgttggctgggatggtctcgacctcctgacctcaggtgatccacctgcctcggcctcccaaagtgctgggattacaggcatgagccaccgcacccggcctcttgaccctgttttcttacttgcctattcaaactctgtccatggctttagccatcttctctttccttcccaaatacatttyccctccctcgttctatgccaaagccataaatttaaatgtgattacaataaatgtatttgtatatttttctctcacataagctgagtgtcaagtcctgttgattgtgcgtaccctttcatcatcattttcttcaactgcaagctcctcatgctaacttctcttttcttagtgcattgcccccagtgaggtcttcacctcatcatctggctcttctgtatcttccctaaagcaaacttaaccaacattctttcttgctccccctacattttgaatcattatagaaaattaccttattttaccataattgtaacccccacccccaagtgccagcctagttaatgataagtagtaaattccatgtgccttgttggttgaatgcttgctgaatgagggaataaatgaatgagtgactacataaaataaatgataaaagttcctgagctttgctgttagggtcagtaatgaatatagtttctgggataaggttggtcccatgtggtggtatgttaataggtatgttatttaaaataaaactttataccataatcttgagaaaaattaaaaaataaacttaaaaatgtatatyttatgtatttctgtggagaccagccatctctacagagctttgtatatatgtatgtgtgtgtgtacacacacacataaaagcccatatgtatattttttgtttgtttgtttttgagacagagtcttgctctgtctcccaggctggagtgcagtggtgcagtcatagctcactgcaacctcaaattcctgggctcaagcaatcctcctgcctcagcctcccaagtaactaagactgctggtaggcaccaccatgcctggctagttaaaacaatttttttggtagagatgggatctcgctgtgttgcccaggctggttttgaactcctggcctcagtcctcctgccttagcctcccagagtgccggattacaggtatgagccaccatgctcagcctaaaatttttttattacataggtgttcattatagggaatttagactgtacagtaaaatgtagagaggaagaaaaattagtcctagtcccttaccccaaaataacatatttgtgtatccttttagtgtcttctttgtatatatttttttcctaaaattaaattatacttagtattattttataacctaccttttttcaattctctatctgtagtctcatggatccattatggcttcttcacatggcwtgagtcttgccaacgaggaccttacagcttagttgaagaaattttgcataagtaaatcagaaaaaggagaacctgtggactatgtagacagtaaatagagtaggaatttaaatataccagtagtggataattttaccttcaaaggttttatgaagaagaaaatacttgagccttgagttagtatgtggacaaataggaagaaggtggcatcttagagagcagcatgagcaaaggcacaggcttgaaaacataaaagcagatgtttaataaagcaaagtttctgcctaaattagatttggcattttatatatatatacacacatacatacccatatcaatatatatatacacacatatatcaatatatacacacataaatatatatacatacacccatatatatatatatatgatgcttagcatttaagagttaatatttgccaacccatagtttattctcaagcatttaactgatttcttgatttctactgagcttcataggatgttagttacttacaaagggatatgtgtggtggaaggataaaattaagtgaatagtatatggctgcaatattactttcatacattttttactgtaaaagactaagtaaaattcaaaattaatcaggacagtcatttaaaaaatctccaatgttarttatcccaattagtgattaatttgatgaacaagtcctcttttaaatgcagatgaggatttgtgtggtatttagggatcttrggcttgtttactttttagtttattcctactcgtgccactcctcatgcccattgagcagctcctaaagttcttagccctgtaccagctatatcctccttttgaaaaatggtaaataactcttaaaacttctgagagttgcatttttattttttagaaggttaaatgtgtagttcaattatgtttttatagcttttccattttacccagtrtttatatttgttctgacataatttctctgttatacagtattagaactcagagataaacttttactaagattctaccaaatgcagatcataaatgttacaaatggttatgtttgaaagctctaacccagtagattacccgatacactgatcatttttatcccccaaccaacatatattttatgctatgcggccaggttaatgtataagacataaatggttgggatgtgatttaccaaagagagaagagggtaaaaatcatcaagtctgaagagaccttgaaaaataattaggattgtattttatcttttcaacagtaagtctggttgggaagttgtattatgtcttcttagttcatatgtcaacattatttcccatcacacctctttttttttttttttttttttttttaagctcaaggagaaattgaagccatagtcgtgcctgtttgcttagcattcctattgacaactcttctgggagtgctgttctgctttaataagcgagacctgtaagtaactttattcatatttttgcattttcccccagctttattgagctgaatttacatgcaataaaatttatccattttaagtgtacagtttgatgaatttttgtaattacatacagatgtataactaccaccataatcacaatatagaacattttcatcacttttataaagcttccttgttctcctttgtaatctgtcttcttctcagcccaaccccaggcagtcattgatctgcttttctgtaactgtagttttgccttttctagaatttttatttatctatctattttgagacagagtttcactcttgttgcccaggatggagtgcagtggtgcgatctcagttcactacaacctctgcctcccyggttcagactcctgcctcagccttcaaagtagctaggattacaggcgcccaccaccacacccagctaattttttgtatttttagtagagatggggtatcaccatgttggccaggctggtctcgaactcctgacctcaggggatccaccctcagcctcccaaagtgctgggattacaggtgtgagccacggccaagaattttatataaatagaatcacatagcgtgtagtcttttgcgtatgtcttttacataatatttttgagattcatccatgatgttgcatatacttctccctttttttttttttgagatggagtctcactctgttcccttactggagtacagtggcatgatcttggctcactgcaacctctacctcctgagttcaggtgattctcctgcctcagcctcttgagtaactgggattacaggcacttgccaccatgcccagctaatttttgtatttacagttgagacggagtttcatcatgttggccaggctggtctcgaactccggacctcaagtgatccacccaccttggcttcccaaaagtgctgggattacaggcatgagtcaccacacctggcctacctttttcctttttattgctgaacagtattctgtagtatggatatatcaaaacttagactgatctgttatggaagtttaggttgtttctaatttttagctattataaataatgttgctatgaatattcacatacaaaactgtgcgagcatatgttttcctttatcttgaacaaataataggagtgagagtgctgggtcatatggtaagtatatgttcaactttataagaaactgccaaactttttcagagtggctacaccatcttggattgcctccagcagtgttccatattatcaccaacacttagtgctgtcagacttctttcattctagtgggtgtgtagtactatatcgttttaattttcatttctccgatgactagtaatggatcttttcatgtgtcacttacatattttcttttgtgatgtgtctattgaaatcttttacccattttcaaattgggttattttgtttataattgagctataagagtgctttatatgttctggttacaacattgttaaatacgttttgcaaacttttgtcccagtctgtgctttgtttttttgtcttaactgtggctttagaaaagcagaagttttacgcctgtaatcccaccactttgggaggtcaaggcgggcggctcacaaggtcaggagattgaggccatcctggctaacacagtggctaacatctctactaaaaatacaaaaacttagccgggcatggtggcacacgtcagtaatcccagctactcgggaggctgaggcaggagaattgcttgaacccaggaggcatgggttgcagtgagccaagatcacatcactgcactccaacctgggtgacagagtgtctgraaaaaaaaaaaaaaaaaaaaaaaaaaagcataagttttttattttgatgaagttcattttatcagttttttttctgtggttcctgagttttgtgtcctgccaaacacagtatcaaaatattttctcatgttttcttccataagttcaatagtttcagctcttagtctatgatccatttcaggttatttttgtgcatggtgtgaggtcagggtcaaggttcattttgttccttcagatgtctaattccattgtcatttattttgaaaagagtgtcttttccccattgaattgctttggtacctttgccaaaagcaattgtctttataagtctgtatctatttccatactctcacttctgtttcataaatgtatatatgtccgttcttatgccaataccacattgccttgatgagtatagctctatagtaaattttgaaaataggtagaattcttccagtgtgttctttttttaaagaagttattttggctaggttctttgccttttcatatacattttaattcagcttgtcaacttttttaaaactatagttttgattgggattttattgaatctataggtcagatttaattgaatctataggagagaactgcagtctttttttttttttttttttgatttaattcytcagctaaaacagcggaagaggkgatttattatatggttgttacactcggccacaaataaacacagaaatagtccagaatgtcacaggtccagggcagaggaccaacatgggcattttgtttttgagcaaggtgggtctcagaggtgatcggcgatcagagggcgatgaagttctagatccattgagacaagctctagacagtagcatgcagtcccacaacttgtaccagcatccccagcgtctggcattccatgtttctgctcctgtggcctccacggtgcaacaagctagcggtttacttggacctctgcytcatctttcttcttttgcrcttcagcctgcgcattcgcttcttcctccacttggctctcatggcgccgaggtttccaaaaaaatggcgctaaggccgagagagaactgcagtcttaacgctactgagtctttcaatccgtgaacctggtttatttctttatttatttgggttttgtttaatttacttttgcagtgttttgtagttttcagtagacaggccttgcataactttttttgaattcatgacaaaagtattttttgttattataaatgaaatgtttaaaaatattttctaattcttagtatatagaaatgcaattgattttttaaaatatattcatcatgtatactgagactttgataaattcatttattagtagctttttggatccttaggattttctagatacacaatcatgcttcttgggagtaattatagttgttctaatctttatgcttttagttctttttattgtcttaatgcactggctaagacctctagtacatatagtacatctagaccatataagagcattgcwttgttcctaattttagaggtgaaagtatttagtctttcaccatcacatgtgatgttagctgtaggttgaagtttttgctttgtggggtttttttgttttgagactgagttctactcttgttgcccaggctggagtgcagtggcacaatcttggctcactgcaacccccaccttctgggttcaagcaattctcctgcctcagccacccgagtagctgggattacaggcatgcaccaccatgcctggctaatttttttgtatttttagtttagtagagatgggggtttcaccatgttggccaggctggtcttgaactcctgacctcaggtaatccacccacctcagcctcccaaagtgttgggattacaggtgtgagccaccgcgcccagccgctttgtgtttttttttcccctttactactacttgcaggggggaagttcttatttctgttttgccttgctagcaatttttatcatgaatgggtgtcacaatttggtcaaatgctttttctgaatctattgagatgatcatatggtttttctccttccttccatgaatatggtgcattttattgatttttcatataacatctttgcattccttggattttgctgcattcagtttaatactgtttgcatctgtgttcatgagtgaagttagtctgtctttatgtgccttatctgtctggttttaaaatcaggataatactggcctcataaaatgaatgggaacatgttacctcctctgttttctgaaagagtttgtatagtattaatacaattgtttccttttgcccagagttttgtgggaaggtttttaattaaaaattcaatttctttataaatatagctttctttttcttcaatctgttttggtaatttgtgtctttcaaggattcattcattggtttgtctaggttgtcagctttactactttttatattacttccaaatgttataggtatttcctacaggagagtcagtctggtaggctctcactctttgaagcaccattctcagtcacttttttaaatttgatttttatatttgaacttttttggtatcagtgggaacattaatttgttatctggattcttttaattggaataccacaacatgtggcctgggtaaagattttaagtggttttaattgcagaattttgagagtttaaaaaaaaatttgaacactgattagatttagctttgttaattcattatgaatacattataatccttatgcattttcaacagtatttttctattggttataagaaaaataatttttgtttggggtagagtaggtattttttgttcatttaggtaattggtttggtttgtaagagtctttgatgaacatgtttagaaatagggactatttattgtttattatgtgtggttttacataggccatttttcttttctcttcagaattaaaaaacacatctggcctaatgttccagatccttcaaagagtcatattgcccagtggtcacctcacactcctccaagggtaagagaaaatgcttctgagttgtttataatatacagacatgttagtaggtatattgagtatctacagttagtaggtatattgagtatctacaaatgtaccaaaagataagatattcaagctgaatcaaaaagtaaatgaagataaaacagtacataactgaaaattttaatcaaaatttaatatgtatgacatattttaggggttttatcaccatcatagtatatttgttctgatattttaaattgtttagtacacattacagatgtttggttgaacttgcaaactgaaaacttgaggtgctgaaactgctatgtgatggtaactacctcaagcattttgggttgagtattaaaaccaagttcaacagtttatcattttagcactgatgaaatgatctctgggaacctactctaaactctgaattttaaatatgccccaaaggggaactcatttatatttattatcctccggtagtccttaaattttatattaacagattaaaatgtattatgtatttttatattctacaaaatctctgtcattcaggtttgattttccttaatgttttctagttttctgtccasttaatcctaggctgcctagtctaggcatgaaatattaaatactacttgtagaccattagcttatcaaaatgtaacaccaacaatattgatttagactacttagactcattttatagtatctgcattttgggtagttgacagtgacttagtgacataatacaggttatttctgtaccactgagarttactgggaagtttcagagatgcattagctctgtggctttaactaatacttgcyatatacaattttttctcytccttagcacaattttaattcaaaagatcaaatgtattcagatggcaatttcactgatgtaagtgttgtggaaatagaagcaaatgacaaaaagccttttccagaagatctgaaatcattggacctgttcaaaaaggaaaaaattaatactgaaggacacagcagtggtattggggggtcttcatgcatgtcatcttytaggccaagcatttctagcagtgatgaaaatgaatcttcacaaaacacttcgagcactgtccagtattctaccgtggtacacagtggctacagacaccaagttccgtcagtccaagtcttctcaagatccgagtctacccagcccttgttagattcagaggagmggccagaagatctacaattagtagatcatgtagatggcggtgatggtattttgcccaggcaacastacttcaaacagaactgcagtcagcatgaatccagtccagatatttcacattttgaaaggtcaaagcaagtttcatcagtcaatgaggaagattttgttagacttaaacarcagatttcagatcatatttcacaatcctgtggatctgggcaaatgaaaatgtttcagraagtttctgcagcagatgcttttggtccaggtactgagggacaagtagaaagatttgaaacagttggcatggaggctgcgactgatgaaggcatgcctaaaagttacttaccacagactgtacggcaaggcggctacatgcctcagtgaaggactagtagttcctgctacaacttcagcagtacctataaagtaaagctaaaatgattttatctgtgaattcagattttaaaaagtcttcactctctgaagatgatcatttgcccttaaggacaaaaatgaactgaagtttcacatgagctatttccattccagaatatctgggattctactttaagcactacataaactgactttatcctcagactagctgaatgattttgtgctgtttcaggatgtttgcactgaagaaaaacagaaagcttatctgaaatttataaaactttttgttttgctacatagaaaacagaaggtatttgaataataagcagtgatatgcttagtgagcacagctatactgattttgattagaatagtcatcagagtggcttagggacagttaatataaaagaggagcaaggtgtagaccatcatctacttctgctaaaataacttaaaaagaggtccataggccataactacatgagcccagcttttgtaatctgacaaaaaaatgaggagcagcytcgtgtrtatcagtgtacacggtattccttaggtcccttccattggtagtgatgctgcgagttattactggagaaaaggaattctagagctttaacttggcagattaaaagtactcattttttattcatcaataattagtaatctcactagttttcaaaaatttgcatattattgacaacctctttgaagatgcatttcacaaactcaacagagtgccatgataagagctagggatcccccaaactatctcaagcatctaaaaaattgccatttttaaaggcttaaattgtagtagtaaaggggaaaacaggaagtagtagtaaaggggaaaaaaaaccaataaagcatctaaaaaattggcatgttraaaggcttaaattgctaatgtgtrtatatatatatatatataywcacacacatatacacacacatatcattgacttttcttaagacttcagagtactgggtagatgaacactttatacagtatatatcttcagcttaaatttgttttgagtattttttttatttttaaataagtaggcaaagatttaaatttttttatttttagtaaatgtttgaggcacactaagacaacttgggcaatatttgccaaaacaaaacagaaccccaaaaaatgtacatcttgttcttagcaaatatcattattgtagagacayttaataaagagatggtattttaatgtctgcagttctgaggtagggtggaacttagttctacattgtgatttaggaatttttaaaaccttttttcttcaagggagaagtgacccaggcctcgagtttagtgctaaagccgctagtgtacttatgctgtcccctaaccaccacgtgcgatatggaagcagatgctaaatataggggttttcttagaaagtaagaggaaattagcaagcgttattagtgattgactactgctatcaagtgaattcaaaggaarcaggtttttatgccatatttaagttacagaaaycaggcatgcttagaatagtttctagaggttattggagaatagaaagctaagaaaacttggtatacatttacaatggaaatataattacactttttactctcagaatattrttcasattagacttcctgtttatcttttatattcttgcattkatataatgcctsatcctttcaaagttctttcacatattatatgatcttctttatgaaaaaaatagatgtttcattctgatatattcagtttcccactttaggcaaaagtrgattaatagaatgaygaattcaaagtagatgaggaaaatcaggcacagagaagtaraggtaggkatagacccaaatttacacaacaagataatgacatctccagcttttaagttgatcatcaaaggctgggctggatttgtcttgctgtatgtgtcaggaaatttatacctattacattttccattttctcaaaatttaagtcacatgactaatrtttagctgcaactttyctcmtaayaaatagtgtcatgaagaatgttgtagtgygaagtttgtacatttcagggtcagatatacaatatgamctcttaatctacaggaatgagaatggaggatcattgaargccatgatataaacaaatttgcatgttgaagcctgtataaaacatggtacagtgagtgaatatacccccatccccaagaacactttatacatattaaatggatatatgattactgtgcaaaaattcattctggaaatgaacatatatttgagcmctaatatgtaatgtacacctgccctaaggagaaaataaattataaaactttttacattcaaaattactttcccaagcatgtcttagaataatctatgtgttgatgcatgtaaattgtactttaggtaggcaaagaaatctggttatttatgtaaaaactagyctaataaagttagttagtggctttatcactttaaatctttagtgtccaaaagtggtgtttaaagtaatagcacatcagaaaaccttgtctggacaaaactagttcactcactgcttctgcacctgcagttgctccctttagggttataaaataatgacccaaatgttacatgtrttgatattataacttgtcagttactgatgtctgtggtatcctaccctcatctctgaargggataatactgaataattattagaaaactataaaacttcacactttgtaccattaaaacctaaaattttaatcttgtccttttttactatggatcagtcggcactcgggaacagcagcaaggaaaaaaagcaaatttcattcacatgttctgtgttcatacctcttctctacctaattgttcatttaaatttcagccttattccttsataagggattttaccacatgaagtcatccagtgaccctagctcttattgtgaagtrastggagtatacttagaaatgttacaactttaaaatgttacaaaacattcattaaagctcatatwtaaagtagagcatcyagtttgagaaatagaaatcaattattaaagatgtcttttttctmcccatttaactagtwaaaaccatgayrtgtaaatgtagaagtagaataatcatagaattccctaaaatatttctgtttactaacatatattgaccaagtacatcaagcaggagagmtcttccttcattctgttatagtccacatcattctaattttgctcagttgttattaaragcatattcctaaaccayacacttttgtttcaataaagttttattttgttgrgatgaataaaatawcaaagttawaagctgcataagacaaaagttcarttgttcaaaaaaaatttactgggayagctttctattacaggtattgttagattatattgtgctgataakattactttctaaaaaatttgtacttttctgtaaattaaaagaatatggagtcataaaatggcaagtgttttaggattagcstaaaattggacattgtcattgatttcaaagaygrtatgaactagcagtcttacagcctaattcttctttggactggtccttggcagcagttccttttcagactcgataaacagaattcagatgatgtaagtcaaaayaaaactttacaaagccaagcgtattatcttttgcattaacctatttttttccatcatacatgctactagtatgtgcattagcatgatattctcatatacattgcattaaaaattaaaaggtrgcagctcagggtgagctcttctgttgctcatttgttcctaaatttttaagggctttttctcagtcaatagtttgtacaaactggttagtttaacttcattacccatttcattaaagttgatgggtcgtgtgatgagatgcatttaaggccgatagtgatagatgttttttttatttcttgaacacaggctttgtctgaatgatgttcttttatctcttgaacacargckttgaatgataactacaggttttaagtgctgttacattaataccataatgtgatgtgttagaaacaaaggratatttcaaaggtagatatttgaaaattctctagtctcaatatgtatgtgtattgaatatactctaaaaataaatgtgcaatttgctagtaggacaatgcagtgactgactagcattaggtatgtttcttttatatcctagctatgtcccactttcttctaagtgcaatcctttcatgttcacttgctgttttaccccayctactctaacwtcatttggaaggcttgtctagagtatagcatgtatttttacctttgcagtgaattgcatgtgctaattgtaaccmcagctatttttatgttgacataactccaaatgttatattaaatgttctattatatattagctctaatcccttaagtaaattttaagaaataaatacttgttcaaattttttttctgtatgtggttactatcatctgactatgcatatttgtaacagcatttatcattagtggtgttagctaaataagcatcttagtgtaaatgagatgcttcgtgtgggttttgtgacattttaaatgacataatggaatgtgatttaaaagaaaaccagtacactatcttggtcttaataacatagaatggagatggcaaatttatccactagttttccagatttactatttaatagctgaggtctgaaatcgtagcatcctccctcctagtggacattaaaaaaaaaaaaaaaaaaaaaamcctacttggttgtcaagagcccaagtatggaggtgctgcgccatcttgtggcctgtctgtgcccaccctgcactctgctggagtctccatccttgttgcagtgagacttgaagttcaagattgatacatggcatcctcctgctacttcttgaggttactaagtagtatatgaaactaatcagtcagcaagtccacctggaaggaaaagaaaatctcaactattaatgtgccttcacattgtgattttgtctaaaaaaatgtagtgagtcaaaaaacccacaagccagccaacagtaactccttcacatatataccagagtttatagaaataacatgtcagctttgggctatgtgctcctttgtttaaaatcttctatttggttatggcttgtataggctcaagcctgatttctttaaggtgtggtggctcatcttatcctaatgtgtatgatagatacagtccatcctgctttggaaaagattatgtaactccttgagagcatactctttctctagcccaaaggcagtgagagagttttcttgttcaggattgcttaactttccatttaagctttttctttttaaattaatacaaacttctacactttcaaaatacgaaatatattacaactgcgtataggctcttccatacttaagtccagtgcttgggcaagttaatggagtgaaagactacaagcaaagaggaactgaggtagaaaaagaagaatgtgtgaaagcagcaggaagctcagccaactcgaaagcagggtgaacagcttgagtcctgttgctgctgatcggggttggctcttggacaacttagtaagatcatggaaaggctgcttgggttctccatabaaaagttctgtctccatcaagggaggaaaatgtacctttcaactcaaaattcaatatttgtttttaaatatagctattttccccaaccgctaaagattttcaacagatamgaagccagagcttagttttagaaacctgtggacattcaaacctgattctttattccctgtgactatggttatgtcattttacatgtcaaaaaagtgtatctagaattgtcatttcttatttttgagctttttttagtgagaattatcccctcacttaaatggctttttatttaaacatctgtgcattctgtatgaaattgtagtctttctgggataacatggtgagctatatggtggtaatccacacacacaaaaataaaagccaaaaaaaaaccaaaaccctcaggtaaagtatttctctttcttcaactgtctcattagccctggctgtggatggtctttctgagacagg

SEQ ID NO: 13255 - DNA, 101001 bp, Homo sapiens
  misc_feature (1)...(101001): n = A,T,C or G, or insertion/deletion polymorphism (see Tables 1-2)
ttccttatctgtgatataggtatactagtttcacctgcaaagggttactataaggatgaaataagttaatatttgtgaagtatattgaactgtgcctggcttatagcagtactatgcttgctgattaaaaattaagtacctgcactgggatacagtgstaggagccagagcacaaagaggagcaagaccaactccctgctttcatgacactcacaatacaaaagacagatgaattacttttattcctttaccarccatttcagaactaagaacaaaaacatgttttaccattactgggtacccaattctcagtcaatattaacataatattgagaataacatttaataaaaagtaatgttttcattaaaacatattcagagtagggaaacttattaaaatatattcaagaaagcgttaacttttaggaccatgagctaacttttaggacaactgtggaaaagagactgaaaggctgcttgagacctcccacatttagatctaagatgttatgatgtctcgatcacaggaggggcaaacccactaaaccaatggttcatttggtgttccagtgcagttccaggcacttccctgtaaactgcagcttcacaaactacatcacatctcgaagaagatgttcatgataatgccctaagagaagccattagagggagtaggagtgctaggcttgaaaaagactatactggacagtatttttttttttttcccagcttggaaatgttctctgatttaggggaaacaacatgttttcctctaggggacagtgtgaagaccagatttcaacaaacccaaagtgccagctaagagggctctgggctgtcttccaaaaagagaagatgactgaaaagagcattggctttgaagtcagaagggctgagtaccaaccccatctccatggagccatgagtcttctaacattgccccccaaccacgtctgcaatctcttctcaggttgtatttcagctggatgttgcacatcctttgcacgtgtgtgcrtgtgtgagtgtgtagaagcactaggggatgggggaaggtggggtgggagtgggggtgtcttcctgcttgaaaagcttttctttctttttttttttttttttttgagatggagtctcactctgtcgccaggctggagtgcagtggcgtgatttcagctcactgcaacctccatctcctgggttcaaaggattcttctgcctcagcctcccgagtggctgggactacaggcgcgtgccaccacacccagctaatttttgtatttttagtaaagacagggtttcaccacgttggccaggatggccttgctctcttgacctcatgatccgcctacctcgacctcccaaagtgctgggtgtgagccaccgtgccaggcccaaagctttgcttttctttgagtactcagtcaacctttttttgtcagccttttgagtctgcttttccagactcaagcagaagctgatcacagtgattaacgagacattaccagtccattcagactataaagtataaccatgtataaatttcctcacctactacaattacatattcatctgttgttcacatggtgagtctttgaggacaggggtatgcatctatttacctttctccttgcagcacctggcttctaaatatatgtgggctgaatggacaagtgttttccaatagtgattatcacatggcatagacatacttggatcaaargccctaagtgttgggaattacagtcacagcagycacttgctactgaggcagacatgcttctccatttcaacaaacacactgccaagataatcatttctctgatgtccaggggaatctatccataaaatggttgctcttttgcaactgaaaaggtgttgcatgtgacacagtattgagtgtggtaggcagaacttaaggtgcagattcagagaccgaagacttcacatttctatttttttttttttttttttttgagacggagtctggcgcttgtcccccaggctggagtgcaatggcgcgatctcggcacactgcaacctccatctcccgggttcaagcgattctcctgcctcagcctcccaagtagctgggactacaggcgccctccaccacacccggctaaattttgtatttttagtagagacagggtttcatcacgttggccaggctggtctcgaactcctgacctcgtgatccgcccgcctcggcctcccaaagtgctgggattacaggcgtgagccaccgcgcctggccacacatttctagttctagccctcactgtccccttcctcagggatcatcttttttttttttttttgagacagcgtctcactctatcacccacgctggagtgcagtggtgcgatctcggctcactgcaatctccgcctactgggttcaagcgattctcctgcctcagcctcctgagtagctgggactacaggcgtgtgccacctgcccggctaattttttttttgagacggagtctcgctctgtcgcccaggctggagtgcagtkatgcgatctcggctcactgcaagctccgcctcccgggttcacgccattctcttgcctcagcctcccaagtagctgggactacaggtgcccaccaccatgcctggctaattttttatatttttagtagagatggggtttcaccgtgttagccagcatggtctcaatctcctgaccttgtgatctgcccaccttgacctctcaaagtgctggaattacaggcgtgagtcaccgtgccgggcgtaatttttgtatttttttagtagagacggggtttcaccatattggccaggctggtyccgaactcctgacctcgtgatccacccgcctcggcctcccaaagtgctgggattacaggcgtgagccaccgcgcccagacaggaatcattatctttgcgtggcagggcattcattcaatttggatttttgcagatgatgataatttatacggtgggtattcaccatgctatcaaaacagattaacttttgaacttctaagaaaacactagtcagtgcacccaccaaaccacaatttcctttcctttttttttttttttttttgagacagagtcttgctctgtcacacagtctggagtgcagtggcgtgatcttggctcgccacaacctgtgcctcctgggctcaagcgattctcatgcctcaacctccccagtagctgggactacaggcatgctctaccacgcccagctaatttttgtatttttagtagagacggggtttcttcatgttggctaggctgatctcgaaatcctgacctcagctgatctgccctcctaggcttcccaaagtgctggaattacaggcataagctactgcacccagccttctttcatctttttgtctttcatcattttatgtgctgggctttctttttacattttatttattttagtaagaaataacttccagtgtaaaagtatgtgtaagtatgccaccttctggataacaagagggggtaaagatacttatatgtagtttcttgtaactctgcagaacatctttgtaaggatacagaggaatgagggaacactggttacctcccaggagaagagctgggtgtctagcaggcagggtgagaaggggactttttacttacacccttttgtatctttgggggtggcaccatataaattatctcacttccttagatatgcaacacaagctaataattttatgtctaatattttgaaggtgttattcaagtgccttcccatgaatgttcctgccaaattaacatagctgagggaaaatagggcttaggtacttggtcagtaaatgacatctgtggactgtgagggaggaagttcaactcagttgtctaacatctcttgggttttatggtcattttctatttttaaaattcttttattttcttcctgattcaattaacaagtttttatttagtgcctactctttgcccagtactgtcctaggaatcctaggagatataaaagaagccgtcatgaaacaacttttacagttcttgccaagtgtggagatcactgtggaatggtgtggctagaaagtcatcctggaagcagagtcttacttgcagagaagcagaaggcttagacaagtggaaagagggcaggaggggctgctggccaggggcaaagcttgacaggggcagaaagcgatataggtggtcagagaggcccgtttggaaagtccctataggtcaggcagaagaacttaaccttgggagtccattaagagtgataagagaaggaagcctggtattagcaaggaaataagagagaactgagaaaccagatgccaggagaccacccttgttgcaataatccggatgtaaaatgatgagggtttggatttagaatgttccagggggaacagaaaggaaacaaagaattcatgagacatttcaaaggaggaaataccaggtcttgatgacaggctggagatgataatgggagaagtcacacatgattccagtttttctaccttgggaagccagcaaagtgacttctttttagatctcttttctttgctcacacacaaattgaccccctcatagagttcagttgaaatatcaattacaaacagaattgatctattttttttcccttagaaacacaggtaatcttatttgcctttagctaaacgacccaagatgcaccttgctgggctttgctcttggatagcactcatacctctatgacaatgctccccactttggccttgtactgcgtgtgtggtgtgcaggtgcgtttatcacccactaaaccaaaagtccgtgttgtgcagggaccacgtctcatgcagagttaagtattcaaaagtttttgttaattgtttaagaaaatgagatttacatgaaacaatactttaaaaagctttccagaaacaacagcattaaaacaraatcactgaaattaaaatttacataaattaaaaggttctgtgttccacatgccaagaaaagatcttacactattgtaatagtggtagggtcacacagttttattcctcagcttaagtgctgcaatacagtaataatgcagtacaagaatactgtataataaacsttaaacgaaacacttcatatatactttacacaagttattggatattgcttagtatttatttcccccacccctgctgtgcaaagatattaatatccctcttttataggagaggaaacaggtaaagagaagttaagaaacttgcacaaggtcatccagctagtaaatgttggagctgggatttgacaactttgtcaagtctccatccttaacagttctgctctatattgcataagcagacagctcccttttggggactgacaggttatttgaggcatatgaaccatttttggtgggggggctttcccacccagtactggaagtgtctagttatatggggcataaccttaggagcaagcaggaaaagaagaaatgtattccaatagtgttcagaaatataccagagtaaacgaataaccatcaataacagcattttacagcctacctaataacacaggaataaaaccctttatctggaacctaaataataccccctccactcattttattaaaagccttgctttatttggaaactcttaaaataagtggtcatacgattaaaaaaagcagcggcgcgccccctccccggcggccgggcgcagctgtccgcgcctcccccgcgcggctgcccgcattccaactctctgaggtcacgggccgccgccgcctccccggatccgcccgcccggctcagggggagggacgcctgggcccggccgccccgctgctccggccgcgcgtcccgcgtcggtccgacggtctgtccgtcctcctgccaccccccgcccccacggggcttctttgtgyggcgctcctcgccggccggtcccacctccaggcctcgcccctcgccgtcgccaccgccggactctgcccaggggaatggtctgcgagccgggtttttggagacaggaagtgaggcgtgcgagccccatgagcgcgccgcggcccgggctggcgtgcgggtgcggctgcggcggccgcgcggcggggccccgggaggcgggtcgctgagcggggcgckcggccccgaggatgcgggagcgggagcgggagcaggtgagggcgcggtccccggccggcgggaggggcgggcggctggcccgagcggyggggtgtgtccactcgcccggaccccggagcgcgcccgcggccccggaatcccggagaatggggcgcggcggccagacccgtagcgggagcgtaacaaagagaaaagtcttgtttttcaggttcgctctcatatacttgagtaatttctaaaaggagtcttgaacttctattccgaacgccctggccgattgttgcgggttaattctggatcaggsttttaaatgtgttaggcatatttgtgcctctcagaatatataaacgtgaaattcgccagataactttggcgagaaggggcgcagggaaggactgtttggtaacgcctgggtttgtttttggagtagagtatttactctggaaacaagaattcttggatctgcaaattccgacttgtgatttctgcaaatcctgattagattggccgctcttggcatgctcgtcctattttcttttttgctragaaagccttatactaatagcgtatgctcacaaacacattcagaacattcgtgtgctccaagtgacaactgctgtatgcctaatagttgctgacagtttatttatttttttaagtttgggacacgacagtaattttactctgaatatagtccgtttcgtttctagggcattttattctggagcatctacgcacagatgttttctccgtgagaaacatgggtttaatgctatagctatagatattactctaaaaatgtcacatactctctccttttagtgcttattttattttaaagcaactttggcaaaattacatgtggtaaggaccttaataggaaaggggaaacgctgtaagattgagaggtaaagtgtatttgaggaacttttggaaagggttgtagagagggaaaattaaaatgaattcacaaatagttcagactgccttttgtaaacttgtactgaagcagaatctagtatgtatctgtttacttaccacaaaacggaaagattttgtagagaaaaaattatatcctagttttcctttaatagctatttataaattatgtttactttagtaaattataattccagacccaatcactttcatattattgcatattattttatacctgaaacagacctccccaaagaactcttaaatttctactcatcttggttttattatcttcagacattcataattgtattacaccatttggcaacaaatactgcatattactgaaaattaagatgtataaatcattgataaatttgtaaattattaaacaaaatcattgttttaacatagtgggttttatataaataagcaaaaagcaagccattcttatggatagatcttggggggatgcaccatgtacacacacactgcaactttttcaatttcatctaccaaaataagagataattttgacttttcctttatccctgatgcagtaatacatttcaagtctgagggacaattgaaagttttactgagtttgcttaatcagagcttaagttaataattaagttatacagtgtagtatctattgctttcaaggcatagttctatgtagtgaaaagactaccatatttgaatggcacctaatacaaatatttatctttcctctacacatatgcaatatcttgtctgttcatctacactacttaatccgcccggtttccagttaccataatttttatgtaaaattgaaacccaccatctgatctcatgaaagggtgtttagtatgcatatttataatccttaaatatttactcttggtttatcaattttctagttaaaagcttattatttaaagttgtcatttgctaatttttttccatcttgctttacttatttagtttatacccctgaaacagcaaagagcattgaaaactactggaagtggaaaccatatcttttaatacttattttctgtttccctccatagtatggtgcttttacctacagaaggcactcagcaaatgcggttaattaacacagtgctttaggtagttgcagcgttgtttttttcttctggccttcccctatcccttgtttttaatattttgattttcctggctatgggaaataaccagagctcaaaacaaacaaaaaaactagccagataaaaccgtggttgggtccttattagagatacagctctgtatgtaattatagcatggttgtaatctctttaaagacagcgacggtttagggattcgtcttagatttctcacgatgctcattacgctgtcttgttcccagagacgcartacacatttgtggaatggaatttcaaaatgttaagtttggcaaagccgagggtagtagcggaacccttttctccaggtctgccattccctaaccctaagtgccccatcacctctgggcctgagacgcagtcaggagagcaggacccaggagaggactgggactgtggaatttgggatcgattcccagctcagcccgtcctagcgtgaaactgcgaaagccgcttctcttcctgaagcctgggttctgtctgccagatgagagggtcgggaatagatcttgcctctccgcgcggtcccgggccggaactcagcgtagccagctatggctgggtctcgctaagcgattcatccccaacaggcaatctctgcgcagaaggaaggtagggaaccgtctcaggaccctggaaatgtccgggattttgtagactcgtttagggggaaaaaactaatccagctgatataaaaatccccagctagtgctcgccccagaaaccatcaacaggtctggttaaaaactgttagagcccggcttggtggcgcgcacctgtggtcccagctactcgggaggttgaggcgggaggatcgcttgagcccaggtgttcgaggctgcggtgagctacgatggcgccactgcactccagcctgggtggcatagcgagacttcgctctataaaacacgttgtaaggagcgtattttgaggtcctgtggctccaaagcgggcatcctatggggcccgcccarcctctccaccgccagtagggcacgcgctggtccctttaaatgttcccttcgggagccgagggaccggtccttttagagcgcgtccgtccagaaacgcggctgcagaaagagggttccggggcctccgagtctactggttggcctggcaacgccgcgtgctcttcccaaggggaggacgcgggagaagccggggcctgagtgctccaaggccccgtgggcttcttgggtttgttgcctccggccgctcattaactcaggatggcgtggaagacctcgcccgcctccccttctgggccgcggctccgcttaggtgaaggcctgtttgggcgtccccaccctggagaggggccggggtctggattttcagaactgccactcttctagtggtaaatggataacgagcatttgtagggtcttttatgatgtttatcagtaaatcaatttgatgacgtaaatacttccacaagcgcttgttaggcacctcaccgggtttgaatcacacacctgcctttcttagtggggattattcctcccatttgccttcagggttaattttctaaagggattgggactgaaacctagctcttttggggccatttggcacttttctcacttaaggactraagaactctgacatttggagtattacaacctgaaagagttacctatgaaaaaacaacaccttatccaaaataggaagaggatcacaattactaactacaaaatttrggattatagtagtgctggctattatctcatttaatcytgaggatggcccagtttgctatccctatttgtaggatacagtgaagggtggagtctgaccctgagcctagcacaactctgagataaaattccaccctgccttccgggtcctgttagtgccttttttccagyggagagggacggcttgttctttggccacagcttgactggcttttctttatayaagcaaagcccagcgttacgtttrcttaactaacggcgttcctctttccccagcgctggcgtcaatgctcccttcctcgggccattggagactccgttgctttttaatggcggcagcggctgctgggtgagcagctggaggccggacagtgttcgtcccatmcggagaggatcgctttctcctggcgtcaccagcgctgggttggtgggggtagcttttccctctttgctcctccattcttgaagaaagaagaagatgccactgccatttgggttgaaactgaaacgcacccggcgctacacggtgtccagcaagagttgcctggttgcccggatccaactgcttaataacgagtttgtggagttcaccctgtccgtggagagcactggccaggaaagcctcgaggccgtggcccagaggctggagctgcgggaggtaagccacctaaagacactgcaggccaggcgcgggtggctcaagcctgtaatcccagcactttgagaggccgaggctggtggatcacctgaggtcaggagttcgagcctagcctggccaacatggtgaaaccctgtctctactaaaaatacaaggccgggcgcagtggctcacacctgtaatcccagcactttgggaggccgaggcgggcgaatcacaaggtcaggagttcgagaccagcctggccaatatggtgaaaccccatgtctactaaaaatacaaaaattagccggacgtggtggtgggcgcctgtagggtgtggtggcgggcacctgtcatcctacctactcgggaggctgagacaggagaatcgcttgaatgtgggaggcagaggctgcagtgagccgagatcgctccactgcactccagcctgggctacagagcgagacacctgctcaaaaaaaaaaaaaaattggctgggcgtggtggtgggtgcctgtaatcgcagctactggggaggctgaggcaggagaatcacttgtacccaggaggtggaggttgcagtgagctgagatcacagcactgcactccagcctgggcaacaaactctgtctcaaaaaaaattaaaaataaataaaaaaaacacgacaggcttctctggcccgcatgctggctgtgtgttctagcccacgggccactcactgtgtgtccctggctgggatgtctgagttgagcctgtagtcccctcctcatgaagcaggaatagattagattaagaagtctccccttggggtgccctataagaactaatggttcttattttgaatatgtttatattccccctctaaggtaatccagaatcaaatgtgaatacactttgggttgttcaaatttccattttctaatatacccccaaaggtcatcctgatctctagtacagtttactgacttcattctttcttttttgttcattttaatttttttagagwcaaggtaggtctagctatgttgcccaggttggtctcaaattcctaggctcaagcgatcctcccgcrataggcatgtgccaccatgtccggctcttgacttcgttctttcaacattcattgagtaaaattcattgactatattcttacaggccagatcgaggttctagaaacatactgcctgaactcagtttgagttctagtttcctcaccatctgcttctgttaccttgggcaagttatgtgatatctctgagccccagttctccatctgaaccatggggatgactgtgacacctaattctcagagtagcataaggttgtaagctctgctaactagtctattagagtaccgattgggaggtttgcccaggaaacccctaatctagttggtaggaagttatggagtactcatgtatccatataatgtcttaaatttaaaatgttatgcaaggcctgtgaagaaaggtctctaattaaacctaggaccctccctacctttggctacctggttcttgggtaagggaaagttagagaaactggttattccacctaaaaagtcaggaatagatgaactttgctcctggtgaccatccaatcacttatatgatcactcagtactgaagatgcgtaagtgccaagcacatacatacttggaagctcaccctagtgttgttgccagtaagaaaacaggcatgatgcatgctgtgataagggaagtagagggtgtgctataggccagagggaggtgcagcaaagggaaggctgctcagggaatttgattctgagctgtgacctgaggatggggcaagggagtcctatcaagggctggaggagttccaacaaagagaactgcacaggaccaaagacgcagaggaagctggtctgcctgaagcctgaagtgcgtggaggaaaggccgactgtaagggccacacaatgaggattttttgttaaaggatttagatttatcctgagggtagtggggaagttaatgaagggtgtaaacaggtgtggtacgattgtttctgtgaagagtgagccctttggagaatgatttgaggggagtggttcaggtacagatggtagccacctggagttggatagggttggagagaggtggttggaatctggatcaggacctaccgagtaatagagaagggwtagcatgggtcctggttgatattcaggttttcagtagatggtggggctataacagagaggaaatgtgaaaggaagtgcagatctattaggggcaaggaggagcgtgtggtgagttcagttttagaaatactgagtttgaggtgccagttggaggttttgaatagacagatggatctgctgatctggagttcaggcatgagatccaggttagagggaagatattgggaagtatcagcctaagtgagttcattaaagccagaagatggtatgaggctctccaggggagaaaaagaggacatcgcagacccctcatggtagattagaggaggggaaagtgttggaaggaaactgagatgaaactgccgaagaagaagaaagaaaaccagaacagcaggcctcagtaaccagtccctgcttacttgcatttattcttttttagggatgaggtctcactccatcacccaggctggagtacagtggcaccgtcatagctcaatgcatcctcaaacacctaggctcaagtgatccttttgccttagcctgccaagagctgggactacaggtacactccaccacacccagctaattttttttttaacttgtgtttttgagatggagtcttgctrtgtcgcccaggctggtctgggagttgtttcctctagttatcttcctgcctcaactttgtgagtaggtgggattacaggcgtgtgccaccttgcctggcttagtggcttatattctatttatttatttatttatttactttggttgcttcgactttttttttttttttcctattatggtttcttcttcctgtaattttcttcctcgtgcaccaggtctgtctataacgcctagagagtcagcttcttgaggaactgtggtttatttatttttataccaggtgtggaatgtgttcagtaaatacagggagaactgaacccacaggcattgccttccttctgttaataagtccagagaaattgccatcccttgttagaagttatcagtctcagggaacaagtaactttatatagctgtgggtatattttgagcctgatttttaacagaagaggaaacaggcatggtccctagaaaatgttttgcctgtggagagtctgtcccacaatttccaacataaatgtaacagtcatgggtagaaagtttgtatagcaaactttttctttgaaagccccagaagctctgctctgtagcatataaacagatggctcaggcatcaggcctaatcttaacaaatgactgttcagaaataatctgagtggggtcacacctgtttctagtttgtacatatagtctctgtgtgattcataccaagaaatatcagtatgttggtttcttgcactgttctcccaccaagcaaatctggaattatcgcatatagatttgggtggaaaactttgctactgtccaaatataaatggagggaaaagtccctcttgcttaattgaataccatttcacttctataatgacaattttttttttttttttttttgagatggagtttcactcttttgcccaggctggagtacaatggcgcgatctcggttcactgcaacctctgcctcccgggtccaagcgattctcctgccttagcctccccagtagctgggattacaggtgcctaccaccatgcccggctaatttttgtatttttgtatttttttttttttttaagtagagatggggttttatcatgttggccaggctggtcttgaactcctgacctcaggtgatctgtccaccttggcctcccaaagtgctgggattacaggagtgagccaacgtgcccgggcctataatgacagttacaagggccgcacaatagtataacactatacccaggggtttcagctatatcagtagtgtttcttacactgggtatatgggtattttttttgtttgtatttttagctgtcatatttttacaagtgtctaagatattttgtattaaattaaaagcaacgtggttaatatacatgtatccaatgtagttaacttaggttgctaactttcttttaaattcaccatatttgaactacagaaagtaacttctttttttttttttttttttttatttgagacagagtctcgctctatcgcccaggctggagtgcagtggcgygatctcggctcactgcaacctccgtctcccaggttcatgccattctcctgtctcagtctcccaggttcatgccattcttctgtctcagcctcccaagtaactgggactataggygcatgccaccacgcccggctaattttgtatttttagtagagatggggtttcaccgtgttagccaggatggtctcgatctcctgacctcatgatccgtctgcctcggtctcccaaagtgctgggattacaggcgtgagccaaagtaacttttaaaaatgggaaaatgaattattcccttaggaaaatattgctgttcgttatagcagtagtttctcaaagctgttgaaattccctgcctatcattcttctgagtttcaaaacattttttcaagagaggctgtgagtccttgtggaatttaaggggagctagaaaattttctccaattttaaaagcatatgctgtagaggcttgaaggaggtggtgacacaagtggccacctgggcatgggcactgcctggggcatcaccttgacggaatcagcacaatccagagtgcaagagtcaggctcaaaaatctcatgtcatgggaagacctgatttaatctagctcgctaaaaatgatgtgtaaaaccaggacccaagtttagtaatttataagcagtaaggaactgccaagggtcccaggtatgtgtgccctctgcctaggccaagattttcctatagttagggcacatgggaaccagaacaaaccagaagtttcttggtgaacatggaatcagaagaatgttaccttgaaaaagtagatattttcataagtcggccaggcgcrgtggctcacgcrtgtaatcccagcactttgggaggccgaggtgggcagatcacctgaggtcaggagttcaagaccagcctggcctggccaacatggtgaaaccccatctctactaaaaatacaaaaaaattacccatgcgtgatggtgtatgcctgtagtcccaactacttgggaggctgagacaggagaatcacttgaatccgagagacagaggttgcaatgagccgagactgcgccactgtactccagcctgggcgacagagtgagactctgtctcaaaaaaaaagaaaagaaaagaaaaagtacatatttttataagcagagaattgctgcctccaggaccagacaaattcctttgagtcagggcaccttttcctctgcgcggtgcttcagtggtgcttcagtgcctgtctgcctcttgagatggctgcttagtaaagtggttaagacagtctgcagtattcagaaacacctaggttgcatccaagtgctgtcatttaagtaattattaaatcacttaatttcccaagttcattgatttttcatttgtaagttggggataataatagtacctacttgatagtggttatgaggattcggtgttaaatgtaaaacatttagcaaaggacctggtatttgggaaactctcaataagtgttcttctttattaccatttttgttgatgttatgttattgttattagtgactcctatcccctgttgtagtaactgaccaaattctcttcataggaattcttttcttttctttttttttggtgagatggagtcttgctctgttgcccaggctggagtgcaaatggcgcgatctcggctcacagcaacttccgcctcccgggttcaagcgattctctcacctcagcctcccaagtagctgggattacaggcacctgccaccactcctggctaatttttgtatttttagtagagactgggtttcactatgttggccaagctggtcttgaactcctgacctcaggtgatccacccaccttggcctcccaaagtgctgggattgcaggcaggagccaccgcacctggcctaaaaagttttttaatcctcaggatatggggaagttgtgaaaccatggaagtctcttcaaggttatttttttcatgtttttgctgtggtatattgtgttagttttataacttagaggacagttttctttcagctgtttctgaggggggtgtgtgcatgctggggcgtctttattgttgttcccatatatggccttcatacataactattgttttgaagttgagttaaatactgagccactgctaaaaattacctccagggtattttgttgaagatgaaagtctagcaaaatatatatagtggcctctcatttcttaattataggctttggtttatcatagatctttacgaaatgttttttaaattgtgtgtttagtgcgttacacacaatgtcaagtttttgttccatagactgtaagctccatcaaagtaggactcttgttgactggagcattgccagggtctgggatggcaccttgcacctatgttgttgctgaataaatgtttacttagtttaaaaattaagagtttagttttgaatttagattgataaacatggacagcagtacaattaagtcagcctttgtttgctctgattttatttcctggagagaggtaaacatttccaaagttttgtatacagatagaaaagcaccattttctttagactcttctttttcactttggggcttcttctgaaacacttagaaagtgatctagttgtagtggctccctgatgtaagattgctgtgtcaagggagtgtcagcttcctcactggactttgaacagatacttctcatagcaccttatggcagatggggatattttttcgctaggggatttgttagaatagagaggaatcaagcatataacgcaaaccataaccctcaagcacaactttagaaagtgttcttggccatcaaagtgttttattttaaattagtgtcttaggtattccaaatatccactgaccttatcttgactgttatctgagtagacatcaagaatttcatgcttatttccttgtgtactagctgttttcatttggactctaaaaatagctgatatatatgtaaagtaaaagtctagtacccagaaacttttttaccttttgggccaagtagttattcatttaggtatgtacrttataaaacaagtaagaccgaggtagagacaagaatctgtgaatattttcagttagagctattggaccgtctgaagcaaatataatgttaggttggttggcctctcacctagatagagaaagctttcccaagtctaacaccaattataaatgatcagggatttttcttgatgtttaggttttgttacttttcttctttggtctaggtaattaagaattagccatataaataagtatggaaattacacatacaaacatggaggatatgcattttaaagtctattctacaatcacaagttattgcagaatttggaaacctgtttatttgaagaatagagtattattcaacctagacttagtgcctaataaacttaaaggctaataacctaagatgttttcctttcagtattggatttttcccttgagataccagatgtccttattttcttaccatcagtctgtcacagtagtgtagtctcaggaccatgtggaattaagcatgaatttactcattcgagatttgtaaggtgaattacaaaatggtggacatgagggaactgatggtgttttgggggctctaagtgctgtcactgtctttggtgtatagaatcagattccattccttctaatatctctagaagctttgactttctgctgtctccatttgggtaaatgagcgttattgtgctggaagctttatttacctcatttaatcttcacaatgagttaggcgttgtattatcttttccattttcaaattaggaaactaaacttaagaaaagtttgagtgattacgtagctaataagcaaaagacccaggatttgagattttatatcagacttctgctcgaactttgacctttaaatttgtggcggtcatggacccctttgagatctgatgcaaacacagaattttgtatacaatttcaggtggttcatagccactctctcccccaagtccatccatgggcctaggctgtgggcctggaggcttcctggttaaggcagtctttccctttttctccccttgtcacagagcaggatctttcttccctggtcttctacttcccagagtgaaagatgctggaaggatggaatatttgtgaacaattcaagaccttcataattaaaaaataataatttgcctctgaatatagagcctcccctcgctgacccttctactacagatgccctttttttctttggccttcatctttaggtctcaggaagggccattcattgctcagtgggacaacttactattaaggaaaaagcccctctcaggggggacagaggggaggtcatgagtgggaattcccccactgtcctgctgatggtagatccatgtctgtcttccctgctaggcagcaggtatgtgatgcatcttcaggaattgaatggatgattcattcttcctttatacattaatcaagttcccaggccaattgttgagccctctgtatcattcttcttgtcagatacacactttatgtgaatatggcattttcttttctattaacaaggattcatcattcttttaacagtatgccaatttagcraatattttcctattcagttctctgagcaatttgttcataaacaaatgtcacttagatttcctttatcttttaatgaattgacagaacatacagaggcaatttaagtttttgcctaagatgctaacattactagaagaaactgtgtrtgtcacaaatccttcatgaggattggtagcatgtagtagaaataacttcctatcaagggtttgtaccactttctatagtagattacccaaatatgatcattaaaaggtgtatagtgttgagatttatatatggkgcagagtagttttgttattttaaataagttttgacttattttgcctactcaggctaagaaaatatacgggtaatctcatgctgagtggcaagctcatgtgaatctaaaaacaacttattggccgggcaaggtggctcatgcctgtaatcatagcactttgacaggccgaggcagtaagatttcttcagtccaggagttcaccaccagcctggggaacatagtgagaccctatctatacaaaaaattaaaaaattagctgggcatggtgtcatatacctgtagttccagctactctagaggctgaggtgggaggatcacttgaacccaggaaggcaaggctgcagtgagccatgatcatgccactgcactctaacctgggtggcagagcaagacactgtctccagaaaaaataaaaataaaaacaacttgttatgttacagttacttagatggctcagacttcgttgacttgtcaaatgaacctcaatgtcaagtgaattttcagcacattgaactttataccatttgattcaactacatttggcaaagtggggttttggaagaaaagaggtaaagttttggtgctcaatggacttgggttcaaatccctgcagactacctgtgtgaactgaggaaaccaacttccctgggatttgtttcttttgtatgtgatatggctgcatgtaatagtaagaatgatagctctgcattgggtactgaccatattccatgccctgtgctagttgctttacatatgtgtaaccctgtgtataatcaactttgtttcctcccaccatctcgttgatggagtggaccaaagaccaatagcatccataggacactcattaactggcagctcttttttagtattctttagccgtttccactttctgtttcatcatgtaaatttgttagttggaataatacactgagggataataatggattggagaaaaatcactggagaggtattattgttaagtcaggcaactgagttcagagctgcactgctgagaattaagatattcaccataacatcctttctcttcctgcaagtttggtatgaaatatctagaaaataaccttctcagtcccttgtattttgcacttagaaataatatgtagacacttgcatacttgattcgcctgtgtttttatgattgacacctattttgaagtcaaatttatgcttagtgacttaaggaaataacacttaaaccatacagtatgataacagaaaaatgaagcatgtttaatagtgaatatgtctaaaattgtattattattatttgtataatgtatgctacccttcaatagaatgcagatttctctgtatgatgctatacaactaatgcctggctagggcagctagttggtgacagccccctgctagaattcaggtcttccagctcttgttttagcacttttctctcaatatactgcttttccatggagccattgccattttcctaaaagaaaagcaatccaagtgttgatattgtctatttactttaaaaggaaataaagggaaagaaggccaggcgtggtggctcatgtctgtaatcccggcagttcgggaggccaaggtgggcggatcacctgaggtcgggaattggagaccagcctgaccaacatggagaaaccccatctctactaaaaatacaatattgctggccatggtggtgcatgcctgtaatcccagctagtcaggaggctgaggcaggagaatcgcttgaacctgagaggtggagsttacattgagtcaagatcatgccattgcactccagcctgggcaacaagagcaaaactatgtctcaaaaaaaaaaaaaaaattaaccgggcgtggtggcagtcgcctgtaatctcagctactcgggaagctgaggcaggagaattgcttgaacccaggaggtggaggttgcagtgagctgagattgtgccattgcactccagcctgggcaacagagtgagactccatctcaaaaaaaaaaaaggaaagaaaaggaaaagttcccaaagatagaatcctattagtgaaggaagtatttaagtgtaggatctcctctactaaataaatgtaatacgaaattttatactgtttaaagggactagaaaaccatgataagaagatctcgtattacttgagcacttgtttgcatgagacacttttgtaagtgctttaaatgtttttgcttattttgatcttcacaaaaatcctgtatatgaggcactgttatgctcatctccattttactgatgggaaaactgagacacaaaggtattaagtgacttgctcatggttacatggcggaaaccacagctagagtagttctgactccttgaacagcatctttcttcctggtttataacctttgacaaatgacaggtggcctgctctggagctcatgcccttgatgacagcctggctcagagtggcctcctaaatgtgacagtagtttttgtaagtactctggagatatttgttatcatttaatttttgtatttttacaattatcttgcttaagataggtttttgcactcacgtcaggcaaagaaaggtaagcatgagaaggaacatgagtgtcattaggcccgcaagacactgttggggaatccccagggtgtttagggcagagctgtttgatgagaagcctttggtgagcttgttccctggcagagttggaagtatcagactgatgaaatacatcccaggagtgttctctgctgagatattttccaaagcaatatctgcttgcactactgttagatgaatttggtgggcttctagattcagattcttcatccaagcaaggagaaaggtagaggcagtgagtccgttgaagtgctggctgcctttcgtgatgagcccaggctgtgactgaagaataagaagttctagtttatctttggttatgtgggtcgtaaactaaacaacctttatatggtagcacatagagcatattagcttttgactgtattgaaactttgtgcagtaacatctcaattatccctgtcattcttgttggttatatatatacagtcatgtgctgcatatcacatttttggtcaatgacagactgcttataagatggtggtcccataaaattataatactgtatttttactgtacctttcctatgtttacataagtgtagatacacaaataccattgtgtttcagttgcctacaatattcactacagtaatgtgctgtacaggtttgtagcctagcagcagtaggctatatcacatgccctaaatgtgtaggaggctataccatttaggtttgtgtaagtacactccatamtgttcacacaatgaaatagcctaatgatgcattcccacatcgttaagggacacgtgactactaaaatttcccctttaatcctagtttactctttaaaaacatgttgatattgtcttaatcttataattcaagatctttctccatagcacttatcagtatctggcataatatatattttgcttgtctatttttccctattggaattaagttacgtgagggcaggaattttgttctcatgttcaatgctgtattcctagttcccagaacagtgattgacatgtagtaggtattcaatcaatattcattgaatgaatagatgaatctttctaaacattagtccagttaaaaatagagtatatttatttgtgtttcagaggcatcatattcatagcatctcattgtccaggatagtaaatagaaaagagataagcagttcatccatgtggacagtaatctcagtttgtgcctcctactgtctttcagtccctgaaattgtcttatcatttgactcttccttaaagataaatgctacagcaacaacaaaaatctagccacacgagaagttcagttacttggacttcagtataatttcagaataatttagaaggtcaagatgtactcttgattattttcttgagtcttcatttagttgtaatagagtataatgatattgcatattaccactttggctgtaaaatatatattatttgatcaagtatagaagaaaactgattaaaattaaacagaaaaggaaaaaatgctgcctgctttgaggcaatgtgaccgccactatctgtcacaaggaagaagtacgatacttcattatttatggcagactctgtaaaggtaagctccaggcttgaattaggttaatacttgttaactacccttgttagatgatctcttcccgggatagactttatctagtgctatcttctgtcatctctttcctgatgaaaagtcttctgacttctgcctagtctaagaaaggcatcaggatgaaattatatttgcaattttagatgggattaacttttatcaacccaatgcatcagtggctttaaaaacccttcagctaatttctgtgtccctctgctctactttaaaaatagtacaaccaaaaagactcttaaaataattagacgagaaatgacttagggattaggaaagggtttacattctgacaggatttggacctgcttttaatagctgacgtctccttaggggactatgatttgggtgctgcacattttttccccatctcaaatttgtaaactctcttttgctttgaacaaaaaacttggttatcaaatcactttgttctcagtcaacatcagttcatgtaaagtaagtcaaccatattgtgctgaaaagaagccaagtttgttttaacttttatttttactgtagtttacaaagcaggcacagttatctgtacaattttagaagagtagctatgaaaaaattttaaacaactatgaagaaatcattgaataactttttgaaaactatcctgatatgtttgttcataacaaaataggaaaggaagggagaatgtaaacacacctgacaatgaaagtttcacaaaattctctacagtgactattgagaattgatctaggggatgctagaagattcagtgatttaacaacttctgctggaatgagtttcccacaggtcaagtcaatttgctttgatcaccagtgagagtggatgcagctgtggagaaagagaagccacgtggaggtaaagtttcttatcaggaaaagcactggaaagttatataacaaagtgtggcaggagacatgaactgaacgccaataactaaaggctgtctgctggaaaacttctgttacaattaaacgaactccattaacaggacgtgcatagtccagaagatttggactcaaggaagagaggatgtgtgcttctgggaagatatcctagaccaaggcagtagttaaaatttcaggcacatgggcctgtctgtagcaaagtttttgcctttcttttagtaaaagtcctggtatgttcagactttaaaggaagaaattagtttgactgttatttgaatagtgatattttcaaggaagaagcatgcttgattcaagttttattctattttctgtcatacctgaagagatcctatctgctaaatataggtaccatgacaaaggtaagagtgcttttcagtattatcagtacgattagaacttacaaagttcttcaccacaattttgaggaaggaagagtacatgttaaattccctattaagaaacagactcagtgaggaagtgagacattccagagctggcaagtggtaaagtcaggactcaaaggccgagccttttgcctgcaaatctagtgctctttgtaccacaccatgctagtggcagctattggaatctcaggcattgtcacccgggggaaatacagccatgtgtcacttaaggacagggaaatgttctaagaaattcgttaggcaatttcattgttgtgtgaacatcacagggagtacttaaacctacgtggtatagcctactgcacacctgctatgtgctgtggcctagtcctggtaggctataataaacctgtccaacatgttactatactgaatactgtaggtaattatatatatataacaatggtgagtatttgtgtacttaaacatatctaagcatagaaaaggtgcagtaaaaatgtgaggtaaaagattaaaaaggtacacctgtatagggtacttaccgtgaatggcgcttgcagaactaaaagttgctgtgggtgagtcagtgaatacgaaggcctaggaagttgcactatagtagtaggacactattgtagcctctagaaacactgtacagctaggctacattaaatatatcacaattttttaattttttaagacagagtctcactctgttgcccaggttggagtgcagtgacgcaatcatggctcactgcagcctcgacttccaggctcaagcattctcccaagtagcctcagcctcccaagtagctggaattataggcgtgcaccaccacacctggctaatttttgtagttttagtagaaatggggtttcaacatgttggccaggcttgtcttgaactcctgacctcaggtgatcctcccacctcggcctcctaaagtgctgggattacaggcatgagccaccacacctggccttcgataataaattaacctcagcttactataaygtttttgctttacaaacttttaaatttttaaaacttttgactcttgtaataacataggttaaaacacagacacattgtacagctatacaaaaatatctatatccttaccctataagcttttttctattttaaagtatttttttgttttttactttttaaacttttttttttttcttttgagacagtcttactttgttgcccaggctggggtacagttgcgtgatcttggcttactgcaacctctgcgtcctgggttcaagccatttttgtgcttcagcctcccaagtagctgggattacaggtgtgcaccaccaagcgccccccgcccccccttttttttaatttttagcagaggtgggtttttgccgcgttggccaggctgatcttgaactctcctcgccacaagtgatccactcaccttggcctcccaaaatgctgagattacacgtgtgagccaccgtgcccggccactttttaaacttctgtgttgaaaactaagacacacatattagcctagccttaaacagggtcaggatcatcaataacactttctttcacctccacatcttgtcctcctggacagttttcaggggcggtaacatgcatggctctgtcatcccctatgataacaatgccttcttctggaaacctcctgaggctgatttccagttcactgttttttttatttgaaagagggtctcattctgtcacccaggctgtagtgcagtggctcaatcacagctcactgcagcctcgaacttctgggctcaagcaatcctcctgcctcagcctcctagttgggtctacaccaccacacctggctgatttttgtattttttgttgtgatggggtctcactatgttgcccaggctgttcttgaactccttggctcaagtgatcctctggcctcagtctcccaaagcactrggattacagatgggagctactgcacctggcctacagttaacttttttataaataggagtacactctaaataaaaagtataataaatgcataaatcagtaacatagtcatttattatcgtccagtgttatgtactgtacatagttgtatgtgctgtgcttttgtgcaattggtagcacgataggtttgtttataccagcatcactacagacatgtgagtaatgcattgcactgcaacttagcaactacaacatcactatgtgataggaatttttcagctgttacagtcttaggggaccaccatcgcatttgtggtctgtcgttgactaaaacattgttatgcggcacgtgactgtaattagcttctatgctactagttaaacctttcaaaaaacaaataacagcaggtaccaaaacagaaatggaaacagctttcatgtttggctttggaaaatatgcttgtacttgtaagtgaagtaatgaaaccccaattaaattggctagagtactgtaaagctttatataaaataagttatttttggaaaataagttatttcttggaaataagttatttctttgggaaatgaagcgcttcataactaactttgcctgataaacaaggttgactcctttgtccaaactatttggagtgmtaagttttggaaacartttataaatttctatctgtcgtaaataaaggatactacctctgcttttaggaacagtgattgttgttgaatacatgactaattaatgtttggagttatttgtttctttagtaagtaactccagactcccatatatttgtaattctttgtaaattctatttaaggggtttttgtttgttatgtacgtgttctcctttgctaaaaagaatrttgcccatcacttccctctactgccaacttgctattattaaataagcccttttcctttaatttgtcatcttttaatctgctttggattggattaccaaatcgctaaactcattaaaagtatgtataaaataagaaaaaaaatccataaaagagataggagaaatttcttctttgtcaagggcatatactttataacattgactttaatatgtatttttgattgctcaaacacatttttccctattctctgttcttcaattatgttcacgtgaggttgccagttaactgtcaaacggcacaaaatcttgacgtaagtatagatattagaaaatagaaattgtaatgaactcataggctcgtctatttctggctcattttttttcttagacttaatgaactgaatttgttgtatttaaacattttaaaatagagctgaaaatatctgtacttgttatgtcctttcctggttttggtattagggtaatgctggcttcatagaatgatttagggaggattccctctttctctatcttttggaatagtttcagtaggattggtaccaattcttctttgaatgtgtgatagaattcagctgtgaatccatctggtcctggacttgttttttgttggcagtttttttttttttaattaccgtttcagcctcaatacttgttattggtctgtccagagtttctgtttcttcctggtttaatctaggagagttgtctatttccaggattttatccatctcccttaggttttctagtttatgcacgcaaaggcgttcatagtagacttgaatgatcttttgtatttctgtggtattggttgtaatatctcccagttcatttctaattgagcttatttagatattctcttttcttggttaatctcgctaatggtcaatcaattttgtttaccttttcaaagaaccagctttttgtttttgttttgttttgtttcaatttcatttggttctgctctgatctttgttatttctttttttctgctgggtttgggtttggttggttcttgtttctctagttccttgagttgtgagcatagattgtctgtgtgctctttcagactttttgatayaggcatttaatgctatgagttaatatatatttaatgtatatttaatgctcttagagctgcttttgctgtatcacagaggttttttgtttgtttgtttttttgagatggagtctcactctgttgtccaggctggagtgcagtggcgcaatctcggcttaccacaacccctgcctccctggttcaagcaattctcctgcctcaacctcccgagtagctgggactacaggcatgcaccaccatgcctggctaatttttgtaattttagtagagatggggtttcactatgttggccaggctggtcttgaactcctgatctcgtgatctgccagcctcagcctcccaaaatgttgggattacaggcgtgagccactgtgcccagccatatcccagaggttttataggttgtgtcactattatcattcagttcaaagaatttttaaatttgtctttattttgttgttgattcaaaattattcaggagcatattatttaatttccatttatttatatagttttgagggttacttttggagttaatttccagttttattccattgtsgtctgagagagtacttgatgtaattttgatttttttaaaatttgttgagccttgttttgtggcctatcatatggtctatcttggagaatgttccatgttttgatgaaaataatgtatattctgcagttgttgggtagaatgttctgtaaatatctgttaaatccatttgttctagggtatagtttaagtccattgtttctttgttgactttctgtcttgatgacctgtctagtgctgtcagtggagtattgaagtcccccactattactgtgttgccatctatctcatttttttggtctagtagtaattgttttgtaaatttgggaactccagtgttaggtgcatatatatctaggatggtaatattttcctgttggactagaccatttattattccataatgtccctctttgtcttttttaagtgtcgttgctttaaagcctgattcgcccaatataagaataactactcctgcttgcttttggtttccatttacatggaatatctttttccactcctttaccttaagtttatgtgagttcttatgtgttagatgaacctcttgaacacagcagatacttggttggtggatttttatccattctgccattctgtatcttttaagggaagcatttaggaccatttacattcaaggttagtactgaaatgtgaggtactgctctattcatcgtgctagttgttgcctgaataatttggktttttttcccccattgtgttactgttttataggccctgtgagatttatgctttaaggagtttctattttggtatattttgaggttttgtttcaagattaagagctcctttcagcattttttgtagtgctggcttggtagtggcaaattgtttcagcatttgtttgtctgaaaaagactttatctctccttcatttatgaagcttggttttgctggatacagaattcttggctgataattgttttgtttaaggaggctaatataggaccccaatgccttctggcttgtagagtttctgctgagaaatctgctgttaatctgataggttttcctttataggttaccttgtgcttttgcctcacagctcctaagattcttctttttctttttttttttttcttgagatggtgtctgactctgtcgcccagactgaagtgcatggtgtgattttggctcactgctacctccacctcctgggttcaagcaattctctggcctcagccttccaagtagctgggattacaggttcctgccaccatgccyggctgatttttatatttttggtagagatggggcttcaccatgttggccagactggtctcaaactccttgcctcaagtggtctgcccaccttggcctcctaaagtgctgggattacaggagtgagccactgcacctgacctttaagattctttcctctgtcttgactttagataatctgatgactgtgtgcctaggtgatgatctttttgtgatgtatytcctgggtgttstttgagcttcttgtgtttggatgtctaaatctctagcaagaccagggaagtttttcttgattattccctcaaataagtttccccaagttttagatttctcttcttcctcaggaataccaattattcttatgtttggtcatttaacataatctaaaatttcttggaggctttgttccaaaaaaggctacagaccagtatccctgatgaacatagatgcaaaaattctcaacaaaatactagctatttgaatctaacaccatatcaaaaagataatacaccatgatcaagtaggtttcataccagggatgtagggttggtttaatatcaagtcaataaatgtgatagaccacaaaaacagcattaaaaacaatatgatcatctcaatagatgcagaaaaggcatttaacaaaatccagcattcctttatgattaaaaccctcagtaaaattggcayagaagggacataccttaaggtaataaaagccatctatgacaaacccagagctaacattatactgaatggggaagagttgaaagcattccccctgaaaactggaacaagacaaggatgttaactttcaccacttctcttcaacgtagtactgcaagtcctatccagagcaatcagacaagagaaagaaagggcatccaaatcggtaaagaggaagtcaaaccgtctctattcactgatgatatgaacgtatacctagaaaacccctaagactcatccaaaaagctcytagatcgataaatgaattcagtaaatgttttagtctgttttcatgctgctgatagtcatagctgagactgggcaacttacaaaaggaagatttaatggacttacagttccacatggttgggaaggcctcacaatcatggtggaggatgaaaggcacgtctcacatggtggcagacaagagaagagagtttgtgtagggaaactcccatttttaaaaccatcagatctcatgagacttattcactatcaccagaaagagctgcccccatgattcagttacctcccaccaggtccctcccacaacgtgggaattcaagatgagatttgggtgaggacacagccaaaccatatcagtaaagttttaggatacaaaattcaggtacacaaatcagtagcactgctatacacaaacagtgatgaagttgagaatgaaatcaagaactcaacttcttttataacagctggaaaaagaattaaaatacttaggaatatacccagccaaggaggtgaaagaactctgcaaggaaaactacaaaacactgctgaaagaaatcatagataacagaaacaaatagaaacacatcccatgctcagggatgggtagaatcagtattgtgaaaatgaccatattgccaaaagcaatatataaattcaatgcaattcccatcaaaataccatcatctttcttcacagaactagaaaaaacaatcctaaaacttacatggaaccaaaaaagagcccccatagccaaagcaagactaagtagaaagaacaaatctggaggcatcacattacccgacttccaactggactacaagcctatagttaccaaaacagcatggtactggtataaaaacataggtcaatggaacagaatagagaacccagaaataaagccaaatacccacagccaactgatctttagcaaaggaaacaaaaacataaagtggggaaaggacaccgtattcagcaaatggtgctgggataattgacaagccacatgtataataatgaaactggatcctcatctctcaccttatacaaaaatcaactcaagtgggatcaaagacttatacctaagacctgaaactattaaaattctaaatgataacatcagaaaaatccttctagacattggcctaggcaaagagtctgtgaccaaaaacccaaaaacaaatgcagcaaaaacaaaaatagatgagatttaattaaactaaaaggcttctgcacagcaaaagaagtaatcagtagagtaaacagacaacccacagagtgggagaaaatacttgcaaactgtgcatctgacaaaggactaatatccagaatccacaaggaactcagacaaagcagtgagaaaagaacaaataatcacatcaaaacatgggctaaagacatgagttagacaattctcaaaagaagatatacaaatggcccagaaacgtatggaaaactgttcaacatcactaattatgaggaaaatgcaaatcaaaccacaatgctataccaccttactcctgcaataatggccataataaaaaaatcaaagaataatagatgttggtgtaaatgtggtgagaagggaacacttttacactgctagtgggaatgtaaactagtacaaccactatggaaaacaatgtggagcttccttaaagaactaaaagtagaactaccatttgatccagcaatcccactactgggtatctactaggaggaaaagaagccactgtatgaaaaagacatttgcacacacatgtttatagtagcacaattcacaattgcaaaaatatggaaccagcytaaatgtccatcaaccaactagtggataagggaaaatgtgacacacacaaacacgcacacaccatggaatactactcaggaatgaaataatggcatttgcagcaacctagatggagttggagaccattattctaagtgaataactcaggaatggaaaatcaaacatcgttatgttctcatttgtaagtgggagctaagctatggggatgcaaaggcatgagaatgatgtaatggactttggggtttccaggggaaggatgggaatggggtgaatgataaaagactacagattgggtacagtgtacactactcacrtgataggtgcaccaaaatcttagaaatcaccactaaagaatgtattcatgtaaccaaacaccacctgttccccaaaaattattgtaataaaaataaaattatttactttattatgaatatttctgatctttaaaaacatttttttactgagatgaaattcacataatgtacaactaaccttttttttttttttttttttttttttttgagatcatctcgctctattgcccargctgaagggcagtggtgtgatcctggctcactgcaacctctgcctcccaggttcaagcgattctcctgcctcagcctccggagtagctgagattacaggtgcacaccaccatgcctagctaagttttttgtatttttagtagaaatggggtttcaccatgttggtcaggctggtcttgaactcctgacctcatgatctgcctgcctcagcctcccaaagtgctgggattatagatgtgagccaccgtgcctggccacaactaaccactttaaagtaaacaactcattggcatttagtacgattacaatactgtctatttctaaaacattttcatcacccccaaaggaaattctgtatcccataggcagtcattctctattcttccctgcccctagcaaccaccaatttactgtctgtctctgtggatttatatattctagtcttgaactcctggcctcaagcaattctcccaccttggccttccagtgccttgggattacaggtatgagccaccacaccttgggatttattcagatgtttcatataaacagaattatacaatatttgaccttttgtcttctggctgcttttgcttagcataatatttttgaatgtcatccacattgtggcatgaaccagtacatcattgtgttttatggctgaatgttcattgtatgtatacaccacaaacttgtttatccattcatctattgatggacatttggcttgtttccaccttttggttattgcagatagtcctgctgtgcatatgcatatacatgtgtttcttgagcacctgtttttcagttcttttgggtatgtacctagaagtggaattgctggatcatatggtgattctatatttagtgttttgaggatccaccaaacttttccacagcagctgaaccattttctgcttctactagcaatgtataagggttccagtttctcctcaccaatgtttacttcctattttttaaattatagccatcctagttggtgtgaagtggtatctcattatggttctgagttgcatttccctaatgactaacaatgttaagcatcttttcatgtgcttgttagccattcatatcttttttcaaaaagtgtgtaagtcctttgcccattttaatattgggttgtttctttctgtatgtaagagtcattttatacgtttcaagtagtagacctttatcagatatataatttgcaaatattttctccttttcttctgttctgtaggttttttttttactttcttcatttattattattattttttgagacagggtcttgctctgttgcccaggttgaagtgcagtggcacaatcatggctcactgcagccttgatctgttggggttaaagtgatccttccacctcagccacttgaatagctgggactacaggtgtgtgccactgtactcagctaattttattttttgtagaggcaaagtttcactatgttgtccacgattgtctcaaacttctgagctcaagcagtcctcctgcctcagcctcccaaaatgttaggtttacagctataagtgaccatgcctagcctgatatggttttttttgcatgtaagttctaaattttgtgcgtgtgtatgtgtgtttttaagagggtcttgctctgtcgcccaggctggaatgcagtggtacaattatagcttactgaagccttggtctcctgggcccaagtgagcctcccactttagcctcttgagtagctgggactacaggtgtgtgccaccacacccagctaactttaaaattttttgtaaagacagggtcttgctttgttgcccaggctggtcttgaactcttggcctcaagtttctcccactttggcctcctaaagtgctaggatyacaggcatcagccactgtgcctggcaagttttgtaattttgaaataagtttatctatttttttctttgttgctcatgtttttggtgttatactcaagcatttattcccaaattcaagatcacagagatttaccctaatgttttcttctaaactattttacgggtcgcttcttatatttacttaatttttatatatggtatggagtagggatccaacttcattctttcgtatgtggatcttcagttgccccagcaccatttgctgaagagagtattcttttccccactaactggtcttggcacccttatttaaaatcagttgactgtagatgcataggttcatttctagactctctattctatttgtctatatgtctctccttatgccagtaccacacagtttggattactatactcttgtaataagttttgaaacaaggaagtgtgagtcctccaattttgttattctttttcagtattgttttggctatttggagccccttgcaggcccatgtgaatttgaggattggctttttatctctatgaaaaagcatattgggattgtgataggtattgcatttgaatttgaagattactttgggtagtactgcaccttaacaatattaagtatttcagtctatgaacatgggatatctttctatttatttagattttccttaatttcttttagcactgtttagttgtgttcagtatatgccttttcaccttcttggtcaaatttattcctacatattttgttcttttggatattactgtaaatggaattgttttctttttttgacatrtacattgctggtatatagcagctgatttttgcatgttgatcttgtaccctgcaaacttcactgaatgtattacctcgagtagggcaggggtgtgtgtgtgtgtgtgtgtgtgtgtgtgtgtgtgtgtgtcacggttggggggtggatttggaggattttctttgtctaggattatgtcatctgtacatagatagttttactacttctttccactttaaatgtcttttatttttcttgcctaattgctctggttagaaccttcagtacaatgtcaaatggcagtggtgaacatgggcatccttgtcttgttactgatcttagggggaaagctttcagtctttctccatggagtatgatattagctgtgggtttttcctaaatgctcattgtcatgttaagaagctcttctctattcttctattcctagttttctaggtgttttttatcattaaggatgttggattttgtcaaatgcttttcctgcatcaattgagatgatcatgtgtgttttttttcttttgtcttagtaatatggtataatgattttggggggtatgttttaccacccttgcagtcctgggatgaatcctacttagtcatggtgtataatccttttagtgtgctgttagactcagttttttaatatttgcttaggatttttgcatctatatttacaagggatgtcggtctatagttttcttgtggttatcttttgtctggctttggtattgggrtaatgctggcctatagattgagttagaaagtattctctccttttccttgattttcgtgctcactccccaccttgtttgttttttgaatggattttaaattattttggaaagttaattattcagattcttaaggttattattcaagacgagccaaaaaaaaaaaatggtcttacccaggaaaaatctttgcctgatgagaatttaatcacaatactttgttgctcaagctccacctacctattttagaaacagatgatattgtagtcataaaatctcatggaatcagatgttgtgacttgattatgtatgtgtagaaattctaagagagcattcaatccaggattataatgttacaataatttagtkacccatatgtatataaacatttctagcagcaattttagaaatataatacctccttggaggtatttaacaagatataaatttgatttttggctagctttcactacttcttaagatagaacttgaacattggggcaggtcccaaagcaaatactttaactacaatagttacgcacgagaaagtcatgtaaacaatctatccttgacaagctacaaagtcaatattcagatgtcccaaatcttagactcctttatttaaaagagctaaccaacaaagaatttactaagcccacctttctttttttyttttttttttttttttgagacagtcttgctctgtcgcccaggctggagtgcagtggtacagtggcatgctctcagctcacttccacctcctgggttcaagcaattctcttgtctcagcctcctgagtagctgggattacaggcacccaccatcatacccggctaattttttgtatttttagtagagatggagtttcaccatgttggccaggccagtctcgaactcctgacctcaagtgatccactggcctcagcctcccaaagtgctgggattacaggcacaatccaccacgcccggcctaagcccaccattcttttcagctgtttgtacctttagataaagttctygctactctcttctatggtctataatttgtgaaaaactaattatgatgcaatttcaacaaatgtatttgttcagttctatttgattttctaattcatgttgcatgagtaatagatgcactgataaagttagcatattttaacagttttcctttcagaatgtgctttttaacagaatgctagcagattgttcagctgttatttttttaaattatattacagtccattcacaaaaggtacaaccacaaattatacaataaaccagaaattttataattctgtttttgtatttggaacagtctacagtccaactgtatttaaaggggaagttaatgtattcaaagggtatttttaagaccttttcattttggttaaaaatgatgacatacagccaggcgtggtggctcacgcctgtaatctcagcactttgggaggccgaggmgggcagatcatgaagtcaggagttcaagaccagcctggccaacatggtgaaaccccgtttctactaaaaaatgcaaaaaaaaaaaaaaaaaagttgggcgtggtggcgggtgcctgtaatcctagctacttgggaggctgaggcaggagaagcgcttgaaactggaaggcagaggttgcagtgagctgagatcacaccattgcactctagcctgggcaacaagagtgaaactccgtctcaaaaaaaaaaatgacctgctgttaacttaccaaaacagttttagatcctaaaggattcctaatctggcattatagaccgaatgtggtacattcagtccaaaacttgtgttctaagatggaacagaaaacaaacatagtaacagaaatgtattttgttgtaatcaaatacatgtaggtaattttaaaagtcttttgaggggaggagtcagtaattgattttgttggtggagagaatgggtgaaactaaatgatatttttaaaaatatagtggttttcaggctggcacagtggcacactcctgtaatcccagcactttgggaagctgagacgggaagatcacttgaagccagtttaagatcagcctgggcaacatagtgagaccctctcttgaccaaaaaaaawatatatatatagcctggtgtggtggcatgcacctgttgtctagctacttaggaggttggggcagaaggatcacttgagcctgggagtttgaagttgcagtgagccgtgatcatgtcagtacactcccgcctgagtgatagagtgcaactctctctcaaaaaataaaatataatggttttctaataggaaaatgtacttaggtagttttcccgtatccaatcctcatgacaggattgtgagggagatattactttattttacacttgagaaaaccaaattagattgattgactttaccatttcactcctagtaaataactgttggaaatcaaactcagaactttggacttaagcatcaagctctttctattaaaccagatttttgttttctataagttgcagtttaaaaaaagaaaagaacagtacttgttttctataaatgtatgatacatattctrtgcttacagataataagcaattcattttaaaatgtcataacctcagaatataattaacaatgggacttggcctttcagatatattacaatgtgcttggattttcaaaaattttatttgcatgcagcttgtcaaggattttttttttttttaaggcagagtctcactttgttacccaggctggagtgcagtggtgcagtcttagctgactgcagcctctgtctacctcctgggttcaagtgatcagcctgccaagtagatgagactacaggcacacgctaccacatctggctaattttttgtattttttacacagacagtgtttcgccatgttgcccagattggtctcaaactcctgggctcaagaaatcttcccacttcagcttcctaaaatgctggcattccaggtgtgtgccaccacacccagccaaagataaggttttatataactttctcttgcataactttggaggagcagtgtagtgtagtgcaaagttatcaaactttaaaggacccaagaaatacctaggagattaatagctttttagggcccaagaaaccctctaggtacttctggtagaggtagtccagggacaatacctgggggaaacactggctttgaggttttacacagataaaaatacctacttcataaattagtgatggtgatttaatctatggtatctctacagytcttggaatacaacctggcacataggaaatgttcaaaatattccattcttgtgtgatgacttgggtggcaactaagaagcaagagaatattccttctttacattcaacaaaatttattgaattccagcagtattctagggatttgtggatataggggaaaatgggcacattcttcactcttgttgaatttatttgatgaactcattttaaaggtatagttcttaccttgttaaaaaataataaaatgactattgagcacatgtttgcataatcttttcccttgcaaattaaagttttattttttacttgaatgaggattgcaggtcaaagaaatgttctattatttctcagttttcttgttgctttaaatctatactatccaatacagtagccactagatacttgcagctatttaagtcaattaaaattgtataatattaaaaatacagctccttggtggcactaccacatttcaagtactcagtagccacatgtggctagtggctgctttattggacagtgcagatgtagataatttccatcatcacactaagttctgttgggacagtgttattctggagtgtgcaactacaaagcagtgattttccaattgtcttaatctgtagattgattttgaggcaagtattagcagtggcttgaggctgtcatttcagctcataagtgcattaatatcctttcaggttgaccaggcccagggctagtattgatttatcttaacagtttcatttcacagcaagtgagatctaaatgctaagacatctgggcattttctttaaacttctgagtaatacactaacgttattttactgcattagtcatagcttttctcatgcactctgtgtgtgtgtgtgtgtgtatgtgtgtgtgtgtagggagagagagaattcaccttcacagcattataattgttttaaatgtgcatgtaatgaaattttggggacaaaggaataaagaagagttggaattgcatctgaatactagaaatggtacttacatgaaataatttcttttatagaaaccaaaactaagagtagtgaaaagttggtttaacactgcttactcagcattctactgggtagaaccccagttatgattatttaaaaatattaattatgaggctgggtgcggtggctcatgcctataatcctagcactttgggaggccgaggtgggcggatcaactgaggtcaggagttcgagaccagcctgaccaacatggtaaaaccctgtccctactaaaaatacaaaaaattagctgggtgtggtggtgcatgctataatcttggctactctggaggctgaggcaggagaatgacttgaacctgggaagcggaggttgcagtgagctgagattgcgccactgcactgtagcctgggcaacagagtgagaatctatctcaaaaaaaaaaaaaaaaaaaaaaaaaaaaaaaaaatatatatatatatatatatatatatatacacacacacacatacacacacacgtgtatgtatatatacacttatacacatatatgtgtatatatacgtatatatacacatatatgtgtgtgtgtgtgcgtatgtgtgtgtgtatatatatatatatatattttttttttttttttttttttttttttttgaggtagattctcactctgttgcccaggctcactctgttgcccagaagaacaacagcaaaaactgaaggaaaaaaaggaggtaagacctatctgtaactagctactcatattcaggaaacagaggcaaaaactcaattgctcttgcatatcatttactgaactctgaaccaaaaaaatacattcacgacctagacactggaatgtagtgggggctactcaattttatatgcagattttaacaacaacaaaaatacagaagaatttatccttggtttttcaattactaaaacactaaatttatcatatatatatacaggtgtatatatacacatacacgtatatatagtatatatacacatatacacatatatataccatatatatagtgtatatacactatatatacacatacacacataaatacacatgtacacatatatatataccattatatatagtgtatatacactagtatatacacacgtgtatatatagtatatatacacatacacacatatatayacatacgcacacatatgtrtatatacatatgtgtgtgtatgtgtatatatacatatatatgataaatttagtgttttagtaattgaaaaaccaaggataaattcttctgtatttttgttgttgttaaaatctgcatataaaattgagtagccgccactacattccagtgtctaggtcgtgaatgtatttttttggttcagagttcagtaaatgatatgcaagagcaattgagtttttgcctctgtttcctgaatatgagtagctagttacagataggtcttacctcctttttttccttcagtttttgctgttgttcttctctgagaagaaaggcaataagagactgctgtcatttggtcacaggtcagggattaktgygactgaagtcattgaaatccttttgtatgttattgcctccttcaatgaccttctgtctttccaggtcacttacttcagcctctggtactacaacaagcaaaatcagcgccggtgggtagatttggaaaaacctttgaagaagcagctggataaatatgcattggaacctaccgtctattttggagtggtgttttatgtgccttcagtttctcagctgcagcaggagattaccaggtgagaaattacatgccgtttgtttttaggaaatagtctagtgagatgtaaaaagtgaaactaargttgaagtcagaagataagtttgaaactttgccctctcgccccacatttttagccacggtgttacaaagagattctcwtatgtggcatgtcagagtgttttactgcatgttgggtaacttatgggttcactaggcacaaaggaataattaaagggaaaaatgatggatttaccctctctgtgaactcttcttgtagtgatgttacctttaatgtttttgttgttttgtttctgatcttttgtaacaaggaaaggagagaagagattttagaaaattagttacaaaatctgtcttcattcctcaaggaaatgtgctgaaaggctcctagaattctctgcctctagctatattctgtagaccggttggggagggagtacagaggagagggagggaagtgtttaagatcaggaaattttggccaataagtgcacttaatagggacaaaagcagaaagggaagatgatattaaggagcagaatagaggaactaagtgttcttattctttttccccctgaagacaatgaaaaaaggaataaaatttgagttcttgagcctgcctttcaaagttctgtgaatcccatcactacctgacctttttaaccctatttaatgttacttttgaacgttaaatatgttcaaaaatgaagtagctgtgctacttcaagggcccgaaacatgctgcacgccctttcatctttgtgtcctagatctttctctcacatgtatttactggaatcctgtttgcctcctgagttgtggttcagaaggtacctcctccatgaagcatctatgaccccaggatagaatgagttttggcttaccacctagaatttgattctacttgtgttaagatggtaattgtcataccctgttattaggattgtccgtgtatctttttcctaggttttagcccatgttttctttagctttacttaatgatatcttacacagtgccttgcagatagtaagaacctggtactgtcccatgtttgtggagtgctgtttgagtctgccagttratgattaggagagaatggaaagtcaaagcagtaggatccagtggtaggataaacacaaactgactgtaaaagtctgagatagaaatattgaagagaaaagtggaagccagaaggaaaaagcctgaactgatcactttaactcatttaaacatttactgaagatatgctctaagaattgtgttgaatagagtgggaggtgaatatgctttaatcccaccctggaggagctgctcacagtctggtggaattggcagttcatataaatagttacagtatcctatgataataaatgctttaattaaagctgtggattcctaggggtggggcaaggggaacttgaacaggaaaggtagagagactgacttttaaattgactttagaaatgttctagagggaatagtttttgcaaagcagggggaataatcaaaatgattacatgtcttcaggaagtttcaggtattacctaaggaggttttaaaaatagacattagcaataaagtcatggtacaatgaggaagagattttcaaatttaatggaatcattaaatttacatttcacaaagatcacccatcatagaaggtagatcagagatggcaagactataggcaggacaccagtttaggaatacctgtgccataatctaggcataggtttacaatatagaactgaacagaaaggcattagctggattgagagagaatgggcctattagagtcaatcaataggattgctcatcgattaggtataggagcacctgatagagaagttgtatcggtaaggrttaagtatagctatatataacaaaaaccctaaatatcattgacttctgtgagagttcagaagtcagccttgcagagcttgtctgacagctccacagagtcttcaaggatgctcgcactttctcttagtgctccagcatcctcagcgcatccttcccatgcactaggttacctcttggtccaagatatccagagttctgtctattacatccatagtcagaaagcagatgagtggtttcctaggaatggggtaggaattggagagaaagattatgaggggtgcaaggaaacttttgcagttggtcagtatgttcctcattttatagtgatggtttcatggatatatatatgtgtctaaatkgtacacttgaaatttgaacagcttattcgtatgccaattatacctcaaaaattgtgttctaaaaaaacccactcaaagatattggaagaaaacaaagggggagggccaggcgtggtggctcacacctgtaatcccagcactttgggaggctgagggggccagatcacctaaggtcgggagttcgagatcagcctgatcaacatggagaaacgccgtctctactaaaaatacaaaatatgtcaggtgtggtggcacatgcctgtaatcccaactactcgggaggctgaggcaggacaattgcttgaactcgggaggcggaggttgcagcgagccgagatggcaccgctgcactccagcctgggcaacaagagtgaaactctgtctcaaaaaaaaaaaagaaaaaagaaaacaaagggggagaacaacaatctgaataatacatcttcagaaagtgcagacttaacagaaaaatatgaccataaagcagcagaaaactgccacctgatactacaaaatgaacttaaaaaattaagaaaataacatgatatgaaagaaccatttaaatctgaattagaaaagcttgggaataattcgtctgtgtaacaggtgaatatgaaaatagctgcaaaaacaattagaaattttgaaatgatagaaactataaaagtatagaagacaagataaaaaatagatgtaataggattccctaaaggaaaaagccaaaacattcttctaacagtatgatctaaggcaaaacattggcaaagaacaaattccaaaaactatataacaaattgtatattctagctataacacattctraaaacttccttgaaaggaaaatgacttgaagctctctattgaaaaggcatactgtgtacctggtatggtcagtccagagcaatcagcgccaacacattctgcaaagtcaccagaaattgggcatccagactaaaactgttataaaattaagaaaataagattggtatcagacttctggaaaaacacttcatgccaacagacaaaaaagtaacatttaacatcctcaaggaaaggaaatatgaggcaatgattatatatctagcaaaaacgacctgcaaatatatcttagcatgggctgccgtaacaaaatattatagactgggtagctgatgtattttctcagtttggagatctgagcatggttgaggtctcatgagggttcccttcctggcttgcagaacttctggctgggtcctcacatggcagagcgagcaaacactttggtgcctggagtttttacttgcaaaagaggacattttgtttcaattgtcgataatcatgcctcagataaacctcactggctatgatactaccactgcacaaagcttggaaattttgaccatcataaagaatacaactgggctgggcacagtggctcacgcctataatcccagcactttgggaggccaaggtgggtggatcacttgaggtcaggagtttgaaaccagcctagccaacatggtgaaaccccgtctctactaaaaatacaaaaatgagccgagtgtggtggcgcacgcctgtaatcccagctgctcaggagactgaggcaggagaatcccttgaacctgggaggcggaggttgcagtgagctgaggtcacgctactgcactccagcctgggcgacggtgagagcccatctcaaacaaaacaaaacaaaaaaaagaatacaactgcatggattaaaacataccaaatatatcttaaaattcatgaattcataatactttaaaaaaaacctcattgctcacctttgaaacttactagagtacaattcattactctgaatggcagtaagtttatcctatcttttctttatagactatataaagaggtaacaatcatcagtattggctaaaacctttgggtaaagggaacaggctggcatcatctgaactcagtgggcaatgtcagcgtcactgtaagtgggacaaccaaataccatttcttctgatgtgatgcatcaggaagtaccaggcaccactgatgaaaatgactaaaatgaacttgtatcaaagcaagcttccagtctgcactgttcagtaaggtagttgttagctacatgtggctaaagttaattaaaattaatacaattaaaaattttcttgcactagctacagttcaggtactgaatagccacatgtggctaatggctactatattgggcagtgcagatatagataatttctatcactgcggaatgttctgttagacagtgctgctctaaatctaatgattagttttcaggaaagatgtgagaacatgtaaacttgccaaatgaccccatgagactacaatcagaaaagtccagaaggcaggaaattctacatgacaaatggctccatttctgttaataacatgaaaataaaaggtaataaaaactttcttttttatagcaagagatatttagaaacatccattaaatgtaatctgtagaccttgtttggattctaatttaagaaaattgtaaaaatgcatttttgaggcaatcatgaaaattgcatatgaatcaggtattgggtattatgaagatgttcattttgttgggtgtgataaaaatgtagttacatttttaaaaaataaagcttaccttttagggatatgtactgaagtacttacaggtggcacgatgtctgggatttgctgtaaaacactggcggtggagggggcaaaggacaggatggatgcagaaaacgtggtaggcataaggttgatgggtgaggcaccatgataaggagatggggtgactatacttaatgtctctacatatgtttcagaatttccaaaataaaacttaaaaaataaaawtgccgatgcctacacattgccttctattactagtctaagaaaaacagatgaagaaaaaaggctgcctcttcatacattatttggaatttctgttgtgcaaaatggggtcacctaatttattatataattattgtcatatattgtatgaaatattttatattggaaagttgatcagtaacttcataaagatttagataaaatatttaatcagcatattttgactttcgggcaagtttatggaatacttgcttttgaatcaaaacgtgcaatttcttttattccttggctgacagttttgaattcaggtctgcatgttacattttattactgctttgtttttttcctgttatttcattcttcttgttgcttggttgccaggctggagtgcagtggcgctatcttggctcactgcaacatccgactccygggttcaagcaattctgcctcagcctccaaagtagctgggattacaggtgcccacgaccatgcccggctaatttttgtattttttagtggagatggggtttccccatgttggctaggatggtctcgaccttctgacctcgtgatccacctgcctcagcctcccaaagtgctgggattacaggcatgagccaccgcagcaggcctgcaaaaatattgaaataacatatttataagccatcttcagccccaccaatatatagaaattttagcaaaaaggtttttttaatcactttagtagaaagtgataatgtcattgaagtgtaatttcttggccatctgctcctacagtaaatacttctttaagaaaaacgtatttatggctgggtgtggtagctcatgcttgtaatcccagcactttggatggccgaagtgggaggatcgcttgagctcaggagtttgagaccagcccaggcaacatagagagaccctgtttctacaaaaaattaaaaakaatttagccagstgtggtggtgtacacctgtggtcccaactactcaggaggctgaggctcaaggatcacttgagtccaggaggttgaggctgtagtgagccctgattacgccattgcactccagcctggnctatagagcaagaccctgtctcaaaaaaaaaaaaaaatctatctgtctgtgtatccatccatccatccattcatcyatccttagttgcttccattaaagkatttgagggataatacaataacatataataacaaccacttatgttttttactgtatrttagacactgtcccaagtactttattaatttaattctcataacaaatcctgtgatgtaggtgctattatctctattttgtabatgaggaaaccaagacacagaagggttgaacaccttgcccaaggtcacactgctagtatatactggaactgggactcaagcaggctggctcctgggtccttgctctcraccattgtgttttgtggactgtcatgtaacatactaaatgaataaaaatactagaaatatctataactgtagatttgtcgtggttaagaacaagacctttgggtcattgagacctggggattcaaactccagctcagtctggctctgtgcatttgagcatgttgcttaatctctgagctccagctcttcatcacttaaaggtaactattattaaatagtggagaaagcaattaagagggatagtaatgagtgcrattatgcctggattttagctgtgagcttaatggcagccaaagcaaaagaagaaatacgagttccatcattcattatgtaacacaaagaagcatacctgtttgcaagcatgatacattttcctggtatagcatttaaacagaaactttgaggtgtgattttttatataagacattgaaccagaaatgaataagttagagcaaatatggaagagtcaattctcatracagtataatgtaaggcaaaaatatttttgtggaaggctacattaattgggtccaartatgttgctttttcatgttttttgttttttgttttgagacagastctctctgtgatgcccaggctggagtgcaatggcaycatctyagctcactgcaacctctgcttcctgggttcaagcgattctcctgcctcagcctcccaagtagctgggactacaggcatgtgccaccacgcctggctaatttttgtatttttmgtagagatggggtttcaccatgttggccagtccggtctccaactcctgacctcaagtgatccgcccgccttggcttcccaaaatgctgggattacaggcatgagccgctgcacccagccctttctagtgtttttgatttaaggaaaagtcctagaatatttagaatggaatatgtgaatagcatgttcaatagacagacttccctaaacacgctctccctcagataagcttctgaaaggagctgccatatagaaaatctcaagtttttctctttggtggatcccagaactgccagcatcccattagctatagagggaaatccatgggtttggctgttagcaggtggaaggagaaaagctggatccaaattcttcttamttgaatggatggtgttttggtcaggttctttggtaataaagaacagaggtttacatgtctgtggctgaaataagatgataaagactcatatgaaatgattaaaggggtgggctgtcagaggaattcaaacatgaactgtaactgggttgcacttcacaggcaccaratacggaggacagtttggattccagatggctccatagactgcactggcagagtgtctgtgatttccatttagtacggtatccccagcatctagaataatgcttaacatataatagaccccagtaattacctgttgagaaaataaataaaaggaagtagtaaatcttcactctagagctttatcaaaatggagaagtgagtggcttcaagtacgtgattgataagagctgctgttagccggctatgctcttggtccttcacatatattattatttgagtatgttcagtcctgtgaaggggtgatggtaccctcattttactggtgatagaatttaaattcaccagattatgacttgcccaagttcgtgcagaatactratttggagagttcaggtctacttgactctaaaccttgttctggtaactgatgccctatatattgaaagtacaaacagggtggtaaacagaagtaaacccacattaccagatattaagaaagcatcttaacagctgttttgagggatttcatcagaaacattttaatatcagcctggtctgaaatatcagaaaccatttttctctggctttactttccagtgctagggaacttctaccaaacaaggtaagcaaactcttatattactaagttactagtcagagtttttaaagtaaagattagccactggctttccatttctccaactaaaaagaaattgtggggactgttttacagggcatgaagcagatgactaattgtcttataggatcgttttaattttgaaataactataatctgggataagtaaytcatcacatatactttaatatgtgtaagtgtcatgtggttgaggactttctcatccttgtttgaaacygtctaggggctctgtgtggtggttcatgtccgtagtcccaacattttgaatccaagcactaggattgcctgagcccaggagttmgagaacagcctgggcaacatggtgaaactcccatctctgtaaaaaatagaaaaatttgtcaggcatagtggtrtgcacctgtagtcccagctactcaggaggctgaggtgggaggatcacctaagcttaggaaggttgacgctacagtgagcagtaatcatgccactgcactcgagcctgggcaacaaagggagaccctatctaaaaaaaaaaaaaaaaacacacacaaccatgtgggattaaggttttatttcactggtttatgcttctctaccaaattatggttaaatgcattgtrtctcaatgagataatattgacattgaccttatacaactgacattttttataggtatcagtattatctgcaactgaagaaagatatcttggaaggaagtattccttgtaccttagaacaagcaattcagctagcaggcttagctgttcaaggtaaataagatcaattcataatgaaatggttctatcagattaaaatgtgttacaacaaaatagcaagggatttttaagttatctatctatatacatctttagtagtgtttatatattagtgaaatattctgttatctaaggggcttccttttgggaaaaaatgaacttggaatacctcaatgaaatatgagacttctggaagttaatcatgttataggtcaacagagcaaacagtacaataaatagaagtatgtatatatgtgtgtatacacacacatatgtacartcatatgccgaatgacatttygttcaacaaaagacctcatataggacagtggtcccataaaattataacactatttttagcgtaccttttctgtgtttagatacacaaataccattgtgttacagttgcctacagtattcagtacagtaacatgctgtataggcttctatgagcaataggttatacaatatagcctaggtgtgtagtaggctatacaatatagcctaggtgtggagtaggctgcaccacctaggtttgtgtaagtatactctgatgtttgcacagtgacaaaatctratgatgcctttctcaacacattcccatccttgacacatgactatatacatatacatttattaatactatgctatgtattyatctagttcaaagactttrtctgctaataggtcatattttaagaagaaagatatgccagtcagtgagtttgatgaggttatattcrcttacagtttaagtacacttcatatgtttggtttctttttatttatttcaataggtttttggggaacaggtggtgtttgcttacatgaataagttcttcttatttatttagttacttttttttttgagatggagtctcgcyctatggaccaggctggagtgcagtggcacgatctcggctcactgcaacctcctccgcctcctgggttcaagcgattctcctrcctcagcctcccgagtacctgggattacagatacctgccaccacacagacccaactaatttttgtatttttagtaaagatggggtttcaccatgttggccaggctggtctcaaactcctgacctcaggtgatccacctgcctcagccttccaaagtgccgggattatagatgtgagccaccgtggctggctatggttacatgartaagttctttagtggtgatttctgagatttggctgtacccatcacctgagcagtgtaccctgtaccccatgtatagacttttatccctcaccccactcccacttgtttggtttcttaaatggttgtcctgaattatgcagtaataacatcaatcataatagataaagatggctgggtgcggtgtctcacgcctctaatcccagcactttgggaggccaatgtgggaggattgcttgagtccaggagttcgagaccagcctgggcaacatagcaagacctcatctttaaaatgtacatatataaataaagattctgcatttcaccagcatttttgaattgtttatttttttcatttttacatgtctgatatacatgtatttacatgtatgtgtgtattttcctttttttggagacagtcttactctgttgcccaggcttgagtgcagtgatgtgatcgtggcgcactgcagccacaacctactgtgctcaagtgatcctcccacctgagcctcccaagtagctgtgactacaggtgtgcgctaccatgcctggctgatttttaaaattttttatagagatagggtcttgctatgttgctaggctggtctcagactctttggctcaagctatcctccctccttggcttactgaagtgctgggattataggtgtgagccactgtgcctggctgggaagatttctgatggggcattatttcaaacaataactggcatttagccttgggagtgaaatttaatcagaataattattaataaaactccttcagcyataagaaggcatggagacatgtatcatttttaaacaaatgcctgatgcacatggagccacattccttttcaaggtactttagattttcttaagtatcacttttggctttaagaattactttttcataagcattttgctgaattgtcaattttttaaaaaatattaaaaatttcaacacaaatatatcttgctgtaatatattcaagtggtctaagtctattccccagaggtcatcagtactgttgacaatttggtttctccttgacattttcctgtacataagcaagcatatatgattacagggtaggttttgtttgcattttaactgtaaaatgagatcatattacatagagcttgcaacttgtttttttatttaattcataggcatttttccaagccaagactcatatctgcctaattaacacttttaaaaagatactttaaaaatatactttatatagctataacaaatttgacttctgaaatattagcataccatctagatatactgcgtattgaattttgttgtgcatattttgcaatgmaatttaaatataattaacgtgaatgtttgtcattctatatagcggattttggtgactttgatcagtatgaatcccaggactttcttcagaaatttgccttgtttcctgtggtaagacttcttttgacactgggccttttaaaagaaacagtttattcctatacccttaataatccctgaaatgaaatccgtatgatagacttactgtcaggaataggattataaaaaaaaattccctcttataaacatctcaagtgtgactgctttccctgttgtagtcatcttggtccttgtgaacccacagaaactgaagggtctgtagtcactgcactgtgcctggagacatttgttttctatttgtgagtttaaaaagaaggattcattttcagcttctcaggaagcatgcacaggttttgcttttaactgaaggtttgaaaccttacaaaattatattgaggaatgtcgcttctcatcagcaatttaaaaagtagatgacaaagacactgccttctacttttataaagtcattactgatggaagggacatggaaactgcattgcaacaactaaggaaggtgtggtatgctgttctgagtgtctacacagtgccagagaacgcacaagatgtttttatcttgctgggctcaggactggctaactactgtcaccaacttgacataactcagctgaaactttccctggaattgagaaggtggggcaagttttttttttttggctcttgtgagaagccagttaattccttagaaagatgattacctatgtaaacaaagctcccatatagtaacaatagtcataattttgcctgatagtgacragagtcattaacagtcaatggccatgattccttctaagaaattggggtgaattgtcacatacttaccactgtgtgttttcttcagggatggttacaagatgaaaaagtattggaagaagcaacccaaaaagtggccttactacatcagaaatacaggtaactctaagaaataagacatggaaatagcatagaaccaatgtctgcttgaatttgaaatattcaattaaatatttaatttacatgattaatatttatttgcccaactaaatttggaacattactgccactactattacaagtagccaacatttatatagcactcactgtgtgtcatgtgctgttctaagtaagcacttacccatattacttatttattgtccatgttttaccagtgaggacactgaggaagttgaaagcagccagtcattgaagggtgcccattttttactgcatgtagtaaaggtttgtttgataacctcaaacaaacctgtataggttaacgtaaaattaggatgatttgttttcttttatgatacagcttagcaagtacagggttacttccctctctatacctatggaagctgtgtctgtcacctggggagctatgctaagagctatggtgcttattactctgaactatgcttctgcatacctttgtatacttgtacatattgacgttctttcatgatgaatctctgtgttgcctgtaagaaaaaatactcttctggataatgctaagtcttattctaaaccaactaccacacagttccacatatagatgctccttgacttgtgatggggttaagtcctgataaacccatagtaagttgaaaatactctttaagtcgagatgtatttaatacaccagtcctgctgaacatcatagcttaccctaacctaccctacgtgttctcagaacacttatgttagcatacggttgggcaaaatcatctaacacaaagcctgtaatatattttataatgttgaatatctcatataatttgttgaatactgtactgaaagtgaaaaacagaatagttgcgtgggtcctcgaagtacagttcctactgaatttgtatcacctttgtaccactgtaaagttgaaagtcattcagttgaaccatcatcgtaagttgaggactgtctgtactctatcattaaattcttataactactcattaagataaacattattatctccatcttaccagatggggaaaccaagctcaaaaagattttgttatctctggctgggagcagtggctcacacctgtaatcccagcacttgggaggctgaggtgggcagatcacgaggtcaggagatcgagaccatcctggcaaacatgttgaaaccctgtctccactaaaatacaaaaaattagccaggtgtggtrgcatgcaccggtagtctcagctactcagaaggctgaggcaggggattcgcttgaacctgggaggtggaggttgcagtgagctgagatcgtgccactgcactccagcctggtgacagagcaaaaaaaaaaaaaagaaaaagatytagttacctctacgtgtggtagaggtggaaattgaaagcagatcagtttcattagaacctattgcttatccccttccaaataaaataaacttttgcctctagtctctctccactcaaatccacacagtgactcacaaaagattaatctccctagaatatcagtttcctcttacctctctccttctccttccacgtgctcatgggtattttcatgctttctactagcccaagttcattacyctgggattaaaggcctcctacaagttggttaaatcctgccttcccagctttaccttctgctggacagcagaaccacatgaaccatttcttttctagcttaattggtccctcaggcacacattgtcctgccttttgtcacttccatttattcatttgtgcatttccttaaaagatagcttagtgttcttattctgcattaagcagaggaagagtgctggatgctatgacacaaagataaatagaataatttcttgtcttctaagagtgcattcccagccctgcaatatgagggctggcaggacaacccactatagtaattataatacatataagaagataatgagtgcagttagaggggtatgggcggaatgtgttgggactgcatggagctgcggcattggagaatcccagaaggtgatccagaggaaatgatgcatagacagagtcttgaaggatattagggattggccaggtccacargtgagtcacaggcacaccaagaagagggattctcatgtgcaaaagcccagaggggctagggaacatattctatctgaagagatgcagagtttgggatggctgcagtgtgggtgccttgaggacagcggggagcatcggaagatgaggctggagatgcaagtctgcatgcacttgggcactcctcctttacccacactgccttcctacccatcctagtagtgttgcactcacctgagcaaaaaggggttttcatgtagcctcctcgtacccttattccctgcgttcgacatttagcacataattctcagtaatgcctcatattttgttgtttttatttttgtttttttttgtttttttgttgcccagactggcatgcagtggagcgatcatagctcactgcatccttgaactcctgggctcaagcagtcttcccacctcagccttccaagctgctgggactatagatgtgcaccaccatgcctggctaatttaaaacatttttttttttgtagtgacagggtctcactatgttgcccaggctggtctcaaactgctggcctcaggtggtcctttgtccttggcttcccaaggtgctgcggttacaggcatgagtcaccatgcccagccctgatatttgggataataagcaattacttggtggtttaagaaaagttcaagatttcaccctaagatttttyagggagttgttttatcccccaccttcccactcatctgccttaagtatggagagcaggatctcatgtgataccctcagcattcagcacatactggttttcagtaaatagcaagattgatatagccaattatagatgcttagaaacgtgaaatgtttataatgtcttatgctaaattgacatataggttttaagaaaagctttattttaaaccattttaagcttgctttgtgaacaatcttgcttcttttgggttgcagagggctcacagctcctgatgctgaaatgctgtacatgcaggaggtagagagaatggatggctatggagaagagagctaccctgctaaggtaagtgtggcttggcggctggggctctttaaagttaggcttacaaatttgagaaaatcatggggaaatccaaggatgtccttatgtgcaaaggctgaggacgtgcaaaactctggaaacttaaaagctgaggtcctggtgaccaaagttttgtggtaaaacacattcccattttgtggttcatactttgaaatggtcttgaaatagagttcctaaggagggccaaactttttcaatttttatacttacctataagatcatagatctcattcagacttttgtcttcctkaatagttactctgtaggtcttcggaactttctacatctgggaaaccagtccagggaactctagcagcagttcctctgcatctgcttcctgggtgtttcttcttctgctttctccttgtaggatagccaaggaagtgacatatccattggagcgtgtcttgaaggtatctttgtgaaacacaagaatggaaggcatcctgtggtatttaggtatttttcttacctctttttgtatgttttctatggctcctgttggtgatacattttttagtacttacagcagttaaattgttcacaagtctataccaaggtctcattaaaaaatggaaataattcccttcctaggaaaaaaataccatctgaatgcaacagtccttttcaataagccgctttcttcaaaactctatgtccagagtataatgcctataatgacggcctattataaaatgcttaaaaatgtgtgaccctttttgtgccatatggaggccattctttgctttgatatgaatgtttaatttgagctctggtttccaaggctatttattggttaatttatttattgtgaggcaaggtctcactctgttgcccaggctagagtgcagtggtacagtcaccactcactgcagccttgacctcccaggctgaagtgatcctcccatcccagcttcctgagtggctaggactacaggctaatgccaccatgcctggctaatttttgtattttttgtggagacagtttcaccatgttgcccaggctagtctcaaactcttgggctcaagctatctgcctgcctcccacagtgctgggattccaggtgtgagcccactgtgcccagcctgaagggctctttcctatgaaaaatatagagctttgttttgactctagttttgtaccaaaattcctaaaataccagtatctaagcaaatttcaattattttttataatgttggttttttttgctgatataaaaaaagatactattcatttgtggaaatcttggaatgtgaagcaagttggaaagaatatatagcgatgtgctaatagtaactgactctgaacaatgaaagtacaggtgattttaatttcctttatagtattctgtgttctaatttgtatcttaaagatagtaagttggaccatattgtacaatcccctacctttaattccttaaaatctgttatctggaaaacccaaagttcatgtccaaccaaaagcttatattgtttttataaggcaggaaaacatattctatcacttytgttttttggttcctttgtgtctaccatttgttgagtgcttatcatgagtcagataaactatgctgagcattttttgtgaattttttttagtgtaatcttcataacactgtcagcagtaggtattaccaccactttgcacgtgtgataattgaggcttagaaaagttgtgatttgtccatggtgacccagttattaactggcataactaggactagaacttggatcctccactttatgcgtgggctcttaatcgctgtattaaacagcttttattctctccaccgcctactcactgcccgccccacaacacacacactactcaagctttctaaaccactcctaccatttcttcttgagaactagtttggcctttgaagagctttttctctaaactgacatctcctccctcacttcctttgctttactgcctcttgagccatgaattctccatggtgattatgacctcagagagtacgcatcacttggggagcagaaccccattcctagaatgcactgccctgggctgggtggctcccctttggcagttgctctctcgtccccaagccacttatattaacccttcccaacatgctgagttgggggtcagggagaggagaggaaaatggatccgtggcttcacctgaagagcagggctctgatggtgcccaaagtgtcacatggaaacttgaggcwtctacctggcttcctttatcactggataggaattttcacagttgccttaatgtgatgctaataatctttagatttaacaaacaacggaatccgwactaarttgattttattttaatacatttaaaataaatctaatggagaaggataaaattttttcttccataattttttctttttataaaattctgtgattaataaaatcaaatattaacatataaaagctaatacgataaaattagaaagtataagattttgaatcctagtgatcacttccagaatagttcactctttgagttcctggcatttcaaatttatcttcaccctgaagcttttcagagcacacctcccccacttttgtgccttattttaatacctgcagcacttaaaagttcttgtttgcttctgtgttctttctcccacctttcccctccaactgtgcgaatttgagggaagcactgtaactcactaatcttagtgtccctaggacctactgcaatttctggcattgttataataggtgtcttttattttgttgaatgaataaatggggcattggcaatcagctaagagagggatcttccatcaagcaaatctgacacatgagaatgatacattttacatcttttaaattctcttttccctcatttattatacatgagtttactttttgaactagctgctgttacttcaattagaacattcatgctagctgattaaaaccactgtttttttttttcttttttctgttttggttttttttgagacagagtctcgttctgttgcccagactggcatgcagtggcrcaatcttggttcactgcaacttctgcctcccaggttcagacaattcttctgcctcagcctcccaagtagctgggattacaggtgcctgccacctcgcctggcctagtttttgtaattttttttttttttttagacagagtttcatttttgttgcccacgctggagtgcaatggtgctgtctcagctcactgcaacctccgcctcctgggttcaagcgattctcctgcctcagcctcccaagtagctgggattgcaggtgcccaccaccatgcccagctaattttttttgtattcttagtagagacagggtttcaccatgttggccaggagtctgaaactcgtgacctcaggtgatccacctgcctcggcctcccaaagtgctcggattgcaggcgtgagccaccatgcctgacctagtttttgttttttatttgtttctttgtttgtttgtttgaggcagtgtctcactctgtcgcccaggttggagtgcagtggtgcgatctcggctcactgcaagctctgcctcccgggttcacaccattctcccgcctcagcctcccgagtagctgggcctacaggtacctgctaccacgcctggcgagttttttctttttttttgtatttttagtagagacggggtttcaccatgttagccaggatggtctccatctcctgacctcgtgatccacccaccttggcctcccaaagtgctgagattacaggcgtgagccactgcgcctgggctagtttttgtatttttaatagagacagggtttcaccatgttggccaggctggtctcgtgttttttgttttttgtttttctcaaaaatgttaccaaatgctaacttacacgtcaggcttagggaaaacttgtgtattctatctccttgtttcccccatgggcactcacattgccagttctctatttgctgttctttaggtggcatgacattgccaacatgtcccacaacaagtccttttttgcattagagctggcaaataaagaggagaccatycaatttcaaactgtgagtaaacattaggggtctgcatggaatgtttttcctaaaagttaacaagttctacttctgcgtgcctgtatgtgtttggaggcagggcagcattaaaatgataatattttgtaattgtataaaacatgcagttttatcatatagcattttgcaaaatggcagttagcaaaaaatggctgctcagtaaatgctgagtgaatgagtctttggataactactgtctgatcatgataacctttaaattaaacttcagggattatgtgggggagaaagtaagcactgatatcttaaatttcattgataaatgaatagctctgaagaaatgttatttaacagttacttgcttttgctctcttgacaaaggcaatattgagttactgagtcatatttttgtttaaaaatgtctttgagtatatttggcaagaataaaagttggtatttttatagtttttagattcccaagtcattttgaaactgtttaatatgagaatcacactgttagaacagattgttttgtcttcataaattaaatcctacttgtggtattcataccatrggcacagtgttggaaaatgaaaggcttatagtgttctgaaagtgactttgtcatatgatgtcacccattatgtctttagacaaactctgcattaaacgtatcaagttgtatgtgtgctttcatattgctttatgcctattttgtttgctaggaagacatggaaacagcaaaatacatttggagactctgtgttgcgcgacacaagttttacagactaaaccagtgtaacctgtaagtatgtcctgctcatggaaattatcaaaaataatgaatttagaaattgtaatcttgagtatactgtatcatcaagaaagacattttatcagttgacatcttttyttgatcctrtagctgttttcctattttagctttggaccaacttgtaataactacattgtatrcctctaagatttatttcaactagttacaagaaccattgtaattcttgaaaggtaaaaagggaataatatcctttatttgtttaaatcaatcctctggtaagcattttkagtcattaaagattattcagcttttccagctatctgaagaatttttgcccctccttcctggtgtgcatttttcttagcccacatgggtttcttactgtttgccagatcaataaagcacacggtgatattgcacatataaaatattgtccttcatctatactcccctccagcctctgcaccatatctctgctttcctgaatagcaggtttcctcaagagagttgtgtatgcttgtatgtttccttccttccatcccattttccctaagcctccacgttactgatgctgcttgttgtggtcaggtgactttcgtccagtgatcatttcatgagttctctcacttgaccgctccgcagtactgatcctccgacagctccttccatccttctggaatcctgctcttcttcggctgccaggacaccaccccctgctcggcttcctctttctaggctgtttcttctcagtcacctttgctggtttggtcctgaggccttttctccaaatcctttcgtctagggggcttctcctgacctgtcctccccctgagcccccggttcaagtgattctcctgcctcagcctcccgagtagctgggattacaggcatgcgccaccacaccccactaattttgtatttttagtagagacagggtttctccatgttgttcaggctggtcttgaacttccaacctcaggtgatctgcctgccttggcctcccaaagtgctgggattacaggcgtgagccaccgtgcccggccctccttgagctcttgactcctgcatcctaccgcaagcatttagtgtgcttagtcctcaataccactctgaaagttgtggtgaatatatactactgcctgtatattctgaaggtagagctggcagaacttgctgatgaattggatgtggtatgaaacctgaccatttttaccactcgtgttaacagcttagtgctggctgccactacttctcatcagaatactgaggtagccttctgactttcctgtttctgtgccttygctgcctgtagcttattttccatatgtcagccagaatgatcttagtttaacctgaatcagatcctgacactgacactcttctttttttttttttttttttttttttttggagacagagtctcgctctgtcacccaggctggagtgcagtggcacgatcttggctcactgcaacctccgcctcccgggttcaagtgattctcctgcctcagcctcttgagtagctgggactacaggcacatgccaccacgcccagctaattttttgtatttttagtagagatggggtttcaccatgttggccaggatggtcttgatctcctgacctcgtgatccacctgcctcagcctcccaaagtgctgggattacaggtgtgagccaccgcaccctgcccagatcctttcactcttcttaaccctcctttggcattccacttctttttttaagtaatttttttagtttgtttttgagacagcyctgtcacccaggctgagtacagtggcatgatcatggctcacagcagcctctcaacctccctgggctcaggtgatcctcccacctcagcctcctgagtagctggtaccacaggtgtgtacctggttaattttttggtgttttttatagaggcaggatctccttatgttacccacaccggtctcaaacttctggactttaggaatcctcctgccccggcctctcaaagggctggacaggtgtgagccaccaggcctggccccattttacttctaataaaagtacgaggccatacacagtgtggtccttgcctggtttcaaccttatgtcttttatcctcctccctgcttgctctgttccagccacagtggtatcctggctaggctgcagatgtgcctcaccctaggggatgctgtccttgctcttttcccaggtctccacctgccttgctccctcattgcagcctgctgtctggtcagatatgaccctcttcagaggctgtccctgattgtcctatggtaccccccttccactatgatctgtctctttaccctctaactttgttttgttctttatagcacttagcaccatgtgaatttctatatttgtttgtttgtttgtttgcctgtatcccctgccagcaggttagctctagagcagtgcttgaggacagacactcttccctgccttcagtgctatattccccatgccaagcaagggcctggctcactgtcggccttaatgaatttgttcagctaatctatagatacaggtgttaagagctctgattcaagatgtcttggtgctgtaagatcccttaggaaaatggtacgtcacccagaactgccaagataggaaaggctacccagccaagtgacatctaagctgagacccgaaatgttgcactcaattcccacaacctttctttaagctgtcctcttgtccctggtccatgtctggaggcacctcctggagctccctcccacttggccccccacgccctatctcatctgtatgcagtcagtcttctggatagataagcaaaatatgtagcactgctcttgaagttacatgtcaggaacaaatctgagcatrtgcctctcacccgccccgtcctgggtacaggattaagggcagactcctgaggtccttctctggacttagctgccccagcccagttggccttggagtctgactccaggaaggcatctttccttatcatgtgaatgcccccagcccaggcctttgctaaaatgcccttccttcccttctctgacagactcttagtcattcttcaagattgagtttaaaatacagcccccatagacaccaccaaacattcagtttgcttagtccttgacaccactctgaaagttgttttttctacctcttttataacaatgacctgaataattcatamcaataatttagtaaatgcttgctctgtgtcaagcattatactgagagcttttattttctttaatccttacagtaaccctgttgggcacaattattactatcccattattgatgaaggtatggagacttacagaagtgaaatgtcttgccctgccacacaactagtaagtggagcagcaagactcgagcctgtkctcttagccgctgtgctagcctgttagagtagttcctgcctgcttttttcatattgacagatatcaactgacagatcattttcatttgatctgtctctcttgtttgatgaagctccatgagggcagggtctcctcttcctcatcttcgtgtcccctgtctggcaaggtgcccggtgcataagggcttagtgaacaatgggagccggagtgtggcagtkatgggagtcacaggggagaagagcacttttgctcctttgtctcttccttttattacagattgtaaatgaggcatggggtggaggcaaagtctaacaagggcattttgtcccttagcaccaggaaggaaggagaaaggctgtkgaagtkccttctgtcttgcagggtgtgagagaaactctgggcaggagcagcagtgtaaagataacatgcggggatgcccacccggacggggagctggccagtggtttgcatgtatggcccagtccctgtctcttctctgccttcccctgcaccatgtttgcatccgagtccccaycgctggtctggtgatgggattttcgtaagcactgacagggaggaggaacctgctttctttgtaaatatgggaagcggtttctgctaggggcctgggtgtatttgcatatgaaagtgttccccctggtggtgatattcagtagtgctacttgcctttggggttccctggggctggcctggttatccagccatatgtggcatgatttctatgcagaagtaagttctaagattcaagcagtagataatgcagtctgttggaccacagcattttcattttaaagactttaataagttaagagtgttcataatattgagccattattacctcagtttgtttcttctctggaaaatagtggagagtytacattttgaataaaccataaaacataatccctttccatgaggcatccatattggttggtggttagtgcctgttttttgtttgtttgtttgttttgttttgtgtttttttttttgcaaattaacaacttgtaataagtaaaagagggaagagggaaaagcaacaaatgattgattatggtgaatgagtcttagaaattcagctctagtttttggaatattgctatttattggcaagtgtgaacaaaactacattaatgtcatcagttgcatatgctatacctaaataaggaacacctgaatctttttaaaatggaatagttatgtttaaagggctgttttccaaagtttgctttcaatctctatatatccaatagattgtggcagtcgatttccatgagctattcctatgtaattacttatgattcattctgtagggaactaatatatttcattgtgagcgtttgtttcccacataaagtaaatgaagcttttaatattagcttttaaaattttgcttgataataaaatgaaaagaactttaattgttatggccatgttttaaaggctctcaatatagactgtttagtcatgttccaatattatgattctgaagtattggtagacttgttgtcatgggccagatgggtaaactaaagcgtgataggcatttaacaaaactgcccctggcctggaactggacggtggcttctggacatctgctttgggctggggtgactggtggcccmggagatagactcgacttgcacagaaaggggaactgtaatcccagggtgtcccctttacccccagtcctgatctattgtagtttattgctgcttgggatggccttatgtgactcatctaatcttgacccagataactatattttagtatttatacaatggcataatccaacagccttctccctccaccccctaacaaagtgcattagataacagaatgatcgttatccaaaccttaaaaatgttagatggataacaatctgtcttttaaaattataaagtgaggatattgagacttttatacttaatattcctttatggttgaattgggaattaaatgacataataatgtcaacctgttagatcagaaatctgcttcaaacccactgtctctcactctaagccccagaactggtcatgctgtaagcaccctccctgatttatataaggaaaatgccgrgagagttggggagtcatgagaggccccttggtgtaggtggctcccctgctcttttctgtgaggaaaagggaggatggtatccttcaacctgcaaagccaagtgatagagggttcaagagactttctccagaagggaaacttgtatttcagactgcagcaggccactcgctgagcgcagtgagatggctggtgagtgctccctgcagctcaggggtgttggtgaacatagcagccggtgtccaccttggttccggagacttttgtaatcaggagactgactagagtaggccctgcctggaaagggaaagagtttacccatcttcttggcctactgcagggcttgaagagactataggaagtctggaagaagatggagcagcccctatcccattccagtcccctgagccccagaagtgtagagaggacccagtagttcccatggatccatgtgaaggagcagggcaggaagaggtgggaggggagaggaggagcagccacaaggccaaacagtgggacctctgggtatggggacatggacccctggtggagccgaggagaggcagcggctttttctgagtaggttcttatatggataaaggtcagtgtcaccctggaaaaccacacatgtcggccggtcacggtggctcatgcctgtaatcccagcactttgagaggctgaagcaggtggattatctgaggccaggagttcaagactagcctggccaacaaggtgaaaccccgtctctactaaaaatgcaaaacttagcctggcgtggtggcgggcgcctataatcccagctgctcggaaggctgaggcaggagaatcccttgagcctgggaggtggaggttgcagtgagccaggatcgcaccactgcatttcagcctgggmgacagagcaagactccatctccaaaaaaaaaaaaagaaaaccacacatttcatggggctggagtgacactagggcctctccctccatcagtattccttcccagttacctgagatggtctctgctggctttgttcctctcccatcccacaatgccaggaagctacacctaaggcggggtttggtaggggggtgaacagtggaagcaggcatcccagagccaagtcagtgacctgtaagcagcttggatgcagccctggtctacccaagtgtaggctgggaggagagcatttattcttccttacccttactatagtgagctcaaaaggtgtaagtcattgagacaaacatttgctaggtatttccaccatctaacacttttatttatttatttwtttaaagagacggggtcttgctctgtcttccaggctggagtgyggtggtgtgatcatagctcactgtaacctcagactcccgggcttaagggatccactggcctcagccctcagcttctgaagtagccaggattataagcgtgtgccaccatgcctggctaatttttttttttagttttttagagatggggtcttgctgtgttgcccaggctggtcttaaacccctggcctcaagtgatcctcacatctcagcctcctragtacctgggattacaggaaggaatctattccttgaactatctattagtgcatgagctttcaatggcatctttttgtttatcaaaatcttaactcccttacatcgtataagaaaggaaacttacaaagcaaaattcagacgaggcttagaaatacaagctcagctgtaaatgcttagtaataagcatcactttagtcctcacttgttagtcactcatttgctcagcaaaggcaccagggataccacatcttgcctccacggagcttacagattagttggggttggggagcaggttggacacatgattgttagacacatacactcaggaatctgacagacctgctggttcaaatgccggttctactacttgtttgccatgtgaccaggagcaacttactgaacttacgtatcactttccttatctgtaaaatcaggataataactggacctcccttatgggtttggtgttcacattccacgagataatcatgtacagtccttagcacagtttcaataaataatattgattttacttgggctggtagacttktttcttttttttaaagacaccaggtcctagtatcccagtttcccaggtagaatatggtgggaattcgcagatgggatcgtagtgcactacagccatgaactcctggattcaagggatcctcctgcctcagccttccaagtcgctggcactacacgggcatgtkccaccacgcctggctcagcctttttaatttttattttgtcttctttggcacacagattctagtgatttcttctcagttatttagcagcacccatcaacatagtaactgcccaaaaagtttggaaaccacagccaacagttacatggttttctcttgtatgccaagctgaggatagctggtctcagagtaaactgcatttataagaacaatgccaagaagaaagagaaggttagactattagaactgatggcgtggctgcctgggtcaagcactttggcaggtacacgcttttgtagtttgttttcttagtagagccggctactacagtgggcagtgttcgcctccacactgggtgctgcggcaagagcgccaagataagctctcagtgtgggagggccgcccatgtgctgaagctctgcatccttgggttttgtgttttatttttgccccaggctgggcaactgtagacatgttgttggagtttgttgacagagaattctgttggcaatccttgtgaatttgtagtactttaaaagtttcttaagttcagtccatctagacagtgagtctctgctagactgaacacagggttcagaggacccagtttgcctaaacctagtcctgacaatgaagaataaccagagacaaagtaaatttcaaggctgcaaaaatgcagcgtcttcaaattctgggcactattttttttttttttttttttgagatggagtctcactctgtcgcccaggctggagtgcagtggcgtgatctcggctcactgcaacctccgcccccttggctcaagcgattctcctgcctcagcgtcctgagtagctgggattacaggcgcctgccaccgcgcctggctaatttgtgggcactaattttaaggaatatattaatgtgcagttaaggagtattttttattttttattttttattttttaaaacccagacacgccatgcagacttgtgtcaccaaaataaatactggaagaatggaatatcttttggaaaagagacatttatttttcmttaacagcctgaatactttccagtaacaaagaaatgaaattatttataaaagctagtaaaagcagttgtaatcacctgatgttaaaactagtatgtactagttttctttttatctcaagagtcttataaaaataagctaatattcagggtttttgaatataagatactagttttcagagtgctaagagtaatattaatttatgagacatgaggcttgatattatggtaaatttgcttaaatggattgaatattcactttgtcatgatggattttctagtaattagtccttagaacactgtaaccaaaggtcacaaaatatttttgtaatcagtgattatgtgttacataagtacatgaaccaggaataggtggtaaaaggtataagaaaaagtgctttgacaaaactacatgtcatcaacaaagccaagaatccagtgtgtttaggttcctagatcttgcagtaaaactgaccacacagaagaaaaaaaaatcttgcctttatttgaaaacaatagttacaaatgggcttttctgtgtctgtttcctttttttaccttattgtttttttaaagatagaacttgctgtgtgartagttgaaaatctcacattatcacattagtgtttgtcagcactccctaatacgtttaggtacttttttttttttttttttttgaggctagaatctcgctcttgttgcccaggctggagtgcaatggcgcaatctcggctcactgcaacctctgcctcctgggttcaagtgactcccctgcctcagactcccgagtagctgggattataggcacccaccaccatgcccagctagtttttgtattttcagtagagatgaggtttcaccatgttggccaggtggtctcgaactcctgacttcaggtgatccacccgccttggcctctgaaagtttgggattacaggtgtgagccactgcgcctggccttaggtgtttttttaaaaagtatattcaaaacaaatcagaaatttcttgcaaagaaaggtaaatgggtttaccatcggctcactgaaccaagtcttgtgctttgctttcccttggttccttagaggaaatgtagatttaaaaaatacgtaggtttgaaatttttttatatttgagttttttaaaagatggggtctcactatgttgtctaggctggtcttgaactcctgggcccaagatgctcccaagaggcgggtctacaggagcatgcttactgcacttggaaatgtagattcttgtcactaaaatcataaattcatttcttcattatgtttgtagtctgtggttaacagacttttaattaaaggcagttcttactgcttgaggcttctgggttgacagtggatggtcccccgggaggaaggttagtggagggacccagggctcccccagcgcataggagaaacacatttgcatttgcactgaatccagcttctcctgcgacaagtgtgtgggtgatgtagccttgtctctttccccactgcttatggctaatccagaggtttattggatgggcctgggaagtatgctctgatcccyttgtgggtccaggcgatgatgctgtgtggggagcctgaaaccacagggcaggttgacgggttggggcagcaggaaagggctgaggccccacgggccgacagagaacctcccttcttttctttgacttcatgacttagatagcttgtctttttttttgcctgagaagatttattattttacattcctatatcttgttttggtagaatttaagagagagtgtgtatgtgctcttctcagagtcatcctattttataggcaaactcagactgtcacagtgaacccaatcaggaggaggtcttcttcaaggatgtctctggtaagaaacaaggaaaatatgattgcttttttattttagtgatgtttttcctgaataaaatatgctttcaatgctgttaattttgagtttgaaccataaaagtgtattgatatttcatcatttttaaccaaagaaatggtaattttttcccataggtccaacctaatatttatattattatattatacatatttgaatattaggtctgaccttaatattaagaacttagactattggccaagagtaatcctaagttggtatatatttaaaatactagatgcctttaataagattgactataatacctataagcttcttatgttgaaatgtttctacaaggaaatgtgtatctattgcttcttgctcttagctttttagatgcagattttctggtggagcctaatgtccttggtatcagtcatagggcttgacattgccatttggggaaacagaaatgctagatatgttaagaactactgtgtcttcatgtttattttccatatataatatatttaattcctttagaagtttttttaacagaaagaatccagtggataataactttacctgtattacataagcaatgtgtttcaaccctgtgtcaaactctccatttcttagcctaaaccccagccctacgtgatgcctcccccaccgcagttgcactataatggacattatacagaaccatatgcttcttcccaaggtaaagtacactgtttctgccatgccttacatagttatgactatggataaatctgtgaatgcttggagatcatgaagcctggacagtttttggctgaagttgcaccccaaattgcatcatgataatagctatcctggattcataaaagaagccaatatattgttttttgtttgtttgtttgtttttttggagacagagtctcaatgtgtcacccaggctagagtgcagtggcgtgtctcagctcactgcaacatccacctcctagattcaagcaattcttgtgcctcagcttcccaagtagctgggactacaggcacgccaccacgcctggctaatttttgtattttttagtagacatggggtttcaccatgttggccagactggtctcaaactcctgacctcagatgatccasgtatatttgggttcttgaatgtatgtaaaaacatgcagtatcaaattttgatgctccactggtctcaaatttggccaatgggaaactatcaagctggttcctgtgtccttttaccaccaccctattagcctttaagtgcttctttgctatctgacaaagaattcccagggttacttttctttccctgccagaggctttcctattgtaaaagttaaacacatgactactgcagttttcacatgagaagtataaggaattgtatttataacaaacccccaagctgaagtttaagcagtcaattaacatttactctatactctctctgtrtggggctataccaaatgctaaggaggtttatgcagatgagtatttccacatcttaagaagtttatcttcagcctggaccacagggccagaccctgtctctaccaaaaaaaaaaaaaaaaaatagctgggcgtagtggtatgcacctccagtcccagctactcaggaggctgaggtaggaggattgcttaagcccaaggtgggggtggaggttgcagtgagccaagattttgtgctactgcactccagcctggatgacagagggagactatctcaaaaaaaaaaaaaacaccttagaatctaatagtttaagataagacaagtgcacaaataactttgtctttctcccctgaacccctttttcgtggagaatggggtcttgctatattgctcagggtggtctcaatctcctgggcccaagctatcctcctgcctctgcctttctaagtgctgggattataggcctgagccaccactcctggcacaaataacttgaatatgatagtttttctgagacagcatgtgcaattaccatgctcctcagtggaagagagactcatcacattggggagattgagaagaactttctgtatctgaaaagatgggtggatttcagcaggtagaaaggcaggaacttgactggggttgctgttcctagttttggggatagtgaacgccaggcacagaatgaagcagggtgtgtttggagagtagagtggtccaggtttcctctcgggtaaggaactggtagggagtgatgcatgaagggaccagaaggtgggatgtgactgtattgtttgtgtcggccctggtgtaaaagatgagggttttcatgcagtgaggtgggtagtagagagcagggctttgggtgtagagcctgagagcatccccctcrccatgttcttgtatttcctccctcttgcaccctgcccttgtctggtatttgcaatcccggcccctcccacttccaggacctggctgtcctctgcattgttagtctcactttgccactcattctcttccctctgtctataaacatcttaatattgttcattctcctccctttaagtaatggtttgagtgatctgctttcttttctcactgacttttttttttttttttttggagacggagtctcactctgttgcccaggctggagtgaagtggcgcgatctcggctcactgcaagccctgcctcctgggttcacgccattctcctgcctcagcctcctgagtagctgggactacaggcacccgccaccacgcccggctaattttttgtatttttartagagacggggtttcaccgtgttagccaggatggtcttgatctcctgacctcgtaatccgcctgccttggccttccaaagtggggattacaggtgtgagccactgtgcccagccctttctcactgacttayaagagtactctctgtgtgctgcttctgcttgctggttacccgcccactcctctgtctttgccactctgttaaagcggccctctgggagcctcccagcacccccacatcccctcaccatcacattcaagcctttgtaccttctggaaactctcctggcatgctaggtttttccctcctccttcccatcagtattgtttggtgagctctgcaggtctgtcctgtggctttttccctccctctgtgagcttcccagggatctcatctacatttaacatttcttttcttttcttttcttttcttttgagatggagtttcgcttttgttgtccaggctagagtgcaatggcatgattttagctcactgccacctctgcctcctgggttcaagcctcagcctcccaagtagctgggattacaggcatgcgccaccacgcccagctaattttgtatttttagtagagatggggtctctccgtgttggtcaggctggtctcaaactcccgaccttgggtgatctgcccaccttggcctcccaaagtgctagtgttacaggtgtgagccactgcacacggctgtgtgcaggatcattcttttgcctggtgttcgagactccacacaatattccctgagcctgcccttccaaccttacttcccaagttattttactcctctgtagctatctgacactctagccaccccagcttgcccaggggtgcaccctggctttgccagtgccgctctgcaccctcaggtgcccttaccccatgcacccttccgttcacatgctgccatgcagaccggataggcagggctatgctgtgctgacaaaatactccattccaaactctcagggaagtaataataaaggtcacctgtccgttgcacactgtactagcaggagggctctgccctgtctgagtctgccgtaggggcttgagctggagaggctcttctctctggaatgttgttggtcagtgttgcagttggaagagagcctggaagctggcttttaaccctctgtgcactttcccttgaccattactagtcgcattgttgtgcctgatatcaaggggtgaggaggggtaaccctgcgtgctctgagaggtggagagacctcacttctgatggaagctggacacgcccaccccacccacttacccctcaagtccccttaactgccatatcttgtgaggtggttcttggttctctcttccttgtccccatcaacccaactcaggctggaaatgagcatttcttcctctggactcctgtaacccttcatctcttctcccttccttgaattatggtgatttcatgcatacctttccccttttcttgcctgtattccaaccatcttttcctccttctattcttagtattgccttttccacataacagtctcataaatggctagatggtttgtggggtgcagaagcagggagactaggtgtatatagagctagttcagacaagctggggtaggggcccgagctgtggcagcagtgaggaaagggggattgcagagatggagccatgaccaagctttgcataaatgaggaaagcacagtgacatggaagtgctgtgtgtcagcagaagaataccatggagatttgagtgctatttcctcacagctgcatgtgccaccagaataaagtgtacccactggattgtggtgtattacttaagtatcaccatgatcacataaatcaccatggagctttcgaagcacaaaaagaatgcctttcagaggaaattgttatttgaaggagttggctgctgagtgttagaaatcatctagggttagaaatcatcctcagtaacagagggcaggtgagctacaaattgactagaagaaacatggcccctgtcatccctgggcagggacacatgcatagctattttaagattaggttaaactgattctgttagctgcaggtctggatcttcctgaaacatgggggccagggcagggggcagctgcagctgtttaatgtggctcctcttggcttctggacactttatgggctgtgtggctgctggtgacactgttggaccagagaagttcagatcctgctataccattacccttttacagtcgaagctctcatattcatttgggaagaacaataaaaatttccagttaaggaaatgcttacagacagttggtgcttgaactagctcagcagcagcaaggccacatccctacccagggaagaaaggcagagtccccagcccagtgccttgaatggtatctctgcctcaacttccccagagttccaaaaagtctgctagtctgctgtgggtgtggttcgtttaagacagggtctcactttgtcacccaatgaatgccaccccttaagtaggcagagccatgcccatcctatagatgaggaagccgaagctcccagggtcactcagatagtgtggctaaagctaggtcattctagcggggatttttacaagctgtgttaaaaatgtcatcagaggtaagggccgatctcagtatttggttggagtaattagtccatttaaaaaaatctcattttgaactcattttttctagataacctctttgtgcccaaccagaacggatactactgtcactctcagacaagcttggatagagcccagattgacytcaacggtcggatccgtaatggcagtgtctacagtgcacacagcaccaactccttaaataatcctcagccctacttgcagccctcgccgatgtcgtccaaccctagcatcaccgggagtgacgtcatgaggcctgactacctcccgtcccatcggcacagcgccgtgatacccccgtcctaccgccccaccccagactatgagactgtgatgaagcagctcaacaggggcctggtgcatgcggaacggcagagccactcgctgcgaaacctcaacatcggcagctcgtacgcctacagcaggcccgcggcgctggtctacagccagcccgagatccgcgagcacgcacagctcccctcgccagcggccgcacactgcccgttcagcctgagctacagcttccacagcccgtctccctacccctaccctgccgagcggcggcccgtggtgggcgcggtcagcgtgccggagctgaccaatgcgcagctgcaggcgcaggactacccgtctcccaacatcatgcggacgcaggtgtaccggccacccccaccctacccgccccccaggcccgccaacagcacgccagacctgtcccgccacctttacatcagcagcagcaaccccgacctcatcacgcggcgcgtgcaccwctcggtgcaaacgttccaggaggacagcctgcccgtggcgcaytcgctgcaggaggtcagcgagcccctcaccgccgcgcgccacgcgcagctgcacaaacggaacagcatcgaggtggccgggctcagccacggcctggagggcctgcggctcaaggagcgsaccctatccgcgtcggcggcagaggtggcgccgcgagccgtctcggtgggctcccagcccagcgttttcaccgagaggacacagcgagaagggccggaggaggcggagggcttgaggtacggccataagaagtccctgtcggacgccaccatgctaatccacagcagcgaggaggaggaggacgaggacttcgaggaggagagcggggcccgggcgccycctgcacgtgcgcgcgagcctcggcccggcctggcccaggacccacctggctgccctcgcgtcctgctcgccgggccyctgcacatcctggagcccaaggcccacgtcccagacgcggagaagaggatgatggacagcagccccgtccgcacgaccgcagaggcccagcggccctggagagacsggctgctgatgccctccatgtcggagtccgacctcaccacgtcaggccgctaccgagcccggagggactctctgaagaaaaggccggtgtcggaccttctctctgggaagaagaacatcgtggaagggctcccgcctctaggggtaagccacgcggcgagcagtgccgggccaggggaccgcgcgttcgccctggcgcttctttcactcatcacgtcccgtgtttttcagctcctcttgttcttttaacgttcttcattcccccacgtcactctctttttgtctaattctgaacacatttaaatttatggaaatcatggggatccacttgaattttagtggttttactggagataattattatagatgaagtgaaaaggtaaattcacagggttttgtcgaaatggaaaagatgaatgaaatgttttagtaatgcactgttaagggaaagacagttaagatttcattactttagccacgattgctttagccacccattaaaaatactgtgggtgatgtggcaccccaggggtgcatttgtttagtttgctcaagagatatctgaaaaaagcatccaggaaagtgtacccaatcctaatataattctccaggttggagtgtgtgtggatacagcttacatatcttggccgtgattctccagagtgattctggagttgggaaggtggcactttgttaaggcaaatcctgagacgtccaggtttcttaaatttaaaagaaagatgaattcagctgagaatctaaggaaagtccccggtagaagatgcagttctttaatattcagcctaataaataaatatgaattaagcactttttacctactttgaagcaaaatataaaaaagcatagtagcatcatctctagctaccatccttggagcatttgccatgggccaagcatttcctctacttttgtggcctatttacagtaagcctattgttatgcctgttttacagatgaagaaacagacttagatattaactaacttttccaaggtcacatgactagtgagtgactgaactggaattttaaacccatacttagaagcccattctgttatcrtctacactgtagatgtatgttctgcattgaagtatactgtatatgttctattaagtcataattgcttgttgaagccttgctagtctttcactgaaacttttaaactcagtccttaacctgggactaagcatctgcggccttgtcatgaagtgtgtccaccgaagtgattttgttgcagtgctcaggcttccagctcttcctggcccacatctccactcctcatgccctgcacttgagccaggctaacttgattagggcctccatcctwtctcctgttggcttccagtgtcctggcaactagggttctcctccccccatcgctgctaaactgcaaactccgacaggacggctcatctcaagtgtggttctggcctagtgtatgacatcctttaagatgctgcaaacatcttgctaaacaggaaaaaacgcacactattatagtacttatgaaagagattaatgtacatagacaaaaactacttaacaaaaaaagtaccacagatttaaatttgcttttttttttttttttttttttttkagaacagtcttgccctgttgcccaggytggagtgcagtggtgtgatctcagttcactgcaacctctgcctcctgggttcaagcgattcccctgccttgtgatctggctgcctcagcctcccaaagtgctgggattacaggtgtgagccaccacacctggcctaaatttgctttcttttaataagttttgggtttgaattttaagttgatttttaaatttttcacaagtatgcaacataactcacatccctgaacagtaaaggccaatgccttcagtggacacagatttaagagtgtagggagcagtgattcaggataaggtgtgggtagattttccaaagtaactctacctgaatccctgagccagctggacagggtccttttatagttaacacccttcccattgcattaagaacggtctgtttttatgtgtgactcacgtactttccccaaatgctatctgagtacagctcagtactcaggcctattttatccctgtatgttttgaatggggtctggtaggttcagttaaatctgaggactttgatcaatttggttctcttaaaagaacttttctctcccattgacttttaagaccacaatactagtaaaattatgtgattggattatgtttttggtcctttttgcttaaaggattctacttaaggaatgggtatggcagctgtggtcacgaggaaagagcaaaggtcctacaagttaagaacgttggggctgagtctagagcctgccatttgttagttctctgtgaccacggtcaggacccttcatgcgtcagaacctcagcttccacatcagataacctcagatcatgaggacggtcatcccttcgctgcctgcttcgtggcattatgtcccacatgcagttaggcatgaaaaaatgcctcctgaattacatgattcagtgtaactgattttaaccaaagatttgcttttatttgttttgacactgattaccttgtaaaagaggcagccatgtgacctcagacaagctatttaatctgtgactcagtttttacatttgtaaatgagaggaccccagagagttgttggggggataaaaatgaggttctggcacattgaaagagattagtcaatattaacattactgtgaggtggcatcatatatttaacttaatggctttcaagagtggaagaggccaattccctattgtaccctctgacctttcatagtaacatggggttgccattatcttaatcgttacaacaaatttcctaatgtgaattaaggttatggaggtttagtattaaaaacagtgaaataaactgtagacaagtaggaatgattttagaattctccacccatctccacctccagcaacctgattgttatcttaaaggcagactggtttgggtgctcatatatctacataaagattttctttttgttgtaccctttagtgcagtggttctcacataagaaatcactgtgcagggtatgcattaaaatcctgtgcttatattctaagggctaattaaggcatattcaaggctagttttgactacatacaacattcttccaatactggcttttgaactgacctcacagccaatcagctttatccagcgtgtcccagtgtgggatattttgagtcattttcaggcagagaagtgccagagctagttcatattgactagcaagagccgacttaaatgttcaggaaycttgtgagccaattgatgtgacattaacagtttgaaattggctgtgatgggagtatttacaccatggatatgggcaaacaccgatcaaaacttccttccaagagccwgttgttaaatattaccagcacatcactgttttctgcacgttagaatcattaaatttcagcctaagcaggaagtgtttagtctgtatgcctgtgtctggatatatctgtctctttctgtctaggtgaggcttacagaggaaaggtgacttgcctgaaagaagttggtcagttagaggccagatgtgaacccaggcctctgctgtttatagtctagactgcattatgtggggagctcatgatcaaatattaattataaaattaaaaattaatccacttagcttattgagttaggtaccaatcacagtctccaattacagcagcaatcttttaggatttttttcctctctcaccaagttgccttttccctctgttcttgcaccattatcatggggcttcatggcctgttacaggctgagagagctggaataacacggattttgtttacagggcagaaccattattttccagttggggctactcattatattgatatcatccaaggaagtgtagtatatccaacgaaacttagtgttctttttttttttggagacggagtctcactctgcctccaggctggagtgcagtggcacgatctcagctcactgtaatctccacctcccaggttcaagcctttctcctgcctcagcctcccgagtagctgggattacaggcatgtgccaccacgcccagctaatttttgtatttttagtagagacggggtttcaccatattggccaggatggtctcaatctcctgacctcggcctcccaaagtgctaggattacaggcgtgatcccccgcacctggtcaacttagtgttcttatgcttactattctcagagaggaaaatcatgctctaataataattttaggaaacacttgatttcaggagacaagattttgttgatgctttctcttctgtcctatcctcctggtgtcatgatggagattttagccctgttttattttccttgtttaaaaacgtagccgttctgagaggtagcgtgatctaacccgggtcatctaagtctgcactagaatgcagagtagcatatgaggagggggcttaacacacaaagggggctgctgcagaaaccatttaatttttcagaatgacttaaagaatttatatattttaaaaattataaaaagctgtccgggcatggtggcacacgcctgtaatctcaagcactttgggaggccaacactgcttaagttcagttgtttgagaccagcctgggcaacatagtgagaccccatctctacaaaacacacaaagattagttgggcatggtggcatgtgctggtagtcccaggtactcgggaggttcaggtgggattgcttgagactggaggttgaggctgcagtgagctatgatggtgcccctgcattccatccagcctgggtgacagagtgagaccctcaaaaaaaaaatttataaaagcttactatagtcaattgattgcatttaaagcttttgttttttttttttttttttttttttggacttcagctgatttgttacgtctgtcttgttttaaaaggaatgcagtctgcctggagcctcacctttcattacaacagaactttgtaaccaatagtgtttcaaaaccttctatctggaagactttatcagggctttggccttgaaaggaatgtcttcctactmatgtttgttaaacaagtgktgtgtgaaggagtgtaatctttctgggtttattggcaaaggagaacactccctctgtgtgttcctggtcttcagtgcattgaaacttcttttcacaggggttgtatttgtgtatatttcatatatacatataaatccttttacagggaatgaaaaagactcgagtagatgcaaaaaaaattggtcctcttaaactggctgccctaaatggactctccctatctcgagtgcctctgcctgatgaaggaaaggaagtggctaccagagcaacgaatgatgaaagggtatgtatgggacacacagggctttgtgccttctctggaacaaccggtaaatactacgcaaatgccttcatgagattttggtgaattttctaacacaatttaataataaatgagtgttaaggaattttgtaatatgggcctcaaaattggggcaaatgtatagctaatgtcttaatagataatttcaggttcgaatgctgattttttgtttgtttgtttctcagtgttcttttttaccttctcctggccttttggagcagtcttgattttgatggccttaaagtgagaagaaatctacaaaaatacaggagcatacaggggaaaagcagcagacattgacttttattatactgaaagtttatctcgagagtagtttctcaatttttcaaaacttcctttgtgcctgaggtgtattttctatgaggttttattacatcaaaatcagataggcatacatttgctttacaacgggatcctggaggtagtttcgaatatttcctactgctttagtcttttatatatcgtatgacataaaatggaaacatttgttcatagctgttggaactcattatccrtcccctagatttacttactgttccccaggagaattccatctattaggggtcacaaaattgaccacagatctagagaaaatgaattcaacaaatttctttaggccaattttcaactttaaacaaaagtttgcattatatttctcaccaaaatgattgtcttttgttcttttaactcttgttgttgtggctttttaaaattttaacttcattttcacctagaattttgtttctgttttggttttggtttggtttttttgagataggttctcayggttcactgcagcctcaacctcctgggctcaagcaatcctcctgcctcatcctcccaagtagatgggaccacaggcatgcacyaccacacctggctcgttttttaattttttgcagagacggggtctcactgtgtttctcaggctggtcctgaactcctaggctcaagtgatcctccctccttggcctcccaaagtgcagggattacaggcatgagacaccgtgcccaacctagaattttcaatattatacagtgctagatttgaagcagaaaacaagatttcaaatatacagtcaaaaggtagccacgacgtgtggctgtattcatgttattacacatattctgttttatagtgtaaaattctggaacaacgattagaacaaggaatggtattcmcagaatatgaaagaattcttaaraamcggctagttgatggggagtgctcaacagcacgactccctgaaaatgcagaaagaaatcgattccaagatgttcttccttatgatgatgygagagtggagttggtcccaactaaagaaaacaacactggttacatcaaygcatcacatattaaggtgagaggaacgcctcaagtaatcaacagcacatgcagtttcagttaagttacaagaatggtaagaattgtattcatgtctgtttagaattcagatattttaaaatttatttttattgtattgttttagataaacaccctagttttaaacatttgtgacaaactgtactgcaagctgggaaatccacayaccagtgctagataaaaagygtctatcagacagagccaaagtcatgtctactctccatgtgcgaaaccactctgcccccaacactgttaccaggactcagggcgcacttatttgcccggcttttttttttttcttttgccttttttgagatagagtcttgctctgtcgcccagacwggtggagtgcagtggtatgatcatggctccctacagccttgaccttstgttgcctggctttagaactttgtccttctaaatctgaagacctctttttagctcataaattctgggagccactgaattgctagtttttcctcatcacatactgacatgcatttttatgtaacaaaagtgtctgggctttttgatggtgttcacaaaagctttcaacttaccaaggtgccatctgttctctttacatactctttataataatttttaagtatcatttttttctttgaagaagtgcttttttcctggaaccagtataatgccattaaactggggtaatgtttatggtgagagatagggggtccagttttacttttctgcttatggatatccagtcttcccagtcccatgtatttaagaggctgtccttccctagtgtatgttcttggcaccttatctggggtaatatcactcctatgaaaatggacaaaatgatgattcacaacacatgatggaataaagccagatgttccctcttcctcattgtaccctttgttcatgctggccacattcaattctttattttgggaaggagaaatctcatggtgagtgaatgagtaactgtggacaggtggtggtttttttctttagtttgcaagtattatttgagaagggaacaagctgacaccaaggctttctggagactggcagtctgcctgtgaatgccagtaccccttgatggcttttgggaatctatgcacatactattttgtttttaaatataatatcagcataatttacttaaaaaccgagcatttccttgaaataactcatccagtctctcatgactagatggataagaatgaatgatactgtagttctgtagtgatatttcaaaatcttcagcagccacttgcagaatagaggaaagaatttgatagacctgggtctgacgcctagatctaaaatgaggtgggacctcactttataagctgtgttgtgggacctcatctcacttacatggaaataaataaatgatgacacctaccctgccagcttctcactagtcccctcctcctccctagtgtttattcactgttataacctggtactcatccacagtggcagccactgggtgctcagtgagacgatgtggagcggtgactagggggctggcagccctgagtgagagtgcgtgtggcacaaggcttggcactgggttttacgtttagtgagtgtttggagacagttattgtcgtcactcaatattggtgaagccaagatttaacccaggtctcttaaccacaaatctagtaattactgttgtattagactgctctcaaggaagttaaatctgaagtggaaacttaatattattgtggagagtgaccttgactcagaagttcagaggtgagactatcttaagtaggaaggttttttttaaagaagaggcaccatgtctgcaataacagctacttattgagttatgtgccaggtaccatagatactgactcagtcctcacaatgaccctatgacggtaggcagtatctttattgtataaatgagaactgacattcagcaaggttaaacaggttgcatagatattatgtatattcacagtacctaagtttataaaaatgtcagtaatgcaaattgtattcacaagggaaaagatgaaaagtctttccttattctgctgaataatccagtttactacttttttactttttacttttttaaaaaaacttttttagtactaccatgaatgcatgcatacatacctatgtatattatacccacacatcaatttttttaaccttttctaatcccaggtctctgtcagtggaatcgaatgggattatattgccacacagggaccattacagaatacctgtcaagatttttggcagatggtatgggaacagggaattgcaattatagcaatggtgacagcagaagaggtaggtacttayttctcttaagtgattttctcagcctctgaagaacagttaatgttaatcatctggaatcctgacctgtggagaaaaaggcagggtagggttgtggttctgtttcagatgtgccgtctatgtgagaaaggcatccattgccggatctcgagtcatttaaccatgctcatctttaacaggagggtggaagggagaagagctttaggtactggccacgacttggttccaggcacaacactgtcacctatggaaggtttaagatcacgacccggttccgcacagactctggctgctatgccaccacaggcctgaagatgaagcacctccttacygggcaagagaggaccgtctggcacctccaatacacagactggcctgaacatggctgtccagaagacctcaagggatttttatgtgagtgactttaactttgttccgaggacagctgcctctggaggtgttaaacagagaggaacatttatgtttccgaaatatttcctttatgttatctcatataagcttcggacttgttttaacataaagaatacaagtgttttggggagggttaacgaggtttataaattatgatttggtagtgagtagaaygccacagctgactcagtatctccgtcatttcattttgtagatcagaaagtggacagaggtagtgacttgctcagggtcacactgtccctttgtggttgggtttggttcactggcacccagtgctctttatctgcagtcctcttaatcagtggagagaatatgaagattgagtcaacaatgtgatacgccttgatccttgagtacttttctatttcattgattttccacagcatatcttgaagagatccagtctgttcgacgccatacaaatagcacaagtgatccccaaarccccaaccctccgttgttggtccactgcagtgctggggtaggaaggactggcgtggtgattttgtcggagatcatgatygcctgcctggaacacaatgaggtgatggcgcttatgatcacctggcctttttgggtggaaatraggctggggaagagarggacatagtgacttaatagctctttttgcgcacatttccttggactgtggtggcctcaagatgttactaatgttccctgcaaaaggctgtgtcttcttggagagtctcagtaccaattagcatattaaagactaagaagtcatacgataaataaagctgtttaattttgttttacttgcccagggtttttcaaatttgagctcagaattctttttctgtttacatttcaaggatgattcatgctgcccagagcccttgagggaaatagctagatactgatagcacttagcacactatgtttttgtataattttggtatttagtgagacatggtaattatgtccaaycatacaaagtcagtgagctacacctggggaatgttgaagaaatagtctgcatggacattctatttatagctaaaactaatcagaaaatcagaagtaggcaatcatggcttatttctagaagacgctaaggtggaaaagagactgtccatctccyaaccaggtttctgccaggacactcgtgtcctcccatcctttctgtctcccyaggggaacacattatcttcattaccgtttctctcaacctaggtgctggacatcccgagagtgctggacatgctgaggcaacagagaatgatgctggtgcagactctctgccagtacacatttgtgtacagagtcctcatccagttcctgaaaagctccaggctcatctaagctcccacaatttcttacggggccagtcatgtgaagcgwttacagcttaaaaaaaaagcgcttgcctaactcatactttccygttgacacttgatccacgcagcgtggcactgggacgtaagtggcgcagtctgaatggcggcacgctgaaggaaacgtgcgaagcacaggctgaagaggggtttctaacctgggaaaggtgctcaaggaggacttggtttcaagggccttgccctgccccggtctgtccggtttgcagtacttgcacacattttggagattgtattttctagacaattctctattttactgaagctatgctgggcaattctggcaatcattaaagtgcatagatttctatcttaaactaatttttgataatggagtttttattttatgacaaatatttagggatttttctagtgagaaacaactttgtgtaaggatgatccacagatatgagttgctcctatataactttgtatttaaaaatcatgttattatcttttgttattttttaaaaaccttgggtacttaataatggtttagttgccaaactgaaaactatactgagaatctgtgttattttgaaacatcaaaaggatttttctatccagaacattttttatcctaaaaattctatatagttgtaccttctgtttttcaaatgagagctcaattcatttagatactgaaatgagtcagttaatgtaaagttgaggatgaaggcacattatttaaaatgtaagagaataagcattattttttcagtattattcatagatctaaatgaatttgattttattggttgaaaatgaagtgaaaaacaattgcctagggtggttttaagcacttttttgttaaaaacaaatctgagttttaatatatgtgttgctttgtagatgacacaataacaatgggcgctgagaagcgttttgggagagattaaggactaagagtatgtaagatgactaggacaagagtaggtggagtgtgatggtaaatgcaggatgccttcgtctttacaaaaatgcagtattatctatactcagactgaggtgctgggatggcgagcaggggaccccacagcactgtccccagggaattcaagtcctgtgacygccagtgacttactccgtttccttggggcttttcccacctcaacctgtattgtttctttttcataaataaattcagcattatagtatcattaaaagaagccttaaagaggcgtatttttccttttggttgaaggaagggaatagttaataatagttttcacctcttctcccaaaaagtacagtccaaatttgtgcacagagattgctgtggtattcaagaggtacttgcattttagctccttaattccctggccagtgttagctgtttagtgccccctcacccatcccatttaggcacatcccaatagacagagccaggctgagttacagggggagagtgtcatctctggccccgattaagatggccttgtcacagtgaccgctgagtaggcatggatgagtgggatatttagctgaggaaccctttcccttttccttctttttggggtctcttcttacagtgaacttccaaaatgtcaaatctagggctgtttcccaaattacactattctaggcatcattttgattcccatgtcactccttaactcacttccttgagcactacatgtatgttgtcagccacgagacaggacttcctaaatagtgtgtgcaccagcctaactctgccttacccagaaaccaaccacctaagaggaaaactcagaagatattaatgaaaactaattgaaagtacgcacacttctcatgtaggaacaaaattaaaattttacatttttattttacaaaattaaaaaattacattttgtaggaacaaaatgtaaattttgtaaatacaaaattctttttaaagtcctgtttaaagaacagtagaactaagtgaaaatattcagaacgagctccttagaagaaaggaataagaactttttactggaactattttccatctctagaaaaagtgcttcttcccctccccctccctctccatggtacgtttttgtgaaaatgcttttctgtcaggtttaaacaaacagtttgacatagctcgttgacaagaacatattgtaaaacaaatctaattaaagagtaatatgtggtctatttgtgttcctgttgtaataatttgataagtaaacttctgagggcaaaattactgtttaatattactcttaaaatgttgcatgtttggcgtcattcctaagagccatgtaattttaaacttttaattgcagttagtgaatatgaaaggatttctgaataaaaatctatccacattactgagctttgaaatagtatcattttcaagagcaaactagaacattaagggttcataggtttactgcctctgaaatgagtatattaatgtctgccaaacttacacaatgcttcatgtatcttagtgtcttttaataagaattatcaaaatgtgcacttccacaaaacgtagagttataaaccactgttttccactgatcaattttggtatctctggtatcagttttcctgattagtggggtcttttgatgaaatagtttagcttagttggtagttttgagcacagaaagtactcattttattttttatttttgagacrgagtcttgctctattgcccaggctacagtgcagtggcatgatctcggctcactgcaacctctgcctcctgggttcgagtgattctcctgcctcagcctcctgagtagctgggattacaggcatgcaccactatgcccggctaatttttgtatttttagtggagacggggtttcaccatgttggccaggctggtctccaactcctgacctcaagtgatctgtctgcctcggcctcccaaagtgctgggattacaggcgtgagccactgtgtccagccagaaagtcctcattttagaatatcatttggaatgcttattgtagtcattaatttcttctggaacatctactgtgaagcattcagaaaatgctagaacttagactttaaaaccctttggtcgaattagaagctgggcctgtgcttccttagaaacgtccagaaagcaatgtctagccagaaacaggaggaggagggaggagagtgtggtgttgtgggactgagtggcgacagcatgacgtggccagcttttctgtgaagctttcaccatcagtcatttcagaagggttgagatgttaaatgttcacaatattaagaaaatttaaatatacaactatgtacagtaatataaactggagattagctgcagcttgccaagagcaggtttattatttgagatttgcataaagaaatggaaacaggaaattattgtaaataagactttttttttcttttttgagacggagtttcgttctgtcacccaggctggagtgcagtggcacgatctcggcttactgaaacctccaccttctgggttcaagcaattctcctgccttggcctcccaagtagctgggattacagatgtgcgccattacgcccggctaatttttaatttttagtagagatggggtttcaccatgttggccaggctggtctcgaactcctgacctcaggggatctgccagcatcggcctcccaaagtgctgggattacaggcatgagctaccatgcctgactgtaagtcagactttttaaaggaactcttttggatagaaatgtagttgaatttgcttatcagcaagatttcatgtggaacaagctaaaactatccctttccagtttaaacttaattttttaaaaaaagaatctaaattgcagggtgctttcttttgagctgagggatggacatttcaaaagtagaggaatagctgcattagaaatttgcctgggaaaacatttctcaaaagaatatgagcttttcaaattcctggaaataagaactccatttaccctactatctaaaattatttatagaaaaatgaggaaggccggtcgtggtggctcacccctgtaaatcccagcactttgggaggccgaggcgggtggatcacgatgtcaggagtatgagaccagcctggccaacatggtgaaaccccgtctctactaaaaatacaaaacttagctgggcatggtggcacgtgtccagctactcagggaggctgaggcaggagaattgcttgaacccaggaggcagaggttgcagtgagccgagatctcgcctctgcactccagcttgggtgacagagcaagactctgtctcaaaaaaaaacaaaacaaaaacagaaaaataaggaaatgtcaggaaattcagatcaaagtttgcatgtctacttgggtagagagagttttagaaaacatttgaagtccttggattgttaaagtggtggcatagttttctgggtatttcaggtagttcccaaataaaaaatatgctctaaaagttcacttgtatgttgacttttagtaatatttacccatgcaaacaatactcttggtgttagccttcttagtttgtgccctcaaagcttactgaaaccataggggccctgaaaggtaagcagtggtacagaaccaaaccgtatctgtatgtgttctgtactccaagaaattatagggcaacttttctccctactgcaccctgctggtgagatcagagaataaatactcctgtcgggcagtggcaaccaagactcagaaagcaactgaagttaagtgtctgttttatgggaaacttttcagaacgtatgccagcgtttgttgcagaaacttgagctgtgcatgggtaaggaacagaatgggccttataatgtgagcagggatcttgctaatgaaactgtctgaagtggggcagggggtgaaggagggcaaattggcaaaactgtcccctacctttcctgttgccacttatatgtcctccttaatattactggcttgaaatgggaagtaagggatggcccaagaaggaaggtgaaggtcttcagcacccagctgaaggagcagcagttccaaggcaaatgctattatatagagggtatccctaggtcacatacaagtaaaattaaggtctgtctgcacatcatatttccaaaaatgttgacattacccatgtgtattctaaaaaatacttaattttcaaaaatctaaagaacatctaaacaccttccaacattttatgggttactaaagggatagtaaccatatacttttgagttatgctttaatattataaatagggacaaacrgatgacaagaaaggaatcattgtgtttgaacttctgtagaacttcagaaatagtatggcttgcgtactgttccaaatttctgaaaattacttattaactagataaatgttttgatcattattccttaactttcattaaatgactttgtggtgtgtcaaataaacgcactttaaaatctgtaaaatcccttggctctgaatcgacaatgtggtgtagctgcactggatatagcagtacacaagcgacataatttcagtgttaatagacctacaattttaactgaactggtaggtggtttttaaagtgtgtacaaagactactacttaatttcagttgtcaaatgtgaaaccactgacatttaagtgtgcgtgtgtaacttaaattcacactctaaaaacttggtaaaacaaacatcttcagtattcactcttaaaaacagatgtccattgccaaagaaattcagaaggttggatgattacctgggttagacaggatatgagtctgtcaggcctcaatttttttagtaggttgatgagactagtacagattcaataactagttttcatttctgtctgctcatcagctgagaaaaactgaacaaatgaacagggaatataaacgtattcatttttcataagatacagatattacaggtcagactgtgaccatatgctgagacggtccaaatttttttatcctggaagtttattagaaatcacttgaaattaatggaccattgaatgagacaaatattttgttacttacagtgattaatatttattgaaatgtaatttaatcttagagttaagtgtccygaaaggattttggtaaggttttgtagttttactgaaataataccagtgcaacactggttcagaccaacaaacaggttgaaaaaactgaatattctccagagacaacaagtttatttctagaacaggtttaataaaaacaagataatacagaatacttaaacccctgtaagtcaaacaaaaaggtaaaggaaaaaatgtaagaaaaacatactgtttgcggttccaagatagccaaataggaacagctccagtctacagctcccagcrcgagtgacgcagaagacaggtgatttctgcatttccaactgaggtaccgggttcatctcacggggcttgtcggacagtgggggcaggacagtgggtgcagcccaccgagcgtaagccaaagcagggtgaggcatcgcctcasccgggaagtgcaaggggtcagggaattccctttcctagccaagggaagtggtaacagatggcacctggaaaatcaggtaattcccacccaaatactgagcttttccaatggtcttagcaaacggcacaccaggagattatatcccacacctggctcggagggtcccacgcccacagatactcactcactgctagcacagcggtcygagatctatctgcaagatggcagcgaggctgggggaggggcatccaccattgctgaggcttgagtaggtaaacaaagcagccaggaagctcgaactgggtggagcccaccacagctcaaggaggcctgcctgcctctgtagactccacctctgggggcaggtcatagccgaacaaaaggcagcagaaacctctgcagacttaaatgtccctgtctgacagctttgaagtgaatagtggttctcccagaaaggagtttgagatctgagaacggacagactgccccctcaagtgggtccctgacccccgagtagcctaactgggaggcacctcccagtaggggcagactgacacctcacatggccaggtgcccctctgagatgaagcttccagaggaacgatcaggcagcaacatttgctgttcagcaatatgtgctgttctgcagcctctgctgctgatacccaggcaaacagggtctggagtggacctccagcaagctccaacagacctgcagctgagggtcctgactgttagaaggaaaactaacaaacagaaaggacatccacatcaaaaccccatctgtacgtcaccatcatcaaagagcagagatagataaaaccacaaagatggggaaaaaagagagcagaaaagctgaaaattctaaaaatcagagcgcctctccccctccaaaggaacgcagctccttaccagcaacggaacaaagctggatggagaatgactttgacaagttgagagaagaaggcttcagacgatcaaacttctctgagctaaaggaggaagtttgaacccactgcaaagaagctaaaaaccttgaaaaaagattagatgaatggcgaactagaataaacagtgtagagaagtccttaaatgacctgatggagctgaaaaacatggcaagagaactacgtgatgaatgcacaagcttcagtagccgattcgatcaactggaagaaagsgtatcagtgattgaagatcaaatgaatgaaatgaagcaagaagagaagtttagagaaaaaagagtaaaaggaaatgaacaaagcctccaagaaatatgggactatgtgaaaagaccaaatttatgtctgattggtgtacctgaaagtgatggggagaatggaaccaagttggaaaacactctgcaggatattatccaggagaacttccccaacctagcaaggcaggccaacattcagattcaggaaatacagagaatgccataaagataatcctcgagaagagcaactccaagacacataattgtcagattcaccaaagttgaaatgaaggaaaaaatgttaagggcagccagagagaaaggtcgggttacccacaaagggaagaccatcagactaacggcgaatctcagcagaaactctacaagccagaagagagtgggggccaatattcaacattcttaaacgaattttcaacccagaatttcatatccagccaaattaagcttcataagtgaaggagaaataaaatcctttacagacaagcaaatgctgagagattttgtcaccaccaggcctgctctacaagagctcctgaaagaagcagtaaacatggaaaggaacgactggtaccagccactgcaaaaacatgccaaaatgtaaagaccatcaatgctaggaagaaactgcatcaactaatgag

SEQ ID NO: 13256 - DNA, 55826 bp, Homo sapiens
ctaaattttgtatttttagtggagatggggtttcaccttgagcatgcctacattaaagcaccattacatcatactggaagtattactttatatactactgaactatcagcttttgagggggcagaggaatcttactctttttttttttttttgagacgggagtcttgctctgtcgcccagactggagtgcagtggcacgatctcagctcactgcaacctccgcctcccgggggttcacgccattctcctgcctcagcctcccaagtaggtgggactacaggcgcctgccaccacacccggctaatttttttgtatttttagtagagatggggtttcaccgtgttagccaggatggtctcgatctcctgacctcgtgatcggcctgccttggcctcccaaagtgctgggattacaagcgtgagccactgcgctcgacctttttgtttttgtttttgttttttttttttgagatgtaattttgctctgtcacctagactgaagtgcaatggcgctatctcggctcactgcaacctctgcctcccaggttgaagtgattctcctgcctcaacctcccgagtagctgggattacaggcacatgccaccacacccagctaattttgtatttttagtagagacgggtttttgccatgttggctagtctggtcttgaactcctgacctcaggtsatctgcctgccttggcctcccaaagtgctaggagttgagctgccatgcccggccaacacaagatttcaatgaagaagattacagaaaaggtgagtagcctaagatgacatagaaagtgtactggaagtgcatctatgtggtctattctgtctccatgaactctttcctgattagctcagtaacttctctctctcctactgaattattggtaattttttgtgccagtcaatcaaaaagacttcatgcattaattcattgctctatagcaacccttgacctaaagagtaagattcctgcactttgggaggccgaggcaggccgatcacgaggtcaggagatcgagaccatcctggctaacatggtgaaaccctgtctctactaaaaatacaaraaaattagccgggcatggtggagggcgcctgtagtcccagctacttgggaggctgaggcaggagaatggcgtgaaccctggatgcggaggttgcagtgagctgagatcacgccactgcactccagcctgggcgagagagtgagactctgtctcaaaaaaaaaaaaaaaagaagagtaagattcctctgcccctcaaaagctgatagttcagtagtatataaagtaatacttccagtatgatgtaatggtgctgtaatgtaggcatgctcaaggtgtagcggtggcacaaaatacttttccttagtgaactttccagaagtaaaaggaagaagctagtatgactagagtctggagtgactggggcagagagaatttggggagaacagaacaggacaggtggttggtccagatcacagagcttttcaggccagcaataggatggcaataggaagtcactgaaggattttttttttttttttttttttttgaggcagagtctcactctgttgcccaggctggagtgcactgttgcgatctcatctcactgcaacctctgccgcccaggttcaagcaattctgcctcagcttcccaagtagctgggattacaggtgcccaccacaacacccggctaatttttgtatttttagtagagatggggtttcaccatgttggataggctggtcttgaactcctgacctcaggtgatccacccgcctcggcctcccaaagtactgggattacaggcatgagccattgcacccggccatcactgaaggattttgaagtcagagttgtgtaatcatttaagaatccctgccaatgtaagtcccctgaagrtgggactgtttgtgtttttcatggttatagtcccagggcctgatatgcagttattcttgttaaacaaaagaaaatcttgtgagatttgcatttttggaagatcactgacagcaccatgaattagacatattgagactggaatcagaagaccaattcaaagatccytggactagagtacacaagataccaagagggcttgaactaagtagtagcaatgaagacaagggcaagagagagttaggagtggatttatagcatttgaggactgattggaataaggggtgacgtggagaagttgtgggaagagaataaaaaatgattcccagatacttggtgctatgatctgaatgtttgtatctttccaaaattcatttgttgaaatgtagtctccagtgtgttggtttaacagatggggcctttgggagatgattagatcataaggccaagccttgtgactgrgattagtgcccttatgcagagaggaagcttgtttgccccttttccccttccaccatgtgaggacaaaaaaatgcaccatctatgaggaatgggccctcaccagacactaaatccgttagagccttgatcttggacttcctagcctgtaaatttattacagatctgtaataaacttctgtttataaattactctaagatatcttgttaaagcgccccaaaaagactaagaccttcgacttcattaattcatttgaaagacatcaactacaatttaaaaaaacaaaacaaaaacagaaaaggtggtttgcaatttttttcacttcatgagactataatttatttccctgggtaggccacacaaatccttaagaacatggactttcccccatacaaggctgtgaaccgtgcacacagagatgctcgataaatggtaccgaatcctctccttcagcacctggtcctctctggcagtctccattctcttacctctcactgccccctctacttctctgaacctgcagtccccaaagtcaccaatggtctccatagcaacaaaatttagtgggctcttatacgwccttatattgcttgacttcttggcagcaactgacactgactaccccttgaagcatcccctgcccmggccttccacaatgtcacactctcttgcttctcctccctcctccttggttattgcttctcctatcctcacggctcagctctagccctcttctcaatcacttccttttccctaaaatgattttattcactcctatggtttcagttacttttttttttttttttttttgagacacagtttcactctgttgtccaggctggagtgcaatagcacgatcttggctcactgcaacctctacctcccggttcaagtgattctcctgcctcagcctcctgagtagctgggattataggcatgagccaccacgcccggctaatttttgtatttttgtagagatgaggtttcaccatgttggccagcctggtcttgaactcctggcctcaagagatctgcctgcctcagcctcccaaagtgctgggattacaggcatgcaccaccacaatggccttagctatctgttttttaatgacaattcctcattgagttcaaagcagcctcctgaacttcagactcggtatccaaccattactcaacataattactcaaatgtccatagatatttcaaattcagtatctccaaaatgtaaactctatcttattctcttcccaaaaccttgctgctcctcccatgtttctgctctcaataccactcctgccacagtggctgcccaggtcacaaacccagaagtcaccttcacatttctgtctcctaccttccccaatccctcattgtggtaggagttattaagaaattattttaggcagatagagaggaaaaggggtccttgaaaagtttttgtctcttttgaagcagctcctgagacgtttcctgtctagcataaaagccctgacttttagacccgagctggcaacgtttgatatgcaaatgccggcagttagaaactgggtccaccaacacggtgattcccaccatcgtcctcttgcccttgttctcacaagtgcctggcaacatggccacccccacatatccccacatgagtagaacatcatagcgccctgcatttgcatattaaaaggctagggtggaatggccagttttattagggggctacatgaatgacatgcgtggtcaaaccagtcccctgagccctatgcaaatcagacaccgcctcctgcatcctcctcctataactggctggtatctcccacgcactctgggtctcctctctcagctttggagcacccatccctctgtctctgtacaggggagctgcttctttctttcttctcccttccttcttgcttattaaactctccgctccttaaaaccactccacgtttgtccatgtcgttttatgtaattygactcaagacgaaaaaggctagtattcctccactcggtatcatcaccacattctgttgagtctctttacgtccaaagaatctctcaaaatgggctatttccatctttaagacactctcttaaaccaccatcgtctctcccaagattccttcaacagcaactgcttttttctgcagccagtgatctttctaaaaggcaaacatgaccacatgtcttcttttaaaatatttatatagctccccacatcctttaaaaggtacactttggccaggtgcggtggctcacgcctgtaattccaggactttgggaggccaaggcaggtggatcacctgaggctgggggttcgagaccagcctggccaacatggtacaacctcttctctactaagaatacaaaaatagttggacttcgtggtgcacgcctgtaatcccagctgtttgggaggctgaggcaagagaatcacttgaacccaggaagcagaagttgcagtgagcggggagattgtgccactgcactccagcctgggggacagagagagggccgtctcaaaaaaaaaaaaaaaaaaagtacaccttaatctggtttcaaggtgcaagatctgcacctatccttccatttaagtttcatsaaaccgctgctacctccccgtctcccacacaatttatgggacttctaagttccctctaaagggtccgaacacctacactggtaacaagccacctggatttgaatcctggcaagacaacttactatctgaccttggacattgtgctgttcttaacctctccgtgcctcggtttcctcatgtgtatgaataacatcaacacctacatcaaagtttgctgtattaaatttgataatatatgcaaagcatttagaaaagtgcctagctcatagaaagccttatgtaaatattaactatcattttttttcttttttggggtggtgggggaggggtttcgcttttgttgcccaggctggcgtgcaatggcacgatctcggctcaccacaacctcggcctcccgggttcaagcgattctcctgcctcagcctcccgagtacctgggattacaggcatgcaccaccacgcccgggtaattttgtatttttagtggagacggggtttctccatgttggtcaggctgatctcaaactcccgacctcaggtgatccgcccgcctcggcctcccaaarkgctgggattacaagcgtgaagcacctcgcccggcctagctatcatttttatacaagtgctrggttttgggagaatgtaatgatggcttttttcttactaaactttcagtgcaggaggaggagaaagaaagtaaatagttatatgaacacagtagaaagtcaaagtggaaaacaaaaagaacatagaacccaggtgagcggtccagacctccccccagaaacctaagaatccatagaaatgggtgggaagcggagaagatcctccagacagcaggtggcgatgtagcatcccccagaaggcccgctaacagaagctaggaggacgcgctaccaaggtcacgtgtccccggcgttcactcgctcttcgcttcacgacactcgcatcctcacgggtgattggtctgcgtgcggcacgtgggcggggtaccggggcgggccggggaggggcggggtgggcggaggagaggggcagggggcggagctggagggggtggttcggygtgggggccgttggctccagacaaataaacatggagtccatcttccacgagaaagtgagtgtccgcgttcggtggggagctgtctgccgcgcggtggcgggcgtggagcgcggcatcaccgcctctcggagggctgggtggggcccgagtcgcccccatgccgatctcgcccggcgaggggcgacgccgcagcctcccgcctcctcggctcgaggaggggagcatcacctacgcccctacttcccccgcggcccccgccctgggagccgggagggagtatgggcggggccgggggcgtctcgggacacgggagtggggtggcgcccagtgggtttgcttctgcctttctccgtcactttccatcgcttttcggaggattccttcacccctccccaatccttccctctccctagggtctagctagagtcatctctgggacacctccctcaacccctcctaccctaatcctggcagaattaacttttcctcctccggactgctcaattctatattggagtcttccctacacgtagatctttggggtcttgttcgtgtctttcccctgcactaggtccgcgagcctcccgagggaggagaccttggctcgcccactgtagggcctgacatttaggaagtgaagtaggaaacccggcgtgcccctaaacagggaagtcgtcacaagagtttttattacgggatgtttgggtttggtttcttttggtactcccatctttccggagcaggcggccagctttgtttttaggtattaggagtggactgggatgattttgttgtagtctgcctagcctgctgtccctttaactcttccgtgaccatgcacttgaagatactgtttgtgatatgtraagaaactcctcgtttctctcatactattatccagccatttgtgtgtgagtgaagccttccccaggacagctttggcacatrgtatcatgtttcataatagtttcgtgtttggaaagagttgctggtaaggctgttatttaataggaggagcaaagggtttttgttttattaaatacttataaatgatcatttatcccagacatttaaaattcacacacacacaacaaataaagcaaagacaaaagaatacatttaccaaatgtaaatctgtagcataaattttttttaatttttattttaaagatggggtctcattctgtcacccaggcaggtgtgcaatggagagatcatggctcactgcagccttgatctcctaggcacaagcgatcctcccgcctctgcctccagagtagctgggactacaggtgcatatcgccagggccaggtaatgtttttgggagagacggggtctcgctgtgttgcccaggctggtctcgaactcctggactcaggtgattctcccacctcrgcctctcgaagtgctgtgattacaggcgtgagccactgtgcctggaacaaattgttaagtacaatgcttttcattgtagaaaacatctcggaaacttttgaaataggctgatgttcagtgggggaggaaggactcagtcgtatagttgtcactaattttttgacttgattgacatgactcgtaaatcatagacaatagagatttggttgcttggctgagtagagtgcgtgaaaaatacacacgtactttttttttttttttttgagatggagtttggctcttgtcacccaggctggagtgcaatggcgccatcatggctcactgcaacctccgcctccccgttcaagcgattctcctgcctcagtctccccagtagctgagattacaggcgcccgccaccacgcccagctaatttttgtatttttagtagagacagggtttcaccatgttggccaggctggtctccaactcctgacaggtggtccgcccgcctcggcctcccaaagtgctgggattacaggcgtgagccaccgcacccggccatatttttgttattaattttcaaaggctttggtgtgggaccacatttcaacatggaaggccttaaacatgttccacactacttcctgagaattagacaagatttttaacaatattgttacctagttgggacacatttgtactgacccatgggatgaaaaaaagctgagtgctagcctagtgaaaatctacttacccgaaagaaatccctcttagtctgggtgcagtggctcacaccagtgctttgggaggcccagacgggcggatcatgaggtcagtagtttgagaccagcctggccaacatggtgaaaccccgtctctactaaaaatacaaaaaattagccaggtgtggtggcaggcgcctgtaatcccaggtactctggaggctgaggcaggagaattgcttgaacccgagaggcagaggttgcagtgagccgagaccgtgccactgcacttcagcctgggcaacagagcgagactccgtctcaaaaaaaagaaaaggaaaaaagagtccctcttaattatcagcatgtgtataggcctacagatacttcaggaatacctttaccattatcatcaacttgtatctacatagcatgtgaagattcaacaatttagttttttgggcgtcctcaagagtacgcacctataaccatatggcccaattgttaatctcctatacagtccattctgggaatgtttgggcttactgtgccatttttccgttcactgccttcccctctgcaatatacctttaacccttgctaggtcctgggtttggagagccagagaaccaactttggccctaaagaagctgtgtaggtagcaatatctgcctacgaagggccttgcaaccatttcctcttggaaccttggtttcctctttctgagtagtcactttgagtaccctttattaagttagaatgtaaaaacagtttctcactgatatatctgcagtgcctgagagagggcctggcacagagtaagtactcaataaatatttgaatggggccgggcgtggtgagacctgtctctacaagaatgaacaaaattagctgggcgtgttagcacatgcctgtagacttgggaggctgaggtgggaggattgcatgagtctgggaggtcgaggctgtagtgagccatgatcgcaccactgcactccagcctaggggacagagcaagatcctgtctcaaaagaaaaaaatgtatatatttgaatggataaagagatggctttgagtttctgagatatatatggtgctgtttatctaaagtaaacaagttttctgtaaatattttaaggctttgcaggccagctgtagtctctgtcacacattcttatttgtgcatgtttttcccaaccatgtaaaaatgtaaagtgcattcttagctactggggcaggttgaatttggcccatgggctagagtttgccaacccctaacttaaacctttgtactaactttatgaccactactggatttttgttgttgtttgttttagttctggtgcctgctttgtttttttttttttttttaatcctcttgctgatgtttcttggtgcagttactgtgccatttgtattggtgcttttaatgtaatgcaaactggtaataatatctaaacttgctggggttgtacataaaattattgaaaagattgaaaagatgctgagcattgactctgtggcattcattatgcccttttgtgattgctggattttagccatctttaggacatttgagctttaggagaagccaaattctgtataaatgacttgaagtgctaatagcacaggttttgaaacctctgcctgggtttgagtctcagctctgccttttactacctgtgtgatcctgagcaagttacttagtatccctgtcctctagtttcctcctctgtagtgtggggataataacatagacataacctgagagttagagtgtagagaaggctccctggcagatagtgctgtagaagtactggccattgccattactcaggtgcttgtgtttgctgaacctcatagtaagggctcggagagcactaagaggaggtgagaaatgctgctagattgacagcttgtccccagatagcccattcccgagagcaccttaggtttatacctgatttgtgttgtagttagtagtgtctctggtaatttgaactagtttcaggttggtcttgaaaacctggggaggttgggggtaaatgatttggtagcagttctcttttgtgattttatacattatctttgtagaactgcagtttgctaattctctgagcccaacacaatgaagtctgggcctaaaatcatagaatttcttttatttttttttttgtttttaatttatttattccctccctccctcctttcttcctttcttccttttctttctttctttccttccttccttccttctttcttttctttctttcttttctttctttggagtctcactctgtcaccaggctggagtgcagtggcacgaactttcttcagagtctcactttgtcaccaggctggagtgcagtggcgcgaactcagctcactgcaacctccgtctcctgagttcaagagattctcctgcctcagcctcccgagtagctgggactataggcatgtgccaccatgcccagctaattttcttatttttagtagagacgaggtttcaccatgttggccaggatggtcttgatctcttgacctcgtgatccacctgcctcagcctcccaaagtgcggggattacaggcgtgagctaccacgcccagcctattttttattttttgaggcagagtctcactctgtcacccaggctggagtgcagtggtgcaatctcagctcactgcaacctccgcctcctgggttcaggtgattctcctgccttagcctcctgagcacctgggactacaggcgcctgccaccacacctggctaattcttatatttttagtagaggcggggtttcaccatgttggccaggctggtctcgaactcctgatctcaagtgatcaacctgccttggcctcccaaagtgctggaattacagccatgagccaccatgcccagccaaatcatgagatttcaataccgctgaactttgattatggcaaagtgaactyctgctttgattaaagcttgatgagagaggtggctggggatagtttgagataagggcaaggcaggaaaatgcataatcttacgtgggctcattgtcattgtacaattcttttggtccatgtggaatttgatccgtcctatgacttaagttatgtttatttttgtttttatttttatttattttgtgtctttttgagagacatgatgttgctctgtcacctgggccagaatacagtggcacaatcttagctccgtgtagccttgaactcctgggctcaagtgatcctcccacctcagcccctcaaacagttgagattatagtatgaaccactgtgcctagccttaagtgatttttaaatttgtactgaacagtttgtccttyccttccattaaatcatattagaagtacagaacttgatatttcctgtagcartacagtttttctttgatgaagtttgatttcaagtacttatttttcataatttaaagctattttttatagagagaattttaatcaaatatttggatgtcactattgctatatatggtattaagtatggtgaccatagtytgtaaactccaaactgacagcaagacaggaaatttgtgttagcaaaggcttttttcttactgtttgaattttttaaaaattagatacaatacagagaggagcacacaaatcattaagagtacagctcagcgaattttcacacagtgaacatgtgtaaacagcaagtaacaaaagatttacctgcatcctataacctcccattattcccttttctaggtactgtctctccactgcattcccaccaaatataaccactatgctgaattctgacatcataaatgagttttgcctgattttgagcttttgtgactggaagygtacagtgtatataccctttcgattctgtcctctttagtttaccattgtttgagaaatttatccatactgttccagaattaactactgttaattattgttaattaactactgttgtagttaattcatcctcattgttatctagtattcttttgtgagtaaacacaatttccattctactrtgatcccagctatccatttgggtcgtttccagtttggggtccattasaaatagtaatgctatctgtaatgctattttgtattactacaaatagtaatgctatttgtggcacaaaaatactgcttttgtgaacattcttatacatgtcttttgatgaatgtatgtttgcattgctgttgtttacattatgtacctagtaatggaattgctagatcataggagatgtatatattaagctttagtggatgcattacataattattagttattattggttataccaatttatcctctcatcagtagtatacaacagtttctgtatctctaatctccaacattttagccattttagagtttgtgtactaacacattgtggttttaatttacatttccctgatgactaataaagttgagtacctcttttgtgttctttatagccatttgactgtcttgtgaagtgcttgtttgtcttgcctatttttcttttctttctttctttttcttccttccttcctttctttctttcttctttctttccttccttcttttctttctttctgtctttctttcttgtctttcttgtctttctgtctttcttggtcttgccctgtcacccatgctggagtgcagtggtgcagtctcagcttactgtagcctcgacctttttggggctcaagttatcctcctttctcagcctcccaagaagctggactacaagcacgcaccaccatgctcagttaattttttattttttgtagaaatggggtttcaccatgttgtccaggctggtctcaaacttctgggctcaagtaatcctcctgccttggcctcccaaaatgctgggattacaggcatgagccaccgcagccagccttggctatttttcaaaaggatataagtagaacatctgtatatcccttcaatttgcatattattcagtaagagttgcactctggtagtagaaatatataaggaggagaaagaagtggaaacaaaaagtctattctcatgagaagacttgggggatagtgttctctctagctccaagctacttattccttacgaaaagttgaagataaacttatctcagactgaggctgtctcaatgttgtcttcctattccattatacacatataacccatatttttttcaccagctgaattttgctcctagaaaattgattcatcaggaaaaatatccgtcttgcaaggtggttctctttagagtctgctgtgtgacatagctcaggacaaattgtgtgatgtcagataggttgggttaaggaatagaccttattggggaaagagagaacttggagggccaaggttagcaggagaaggaaatgttctctcatctgccrtcaattcagggaggggcaaacctggtgtctgtgttcacagggagggatccatccatctgtgattctcccttcttatcaggtagcatgggaaagctacactgttgcggggaggagggtcacacgcaggctacttagtaccaggcaccctggacttggattcaggttgccagttgtgtgagaaactgcccagcacctgaaggccctgaacccatgagaagttgtacctacctcccatgaggaggaatcctgtcatcccatgggagctgagcttgggtgcagtccctcttgctggcttgtccaggagtgagctccagggttgtttgggacagttctgctcattgctttacactgtgtatacattatctgtagagttccatgaagagaacttcagcactgtaactgcaagttttaacatggaacagaatttttctcacctgtattaattcttaagatttgaagttctatcaacaagcatttagattgtgtggagatttttttatttttatttttggagacagagtcttgctctgttacccagactggagtggcagtggcatggtcttggctcactgcaggctctacttcctgggttcaagcgattctcatgcctcagtgtcctgattagctaggactacaggtacacaccaccatgctggctaatttttgtatttttagtagagacgaggtttcaccgtattggtcaggctggtctcgaactcccagcctcaagcagtccacccacctcggcctcccaaactgctgggattacaggtgtgagccaccatgcttgactgacatcatcatgttaaaagaataaatgttctagggagctgggcacagtgtcatgtttctgtagttctagctgctcgggaggctgaggcaggaagatcccttgagccctggagttcaagtccagcctgggcaacatagtgagatctctttttttaaataaataaataactgttctagggactaaaatttcctttcaccattagtaatttactgtagaatctccaagaatgaacttattttaggtactgaaaatgagggagactaaatgttttatacagtagtttttagtaaaatatgagatttgatgcatttgatagatgatgtttgtttaaaataattcttaaatttttgatcatgtaattatagtttcattaatggtagatttgtaaaataaatgttaccaaatgaaaatgcatgtacctatgttaattatccttatctaaagctgaaagttcagttcaactatgttaaaacatagtaggggcctggcagggtggctcttgcctgtaatcccagaacttagggaggccaaggtgggcagatcaygaggtcaggagatcgagaccatcctggctaacattgtgaaaccgtatcgctactaaaaatacaaaaaattagccgggcatggcggtgggcacctgtagtcgcagctacttggtaggctgaggcaggagaatggcgtgaactcaggaggcagagcttacagtgagccgagatcatgccactgcactccaggctgggtgacagagcaagactccatctcaaaaaaaaaaaaaaagttggccaggtgtggcggctcacacctgtaatcccagcacttttggaggccgaggcaggcggatcacaagatcaggagtttgagaccagcctggctaacagagtgaaaccctgtatatactaaaaatacaaaaattagccaggcatggtggtgcatgcctgtagtcccagctacttgagaggctgaggcaggagaatcacttgaacccgggaggcggaggttgtggtaagctgagattgctccactgcactccagcctggacaacagagcaagactctgtctcaaaaaaaaaaaaaattaatgattaaattatttaggggagccgggcgcagtggctcaygcctgtaatcccagcactttgggaggccaaggcgggcggatcacgaggtcaggagatcaagaccatcctggctaacacaggatgaaaccccgtctctactaaaaatacaaaaatttagccgggcgtggtggcgggtgcctgtagtaccagctactcgggaggctgaggcaggagaatggcatgaacccgggtggcggagcttgcagtgagccaagatagcgccactgcactccggcctgggtgaaagagtgagactcygtctcaaaaaaaaaaaaaaaattatttaggggaagatactatacaattctgtttaacaagtcacattttaattttttcttttggaaatattagcaagaaggctcactttgtgctcaacattgcctgaataacttattgcaaggagaatattttagccctgtggaattatcctcaattgcacatcagctggatgaggaggagaggatgagaatggcagaaggaggagttactagtgaagattatcgcacgtttttacaggtactgattttaaactcactaagtcacatttcwtttttttttttttttttgagacggagtctcgccctgttgcccatgctggagtgcaatggcgcratctcggctcactgcaacctctgcctcccgggttcaagcgattctcctgcctcagcctcccaagtagctgggattacaggcacacggcactatgccyggctaattttttgtatctttgttagagatggggtttcaccatgttggtcaggttggtctcaaactcctgaccttatgatccacctgtcttggcctcccaaagtgctgggattataggtgtgagccaccacacccggcttacatttcttttaaaaatgtggataccatttagaaaaggatgggccattcttcctatagggatctgactggtgaattataactgtgctgttaactttggaaatgggaatgcacaagatrttgttttaaatatgcacgctaatgacagtttgtatccttctttccccacccccacccttgcttcaactacctgtcaaaattaacagcagccttctggaaatatggatgacagtggttttttctctattcaggtaagtagtcacaagcatgtactatgtgttgcttacatcccaggcaccgtttcacagcctttcaatagtcactgtaacaaggcgaccttcggaagttcttctgtctacagagtatagattatactctagagtactagattttttttttcttgagacagagtctcgttctgtcacctaggctggagtgcagtggcgtgatcttggctcactgtagcctctgcctcccgggttcaagcgatcctcctgcctcagcctcccaagtagctgggattacaggcacccgccaccacaccagttaatatttgtatttttagtagagatagtggggtttcaccgtgttggccagtctggtctccaactcctgacctcagcctcccaaagtgctgggattacaggtgtgagccactgcacctggccaactagagtactagatttttatatagataaacatgaaaggattgtagaatcttcatattagagtggggcatttaaaaattccttcttgagaaagattaatttgcatctggatgctaataataaccttaattctggcygggcgcggtggctcacacctgtaatcccagcactttgggaggccgaggtgggcrgatcacgaggtcaggagattgagaccatcctggctaacatggtgaaaccccgtctctactaaaaatacaaaaattagctggacgtggtgacacgtgcctgtaatcccagctactcrggaggctgaggcaggagaatcgcttgaaccagggagtcgtaggttgcagtgagccaagatcgcgccactgcactctagcctggtgacagagcgagactccatytcaaagaaaaaaagaaatccttaattctaataagtcacaatgtctcaaacttaccatctgttgggtaaatttgagaaaatgcaataccttgctaccatccttttaaatcagcctaccagactggatttccttattatggtttgtggcttttgattttttttttttaatgtatagctctctttgaattctttggtgkttatatatatatgtactygcaagattcttttatctgtgggtctttcattctttttctaacactgtgagttgtatccagagtactttcggaacctctcctgagcgacctatctctgcagatatctttgtttatgtttcccttgtactgccctcctggactcttcctcatccaccagcatttccatctagtgctttaccgtgccactgctaacaggtaatggctactgcagggctgaaatcagaggccagagtaggcccagcacttggcgtttcctatttgtgccttgctgctcttggtgcctgttcatgtgtgcccactaccttgcactcaatttctgtctttgctggtacctggctcacttgcttctttgttggctaccttggagggcagatagtgaattttcagaaatttccctttttttgtcagacagattgaaataaacaggtttgcattttgttttttctacaagyggcaagcccatgaccctagaagtctgacatctatggaaccttcagtttaaatgcccagggagaacttattttggtagayatgatttctgacattgcaggtagcaagttgaatataatttttctaaagtagcacccacagcagccaaattatcagatgtatatagtagactagttttaagaaaagcacttatgggtagaatatacatctggatttttgaggcagttttatttaggaattgtgtggttttctggaacatctcagagacctggtatgaaaagcactcttctaatatatatgtgtttttttttatggatttagtgatatatctatacacacacactttttaaaacctatagccggctgggcgtggtggctcatgcctgtaatcccagtactttgggaggccsaggcgggyggatcacaaggtcaggagattgagaccagcctggccaacaaggtgaaaccctgtctctactaaaaatacaaaaatagctgggtgtggtggcgtgtgcttgtaatcccagctactcgggagcctcaggaggagaatcgcttgaacctgggaggcrgaggttgcagcgagccgagatcgtgccactatactccagcctgggcgacagagcaagactcygtcacaaaaaaaaaaaaaaaaacctatagccttctagagaaatttatatatgaagtacacaactaacatagctacacttcctaaatttggaatggagtggtttarcttatgaaaagttgctatttttcttaacaggttataagcaatgccttgaaagtttggggtttagaactaatcctgttcaacagtccagagtatcagaggctcaggatcgatcctatgtaagattctgttttgcatttcatacatttcttttcccaaatttgatttttaaagttgtaatttcttaaagaagagaaatayattttgaatacttttgttttgatgttccctgtttcattcactcagactttcctatttcacctttgtgatgtccatgagcrtctgccctgtagccttcctggcaccccagtgtctgtggcagcacagagctgaccccataagtggtrcatgaggccatcttgtggcacagcatcactaagctgctgcagagacgttcatatggttgtgtgatcttttaaaaacrtcagtgacacttaactrtaaatataatcttaaattatcacaaattttatataatatttgccagtagacaacataaatatgaattcaatatttcaagttaatattgtstgttttcttttttagaaatgaaagatcatttatatgcaattataaggaacactggtttacagttagaaaattaggaaaacaggtaacatttcttacccttccttgtctttttttcttatattgtaccccatttaaaactaaaatgtgggccaggtgtggtggctcatgccaacagtttgggaggctgaggtggggggatcacttgaagccaggagtttgagaccagcctgggcaacaaagggaggtcctgtctcttaaaaaaaaaataaaaataaaaataaaaataaataaaaaaaaaaacaaagagccaggcatggtggctcacatctgtaattccagcttacttggaaggctgagtcagaaggatcacttgagctcaggagtttgaggctgcagtgaactatgattttgtcactgtaccccagcctgggtgacagagtaagactgttctataaaacataaaaataaaaaaaatatatttaaaaattaaaaaaaaaaaaggattgctgactttaaaattaggaaactgaccagtaatgtgtgtgtgtgtagcatggtttatccttcttgatagatagaaattgtcattttaaaagataatatcagttttccttataaatttatttgtgacaagtatatgcaatttaactatatcataagaaaaattctatattaaagataatacaaatgtggttacttttaagtgggtttttatgtgatgactatgttctgtcagttaattattacatttatagatttgtatttagcatagtgctgtcacaaagcctgaaatagtgtcaagcatgaataaagcattcaattatgtttgctttagtgtaagattattcattatgattccaaaagccatgtaatacgtacgtctacagaaaatcacttctattttttaaataaaacatgaaatatgtcttgagcaagctattttaagaaacaatcatttaacgtccttgttattagaattttgaatctttgaaagagggttattgaaaaccagctaggacagtaaaaaagaataaactagtgatacatgcagcaatatggatgaatctcaaaataattatgctgaaagaataacccacaaacaaaatactacctgctgtatggtatcatttattaaaagtctagaaaagtgcagattcatctgtagtgatggaaagcagattgaccagcggttgcctggkgacgagaaggctatggaggagtgagaggggagggttacagagaggcacgggaaacatggcaatgaggaatgtgttcactatcttggttgtagtaatggtttcatgggagtacagtatacaaatgtgaaaacatttcagaggccagatgcagtggctcatgcctgtaatcccagcacttttggaggccaaggcaggaggattgcttgagctcaaggagttcaggaccagcctgggcaatggcacaagaccccatctctaaaaaaaaaatgaaaraaaaaaaaattggctaggcgtggtgatgcatggcygtagtcccaggtgctagggaggctgaggagggagcmcagaggtcaagcctgcagtgaatcatgatcgtgctactgcactccagcttgggtgacagaaggagatcctgtctcaaaaaaaaagtttcaaattatacactttaaatatgtgcagtttattatatgtcacttataccccaataaatctgttttttttwaaatgtaaatacaagccaaaaaaggtataagtcaagaaaatatattgaattaaatctgtaagagataattcaaaaacaaaaaccctattgttatcttttaagtcacccaaatcaaatttgggaaaagtcacctacttagcttcatcctaagttggttctttctttctttctttccttcttttgagacggattcttgctctatcgcccaggctggattgcagtggcgggatcttggctccctgcaacctccgccacctgggttcaagcaattctcytgtctcagcctcccaaatagctgtgtctacagccacgcaccaccacacccagctaatttttgtatttttagtagagacggggtttcrccatgttggtcaggctggtcttgaactcctgacctcaggtgatccgtccgtctctgcctctcaaagtgctggggttacaggcgtgagccaccatgccgagccctaagttggttctttcttaaagttcttcctgaggagccaagagcaagttaaggagatgtaacctagaarcttacagtggaggctagctgggtgcagtggttcacgcctgtaatcccagcactttaggaggctgaggcagggagatcactgaggccaggagcttgagagcagcttggcccaacacagtgacaccttgtctctacaaaaaaaaaaaaaaaaaaaggcagcttacagcagtagaggctgatgcgagtgggaatcacctctaggtaaaaaccagtgtagcgtactgctgagattatttaacctctgggttttatttatgtgtttttaaaaattatgatccagtattttttacttttttttgtataaagtaagcactgaatttttaaggttgtattaatttgcaaataaatgtctatcttattattttgagagatttaaaaaattttagttcttcaaaattgcattttcrcattttgaattacgttatctttgacaaatacagaagatgtcaaattttggtttattttctttggttctaatttatatttttgtttaaaactatatttttcactatagactctttctgtctctcgaggtccctgtataatgaaaaagaaggctggaaaaagtattaacattgtcaaaatccaggaaaagtagttggtcatgatattgatcgttaactttagaaactttttgtatcttgtgggttaaattaggattactatgtggtagtgataaatgatgttaattagggccgagtgcagtggctaacacctgtaattccagcatgtagggaggctgaggtgggaggatgtcttgaatccaggagtttgagaccagcctgtacaacatagtgtaagaccccttctccacacaaaaaaattagaaaattygtcaagcatcttggtgcacacctgtagtcccagctgcttgggaggatgaagygagagaatcacttaagcccaggtrttcgaggctgcagtgagctatgattgcaccactgcactccagactagatgaccatctcttttaaaaaaatgtgtttatatgttatatgtgatagtgctttttaaaaacatttttaaattatagagacagggtctcactatgttrcagcccaggctggtctcaaattcctgggctcaagcaatcctcccaccttagctaacctcccaaagtgctcggattataggcatgagctgcatgcccagctaatttagtgatttttaaaaactgagctggtaattataaattctcttcctggaacttctgactttctcacaattggaatcttttgacaaaaattatcagtaatgggaaaactttgtgtagttgtcatttttcctcccatcagtgtgatagatatgattggagttatgttggactgatattttgaaaaaagatttaattatagctattaataaagacatttaaactactgactatgcatttttattcttttgggagggtttaatgtttatagtttaaagcaaactgttgtttttaaaaaagtatctaacagggcygggcgcggtggctcacacctgtaatcccagcactttgggaggcctaggcgggcggatcacaaggtcaagagatcaagaccatcctggctaacatggtgaaaccctgtctctactaaaaatacaaaaaaatagctgggtgtggcggcgtgcgcctgtagtcccagctactcgggaggctgaggcaggaggatggcatgaacccgggaggcggagcttgcagtgagccgagatcgcgccactgcactccagcctgggcgacagagcaatactctgtctaaaaaaaaaaaaaaaaaaaaaaaaagagtatttarcagagrccaggtgcagtggctcatgtttgtaatcccagaactttgggaggctgaggcgggcggatcatttgaggtcaggagtttgagaccagcctggccaatgtggcaaatgtgctgtctctaactaaaaatacaaaaattagctgggtgtgrtggtgcagacctgtagtcccagctacttgggaggctgaggcaggagaatcrcttgaacctgggaggcagaggttgcagtgatccgagatcatgccactgcactccagcctgggttacagagtgagactcttctcaaaaaaaaaaaaaagtatttaatagtgataaatctgcagtattctcttgtagtttttaagatcatattattcagtcaaagaaaagagctcaacttgaaatatttccagagtttaaacaatcttactaagctttgatgggttgtatctattcttaacatgtgaaacttccttattacctatratatacactaacttaaatattgacaatttttttccagtggtttaacttgaattctctcttgacgggtccagaattaatatcagatacatatcttgcacttttcttggctcaattacaacaggaaggtaagtaacggctgaacattttgtaatgttacctttcgaagtagttaaataaccaggcacattagatgacagtgtgataaaactgtttttctggcagtggcagtgaaacaatctttagttttgacgtggtgataggctgtgatttgggtgacgctgttcagttagagttctcactgacacctggcccttcctcttctgaggatgctgctttctttgcagcccttctaagtaatggctttttcttttatacatcacatatcacacggctgagaggagggatagatgtttttcttctttgcctcttcyaggccactgttcttccttataaactccagtttctttgaaatacatgyccctaacggctgggcacggtggctcacgcctgtaatcccagcactttgggaggctgaggcaggcggatcacgatgtcaggagatcgagaccatcctggctaacacggtgaaatcctgtctctactaaaaataacaaaaaattagccggggtgtggtggcggacgcctgtagtccsagctactcgggaggctgaggcaggagaatggcgtgaacccaggaggcggagcttgcagtgagctgagatcgcgccactgccctccagcctgggcgacagagcgagactccrtctcaaaaaaaaaaagaaaagaaaaaaaaaagaaatacatgcccctagattaaactatcccttgtccttttgcactcatccacaagtctcttttcatcagtgattttaggatctgactcgttgtctttttctctacytcarctacttttatcattcttaattatttctgtatcgtcaatcaatccagtacctgcctcttagtttcaaaatcacttactcttgcttagctattaccagtaatcataaccactgtcaaatctcaattgcaagcatattactctttaactaccacctcctatctttaaaccatgttttgtctgtttttttattccagccattctttaaaccctactgtggrgcccaagcatttcctttatacgcattcttcctttcttctactgcttattttctgtaatccgtcatcataatcactccattgcattcttcaacgtgtttcccctctctccctccatcatacttgaatgacaaaaatctcaaccctggttaaaccamatcttggccttgtccattcctgtaccagagtagctggacgtggctaaaaaataacataaaacatgatgattggttttacttttttcttaaatgatctatccatccattcacccatccatctatcaaagtgactaggcctatttctgaagcccaggctggagtgcagcagcataatcacagctcattgcagctccaaactcctgggctcaagtgatyctcttgccttagcctgttgagtagctgggactacaggcttgtgctaccacacctagctaaggttttactttaaatttattataatcacaaaattcagatgagcctttagtgctgtctgatayttctactatgttttcttagtgatgtaccaccctccaaggtgtttataaaaaattatgtacyactctccaagawgtttataaaaaataatgtgccaccctccaaggtgactaatttcacagcytatgtctttaaacctttaagcactttcctctcccttacacaccttccttrtggctttccgttacattctgctgagaacatagaagcaattaaaattatgttctttctaccagcaaatttatcaatttgcttatatcttcacctgtgctttgagcctatttaaatagatgaatggtcccctacctctaaccaaaaccagtccctcacttgtgggctggatcccagctcttctcayctactcaagatgttcctgctttcatctctccactctcttatataatcagttccccccccctttttttgtaatattcctataagcagtaaaataagctttttatttccattgattaaaaataaaaatcctctcttaattccatgaaactccagctgcctccccatttttattttttccttaggattgtctctagtgtgccttctccttttcttgaactctgcctcctgggttcaagcgattctcctgcctcaacctcccgagtagctgggattacaggcgtgcaccaccatgaccggctaattttttttttttttttttgagatggagtttccctcttgttgctycggctggagtgcaatggcgtgatctcggctcaccgtaacttctgcctccygggttcaagcgattttcttgcctcagcctcccgagtagctggatttacaggcatgtgccaccaygcctggctaattttgtattttagtagagatggaaggggtttctccatgtttgttaggctggtctccaactcctgacctcaggtgagccgcccacctcggccccctaaagtgctgggattacaggcatgagccactgcgcctggccccggctaaattttttttttttttttttgtatttttagtagagacagggtttcaccatattggccaggttggtctcgaattcctggcctcgagtgatccacctgcctcagcctcccaaagtgctgggattacaggcgtgagtcaccttgcctagccatcttttagtaatggtatttggagatcacaatttgagtgctggcatgcttattgctgctgggtttgttatgtagttattgtgaattcacatttaggaatatagggtttttaattctttgattttagatacttgtatcttttttcttttatatttaaaaccttggttcctgatgatatcccttcttagaaaccctgtctacctttggycttcagcccaccatgctgtggttttcctaacttgctgcctgcacttttcagattcctttcatggatcttaaatatcatctgtaaataagatctatgtgtcaataattaccaaacttttatctttagtcttgacatctaccctgaacacctagctttgactaactcctagctttggcatctccacttggaartccaaaaagygtttcaaactgaacatgtctatgaaagacttatttttttctctctatccatgctatccatcaggttttccatttccataagggtgactcttgtactctggttcctatatattataccgacagagcagcccagagtgcttcttaaccagtgtaaggcctgttatgtcccaccctcactctttgtccttcagtggcttcccagcacacttagaataaaatctgaagtcttaggccgggcttggtggctcatgcctgcaatcccagcactttgggaggatgagggggcagatcacttgaggtcaggagttgatgagaccagcctggccaacatggtgaaaccctgtctctaccaaaaaatacaaaaattaactgggtgtggtgttgtgcacctgtagtcccagctactcgggaggctgagataggagaatcacttgaacccgggaggcagaggttacagcgagccaagatcataccactgcactccagcctgggtgacagaacgagactctcaaaaaaaaattaaaaaaaaaaaawatgtgaagtcttgaataaaacccaagatctttaccatggcccctgaacagggcagagtatccattcttcagacactcttcatagaataccatggtgagctggcatatttattatacaatacagaaacaattttactggcagaaaacacattaaaccgtctaaactctgaatacagttgtcctcataaaaaatgttcaacrtactattttgaggttttccattaatagttcttataatctttgtcccattatgtgttaatccaacaaaggatatccaataacaaacaccaaagtttaagaaaaatgtgctaggcgcggtggctcacacctgtaatcccagcactttgggaggccgaggtgggcagatcacctgaggtcaggagttmgagaccagcccagccaacatggtgaaaccctgcctctcctaaaaatacaaacattaacygggtgtggtggtgggtgcctgtaatcccagctactcaggaggctgaggcaggagaatcgcttgaacctcctgggaggcagaggttgcagtgagctaatattgcaccactgcactccagcctgggtgacagagtgagactccatctcaaattaaaaaaaaaaaaaaattaatgatagagaaacttaaatcagttagattgttttaggtatagcccatccttggtttttgtgtgtagcatctagcttggggaaaccctggatttctggaatcatatttagacacagtcacactagactaatgtaattcttttgggatgcaaaccacacgtttgacaccttaaatagcttttaggtatttggcttcccagcccctatttttagttacaaggggtgtacatgtgtgggtcagggtgggggtagctctttcyrcagatgattagttttagccatgttactagttattgcacacattatctgtgtcctcacagcagccctgtgagtaagtgtattagggttctctagagggacagaactaataaggtagatgtatatatgaagggtaatgtattaaggagtatcgactcrtatgatcacaaggtgaagtcccacaataggctctctgcaggctgaggaaccaggaagccagtccaagtcccaaaacctcaaaagtagggaagctgacagtgcagmcttcagtctgtggcaaaaggcctgagagcccctggcaaaccactggtgtaagttcaagagtccaaaagatgaagaacttggagtctgatgtttgagggcaggaagcatccagcatgggagaaagatgaaggctcagcaagtctagtacttccacactcttatttctgcctgctttattctagctgagctggcagctgattagatggtgaccacccagtttgagggtgggtctacctctcccagttcactggcttaaatgttaatctcctttggcaacacccycgcagacacacccagaaacaataatttgtagccttcaatccaatcaagttgataatattaaccatcacaggaaggtactagtatcatatgtttaacagtagaaaccaagacaaatgcagctaggaagtgggagaactgggatcagatgcaggcagtctgattctaaatcagttgctgttacccactctgacaacagtaagtgagtagcctgctcagtcaagtactrtattagtagggccctttacagacatatttatttctcacagtcactcaatgagacggctcttccagtcttacaatggagaaagtgaggctcagagactttaagtaacttaccttagacgactttactagtaagtataagaatcattatttggactaaagtctttctgaatcctcagcttgtatttttttccagtgttctgtgctgcctttttatctactagtgttttacatcaattttgaatctctttactaactgkttaggttgatttttgccttttttttttaggttattctatatttgtcgttaagggtgatctgccagattgcgaagctgaccaactcctgcagatgattagggtccaacagatgcatcgaccaaaacttattggagaagaattagcacaactaaaagagcaaaggtaaaaatgaggcctgcagtatggaatatatggtagtatttcattatgagaattaaattttcatgcttagattgaatatgtggtccttgtgttgttggcgactctattttggaccttatattttagtgaagtttattagtttaaacttgaatcaactctttgaaatacttaaatatattaacttagttagctggtatggtatattcctagcacttcgggaggctgaggcaggctgattgcttcaacccaggagttcgagaccagcctgggcaacatggcaaaacctcatctctacaaatagtacaaaaattagccagatgtggtggtgtatgcctatagtcccagctacttgggaggcagaggaagaaggatcacctgaaactggggaggtagagactacagtgagccataatcacactaccgcactccagcctggtcgagagagtcagaccctgtctcaaaaaaaaaaaaaaaaagaaacggaaaaaaaaaacttagttggattcaaattgcaacacaatcattatattactagagcttatttgccagaaaacattttaagttttgacttacktaaagcctttacattacaaatgcctttatgttatgtctaaaatagaagattggttgcagttattaccagtgcttttgttctttagagtccataaaacagacctggaacgartgttagaagcaaatgatggctcaggaatgttagacgaagatgaggaggatttgcagagggctctggcactaagtcgccaagaaattgacatggaagatgaggaagcagatctccgcagggctattcagctaagtatgcaaggtaaagacattctgatgtgtgttgtattcattgctgaagaattgattccaattattcttagatttcatggaagttaatgtactcttagaggtgttttgacaattactgcagaagcaatagctatatagtgggctttccctttagatttcttataatggaaatcactttttacaacctrtattttaytaggagtagttatatttttactcctggttattttatttggtttcaacactgtactaacacaatagtaaattgtggtkttaatctttgtgggtatcagttgacccttatccaaatcagctgttacataaatatgtgccattagacactatggaagggcctggacagggaatataaactgattttacaaaaacccaacatttattggctatgcaacttaaaccgtaagcccactttggtgggcccagttttttagtgatataaactatcaatagagaaaagcgaaaacatatcccctagacaatctaggcaaagaaaaatgttaagacatagctcaaagtagcttaattaaaagtttgaagtgggttttttgttttatttttttctaactcatatgtatttgcttctactttctaatgaaattatttatcagttgatttccttagatatctaaataaaattgaaatttcattaatgggaagattatttttatcctgaacttttcttgcctctatgcatgcctctgagtactccatrtggtgtgcaatcccatttttgattaatagagtcctgctggattagcagggacagaaatcagctttagatttctttcttttttttttttctttctttttttttttttttttttttgagtcagagtctcactgtcgcccagcctggagtgcagtgatcttggctcactgcaacccctgcctccgaggttcaarcgattctcctgcctcagcctcctgagtagctgggactacaggcgcctaccaccacgcccagctaattttttgtacttttagtagagatagggttttgcccttttggccaggctggtcttgaactcctgacctcaggtgatccacctgccttggcctcccaaagtgctgggattacatgtgtgagccaccacgcccagccagaagagtagaatattcttaaagagaaaacgttttaaaggcttactcaaatgagtataaacaaacatattgttgcttgaattggtaaatacagtgattggtttttgttstgttgtgttttgttttcaggtagttccagaaacatatctcaagatatgacacagacatcaggtacaaatcttacttcagaagagcttcggaagagacgagaagcctactttgaaaagtaaagtagttggtacaagttaaagtagcatgtttaatatttgctttggctattttgtctatttgtaaatggttactgcctgaatcctgtgaatatttgaatgtattttttaaaaatttacagcaaataggaygggcacggtggcttacgcctgtgatgctagmagtttgggaggccaaggcgggcagattgcctgaggtcaggagttcgagaccagcctgggcaacacagtgaaaccccatctctactaaaaatacaaaagaatcagctgggcatggaagcgtgcgcctgtagtcccagctgcttgggaggctgagccaggagaattgcttgaacccgggacgtggaggttgcagtgagccgagatcgcaccactgccctccagactgggtgacagagtgagactccgtctccaaaaatatatgtatatatatataaataaaaataaaaatttacggcaaataacatgaaacaaaaaaaccttgccccaatactggataaattttttaaactgagtgaaggaaaccttataaaatttcatttattaaaagaaaaatgaaattaggacaagacaagaagaatgccaattgatcctttggatgtacttcttgcttacctgattaaccctgcaaaattcctctaccaatcagtacgaaaaacagctttggaggtatgggagcgcattcccaaatagacgtggtagttcatttagctgctcatggccgcttcaggcagtcctgtaagcctgttagcatcaggggaatrgatgcaaaccataaatctggatcaactcctaaaaccttaccttgtgcccagccttgtaagtgcttgctaaataggaattccaccatatgaaaatacattcttttcaagtaactatcattcagacttttgtcccccacttttttttttwaaagaaaaataaaaggctgggcacggtggcttacgtctgtaatcccaccattttaggaggccaaggcaggtggatcacctgaggtcaggaattcaagaccagcctgaccaacatggtgaaacctcatctctactaaaaatacaaaaattagccgggcatggtggtgggtgcctgtaatcccagctacttgggaggctsagacaggagaatcgcttgaatctgggaggcagaagttgcagtgagctgagatarcgccattgcactccagcctgggggacaagagcgagacttcgtctcaaaaaaaaagagaaagaaaacttcatgttaaagattacaagataaataatcagacccactgatcctaggtcagaaaacagagtcatagctcaatctgacttactatttgctgtatttcatccattctgagatgcacatagtttcacatttcaatgtctctgaaattgagaagcatcttacagtcataattgacagtatattagcagcacctataaatattggctcattttacatttgatggtataatgaagaaaatatttacctttttttctgttttgtttttaagtcacaactcagaagtagatgaaggaaaattctgatcagctgacatcctcttaatgtgagatatttctagtctttattcagtatagattaatggctaattatatgttaaatttcaaagtagtgcttattagtgctttttacttttaagtttcaaaattaacttttttattataataaactccaaatttatacaaaagtagaaaaactagcatactcctgtttatgacccagattcaacaaatactagcacacggccaatcttgcttttttttttttttttttttgagatggagtcttgctctgttgcccaggctggagtgcaatggcacaatttctgctcactgcaayctctgcctcctgagttcaagcgattctcccacttcagcctcccaagtagctgggattacaggtacacaccaccatgcctggctaattcttgtatttttagtagacacgggatttcaccatgtcgtccaggctggccttaaactcctgacctcaagtgatccacctgcctcggcctcccagagtgctgggattacaggcatgagccactgagcccggcccaatctcgttttataatactcccatctcccattctttccactgtcccacctgcaagtttggattattttgtaacaaatctcaatcatcatattattctataaccattttaatatgtgtctctaaaatatattagctttatttttaacatagttaaatgctattgtcataaaataataatcataataattaattgtaattctatatcatcaattatctagttaatgtaaaaaataaatctaaggccaggcgcggtggctcacacctgtaatcccagcactttgggaggctgaggtgggcrgatcacctgagatcaggagttcaagaccagcctgaccaacatggagaaaccccatctctactaaaaatacaaaaaattagccaggcgtggtggcgcatgcttgtaatcccagctacttgagaggctgaggcaggagaatcrcttgaacccgggaggcgaggttgcggtgarccgagatcgtgccattgcactctagcctgggcaaaaagagtgaaactccatctcaaataaataaataaataaataaataataaaaaataacttaaatctacttaattagaaaaactaacattctaaaaattttattttaagaaatatcaaaattggctgggcacggtggctcacgcctctaatccctgcactttggaaggctgaggtgggyggatcacctgaggtcaggagggtcaggagtacaagaccagcctggccaacatggcgaaaccctgtctccactaaaaatacaaaaattagccaggcatgatgatgggcacctgtaatcccagctactcaggaggctgagacagaagaatcgcttgaacccaggaggtagaggttgcagtgagctgagatcaccccactgcactccagcctgggtgacagagtgaaactccgcctcaaaaaaaaaaaaaagagaaaagaaatatagaaattaaagcatacatggccaggcrtagtggctcatgtctgtaatcccagcactttgggaggctgaggcaggcagatcacttgaggccatgagttcaagaccaacctggccaacatggcgaaagcctgtctctactaaaaatacaaaaaaattagttgggcrtggtggtgcacacctgtaatcacagctactttggaggctgaggcaggagaatcgtttgaacccagaggtggaggttgcagtgagccgagattgtgccactgcactctatcctgggtgacagagcgagatactgtctcaaaaagraaaaaaaaaggctgggcgcggtagttcaygcctgcaatcccagcactttgggaggccgaggcaggcagattacgaagtcaggagatggagaccatcctggctaatacagtgaaaccccgtctctactaaaaaatacacaaaaattagctgggtgtggtggcaggcacctgtagtcccakctactctggaggctgaggcaggagaatggcatgaacccgggaggtggagcttgcagtgagcagagatcacaccactgcactccagtctgggcgacagagcgaggctctgtctcaaaaaaaaaaaagaaagcatactctcacctccttcagtgactgatgttagtattttggcacattctttttctgtgacatatacacacttaccttgtaagtgttgtactcatttcctatgacagtaaatagtctttgtaacaggctgcatgatatttcataaaatgaatggatgtggcataatttatatgtgagccttttgaattctgctattataattaatattgcaatgaacaattcttatattgcctctacacctcaaatgtcttatcatttcttctagtttttctgaggatgtcagattattgggttaaaggatatgaacatttttaaggccttggaacagatttctaawttgctttccagaataattcccatgtgatactttcaccatgtttatttcagacttttttttttttttttttttgagacgaaatctcactctgtcacccaggctggagtgtagtggcatgatctcggctcactgcaacctccgcctcctgagtttaagcgattmttctgcctcagcctcccaagtagctgcggttacaggcaagtgcctccatgcctggctaatttttgtgtyttttgtagacatggggtttcaccatgttgcccaggctggtttcgaactcctgagctcaggcaatctgcctacctcggcctcccaaagttctgggattacaggcgtgcaccaccgcgcccagccatcagagtcttttttgtcaaaataaaatggtctaaagacatacatcatagagaaactataatacaaaatttacaggtatatctaagaaaagaaaagtatatttaaagcataaaaataaacygctcttttacttaaaattttttaaaaactggattaaaaatatgaaacttccaacaaattgagcttttttttttttttttttcttttttgagacgrggtctcgcttttgtcacccagtctggagtgcagtggcgcgatctcggctcactgcaacctccacctccctggttcaagcaattcccctgcctcagcctcccaagtagctgggattacaggcgcatgccaccacgtcgggctaatttttttgtatttttagtagagagggggtttcaccatgttggccagactggtctcgaactcctratctcaggcaatctgccagcctgggtctcccaacatgctgggattacaggcatgagccactgcacccggcctgaactttttatagtagtaacgataattcagtaatgtccaataatgactaagtaagttataacaagtacaatgtcagcaataactagtgctttttagtaaacagggtcaggcaaccttgtacccttttaaaaatgttcgaatatcgatatacctccttcctamttggtggaggattgattgaggaggaaagtgtgcagtgatggttaccagcttcagcctcttggcttgactttgcaaatactggtgagaatttggaaagagcttgagaatatcttacatagtcacatgttgctgagaagagttaagaactaacttcttgatgttcatttttaacaatggcttgcattcaaaaccttrtagagctcattagtaggagctaagaagctaatatttgcctttcactaaaattcctgattacttagcctaggtagttcgttgtctctctaggttctgtctttgggagcttgggtctaaggttatcaagctaactctttcttccctctcacccttcccaaattgaccctggtgctgatttgttattcatacgattttctagtttttcttttccctttttgagtatttgaagcttcatactgaatatagtaatcatagtattcatgcataaagaaaatcataaagtaattgcataaatgcrtaaagtaatcatagttttcatgcattaaaaaaactagttttggctgggcgctatggctcacgcttgtaatccsagcactttcgraggccaaggcaggcgaatcatctgaggtcaggagttcgagactagcctggccaacatggcgaaacctcttctctactaaaaatacaaaaaaattagccgagtatggtggcgggcgcctgtaatcctagctatttggcaggctgaggcaggagaatcacttgaacctgggaggcagaggttgcagtgagccgaggttgtgccattgcactacagcctaggcgacaagagcragactccatctcaaaaaaaaaaaaaaaaaaaaaaaaactccctattacagattcataatttatgagtcattaaataatattttcaagccatgacattttttccagcagtagtctctaaatctgttttaccatcataaaaccccaagcaaaactctrctacatcagctgtgtcactgtaaaacctgccttaactcacakaagcatgaaattaagcaatgtgtgtgaaactattttataaactgtaaagtattccatacatacatgttggcagttattaatgtcttctctaggtgtggctttgaaatggatgcagatkctttctgttacaaaaaacataagttgcaaatgttctataacaaggagagacacaaatatcttcatggacatggattgctatgagtgtttgattgcctaatacttgagccaccacttcagtgatayggtataatttatcaaacagtgttgagaaacagaaactactggggatgttttaaagaggaaartacttaatatagaaattaggggtttacataatcttaagaaaggatgaaggtgcagctcttagccaggcctccasagtaccacaaaccaacttgcaggaagagctgtaaccactgccccagttgggacaatgggtaatgaggatattaaatttaagaacatactgctatagcaatgatccttggcatagaaagctgccaccacaattgcctagagatgggaacatgaagtctggcccccattgcaacagcagtgaagcagaattttgggackggcatctcccaaatggctttgcttgccaccagagaacaaccaaagtggagggagatggctaggcctcatttctgcctattttattttattttttgagacggagtcttgtctgtcgcccaggctggagtgcagtagtgtgatctcggctcactgcagcctccgcctcccagcttcaaacaattctcctgcctcagcctcctgagtagctgggattacaggcacccgccactgtgcccagccaattttcttatttttagtagaggtggggttttgccacgttggccaggctggtcttgaactcctgacctcaggtgatctgcccgcctcagcctcccaaagtgttgtgattacaggtatgagccaccatgcctggcccatttctsccttttttttttttttttttttttgaggtggagtctcactctgttgcccagactggagtgcagtggtgcaatcttggcgcattgcaacctctgcctcccagtttcaagcaattcttctgcttcagcctcctgagtagctgggactacaggtgtgtagcaccacacctggctaatttttgtttttgttttgttttttttgagacagagtctcactctgtcacccaggctggagtgtagtggcatgatctgggctcactacaacctccgcctcccgggttcaagcaattctcctgcctcagcctccagagtagctgggattacaggtgtgcgccaacacacctggctaatttttttgtatttttaatagagatggggtttcaccatgttggccaggctggtctcgaactcctgacctcgtgatccgcccgcctcggcctcccaaagtgctgggattacaggcatgagccaccgtgcccagacaaggtttgtatttttagtagagacagttttgccatgttggccaggctggtcttgaactcctcacctcaggtgatccgcctgccttggcctcccaaagtgctgggattacaggcrcaagccactgtgcctgacccgtttctgctttttaaagctcatgtgagcacttaatttgtaaccagaatcctacttgtaaaataatctaagacatgtagcttttagctttgtaacctctataatattgatggcacagtgggagtggatgctgagtaccacttgaacatgttccayctcagtgtcttcacagctggaaggtgtctacattgtttcaaggtggacaattgatttacttctcatttttcataaactaaaagtagaataaaggctattcctctaaaattgctatctcacctgtcactcccttgcattctcacataccttcttgagtggaggggmagagggcatggagtgatagcrgatgtgccaggaattctccataactcagtccgtccctcttgtgctatgttgcagcatcaggatttgctaatgggaggatactgcccttacgtgcatcattagccatgcacactaaggtcttacacctacacacargtcagtattctggctcagagaccarcagggagaaattgcagttctcattagttgaactttctttattgttcacagttttaaaacacaaaattgagaggaactctataaaaaatgtgccattctattaataattgttgctggtaatttaaaaatccttgttccttttcaaattcttatataccttttttttttaaacacttgatcttagccaaaagaccgagaagcaatctttttttttttttttttttttttaacctatagcttctcactgagattgtcagctgtttgtaagttttggtttttggttttctgtgtttgtatttacatatatgaaatayagattgagtatcccttatccaaaatgcttaagactggaagtgttttagatttggggttttttaggatttgtgaatatttgcactatacttaccagttaagcattccaaatccaaaatttcaaatctgaagtgttccactgagcacctcttttgagtatcatgttggtgctcaaaaagtttctgattttggagcatttggatttctgattctcggatttaggatgcttgacctgtaatttcagatttacataaaagcagaaatagtacacagagctccttatatccttcacccagattccccaattattggcctttctgaaccatttgggaataatatgcagatatgattttccattatgtctcagttgttcagtgtatattttctaagtacaagaatatattcctacatatttacatgataacygtcatgtttaaacattttaaaatggggatttgtattacattgtttctctttttgaaaaaattacagaggagcttaatgcaatcagtattacttaaaatctgataatgtgtgttaaatagtagtyttcatttatttcatttatcaggtgttcagtgaatgcttactatgtaacagcacagttatcagcactggggaaatagatgagtaagataagatttgcactttcattagcttacatgccataaagagggaaataaagagaacaccagatgatgataagtttatgctgagaattaaaatgaagtgatgaaataatgggaatgtcaggtggctacttttggtgggatggtcaggaaaggcatctctggggagataaattttaagctcagacctgagtgaaaagaatgagccagccatggaaacattatgttaactcacatggtagtttgaaatgctttatctgatcaaaggtacttatttttggtgactttcaacaatattaagggtctataaaccaacactcatttgcataagaataactaccagtgaatctttttgtatgataggttttttgtttgttgtttttttgagacagagtctcgctctgtcgcccaggctggagtgcagtggcgcgatcttggctcactgcaacctctacctccccggttcaagtgattctcctgcctcagcctcccaaagtagctgggattacaggtgcctgccaccacgcctggctaatttttrtatttttagtagagatggggtttcaccgtgttgtccaggctsgtgtcaaactyctgacctcaagccatccacccgcctcggcctcccaaagtgctgggattacaggtgtgagccaccactcctggccatgataggttattttgtgatgaaaatacctacctcttaatttgtctgataaatttaaattttatgtctagatttcctaagatcagcacttccatattttaaagtaatctgtatcagactaactgctcttgcattcttttaataccagtgactactttgattcgtgaaacaatgtattttccttatgaatagtttttctcatggtgtatttattcttttaagttttgttttttaaatatacttcacttttgaatgtttcagacagcagcarmagcagcarcagcagcagcagcagcagcagcagsgggacctatcaggacagagttcacatccatgtgaaaggccagccaccagttcaggagcacttgggagtgatctaggtaaggcctgctcaccattcatcatgttcgctaccttcacactttatctgacatamgagctccatgtgatttttgctttacattattcttcattccctctttaatcatattaagamtcttaagtaaatttgtaatctactaaatttccctggattaaggagcagttaccaaaaraaaaaaaaaaaaaaaagctagatgtggtggctcacatctgtaatcccagcactttgggaaaccaaggcaggagaggattgctagaacatttaatgaatactttaacataataatttaaacttcacagtaatttgtacagtctccaraaattccttagacatcatgratatttttctttttttgagatgragtcttgctctgtcacccaggctggagtgcagtgtcgcgatctcggctcactgcaagctctgcttcctgggttcatggcattctcctgcctcagcctcctgagtagctgggactacaggygcccgccacatcgcctggctaattttttrtatttttagtagagacagggtttcaccatgttagccaggatggtctcaatctcctgacctcatgatccgccckcctcggcctcccaaagtgctgggattacaggcgtgagccatcacgtccggccagaaatcatgaatattagtaggtgaaaaataaacacattttaccacctggaaaatgaaaaatacttgagtataatctaaataacaatgggaagtgcagagttactttccaggtctcggtttaaatatgtcttaaactttggccaattagtagtagaagttgagagaaaaagtaactatctgacaaagaaattataagcagaatatataaagaactcttaaaactgaataatcagaaaacaactcaataaaaaggtgaaggatttgaaaagatatttcaccaaataagacatagggatgacaaataagcacatgaaaagactctcagcatcactagtcacagggaaatgcacgataaaaccacagtgagacaccatggcacccctgtaggtatggctttaatgaagaaataaaactgacaataccaagtgttggcaaggatccaagcagctgagactcatatactgttaatgggaatgtaaaagtgtacagctttggaaaacagtttggcatttttttgataaatgtatacttagccatgtgatccagcagtcccaatcatgtatatataaccaaaagaaaagaaaacttaggttcacataaaaacttatatcaaatgcttatagctgaccaggcatggtggcccatgcctataatcccagcactttgggaggccgaggttggcagatacctgaagtcaagtgttcgagaccagcctggccaacatggcaaaaccctgtctctacttaaaatacaaaaattagccaggcgtgatggcaggcacctgtagtccagctattcaggaggctgaggcaggagaatcacgtgaacccgggaggcagaggttgcagtgagccgagatcgtgccactatactccagcctgggtgacagagcaaaactctgtctcaaaaaaaaaaaaaaaaaaaagggctggacacggtggcttacgcctgttatcccggcactttgggaggccaaggcygatggatcacctgaggtcaggagttcaagaccagcctggccaacatggtgaaaccccatctctactaaaaatacaaaaatttgctgggcatggtggtgggcacctgtaatcccaggaggctgaggcaggagaatcacttgaaccygggaggcggagattgcagtgagccaagattgtgccattgaactccagcctgggtgacaagaccaaaactccwtctcaaaaaaaaaaaagattatagcatctttattcatcattgcccaaaattacaaactgcctaaatgtagaccttcatttagttaatgaatgcacaaactgtggtatatccaaacaattgaataaaaaaaggaatgaactggtacttttttctattcctcctgtttaagtacagccaaaacacctcaacatttgtataaaacatgagctgggctgggtgcggtggctcacacgtgtaatcccagcactttgggaggctgaggcgggtggatcacctaaggttgggagttcaagaccggtctgaccaacatggagaaaccctgtctcaactaaaaatacaagattagtcgggcatggtggcgcatgcctgtaatcccagcttcttgggaggctgaggcaggagaattgcttgatcccgggaagcgaaggttgcagtragctgagattgcaccattgcactccagcctgggcaacaagagcaaaactctgtctcaaaaagaaaaaaaaaaccattcagctgaatctcaaargcagagagaagacagactggctagggaccttggaaccagaggagcagtgtggtggggagtggactggattttctttttgcctcatttatcctggacttggtgctggagaagctatgggttcagaccaagagaaaaccccatgaaaagcctgctctctctagccaaaagaggcarcctagcaagataaaaacctttagataataagcacttgactccagtcaaacaaaacagaataaactggccccattcacccctgtcagcaaaggccaagtgggagccaagatatgtaccccaacctggaagtcataaggtacacttctcccctttcccagccaaggtggtgttagagaaggctgactggggagctgggattctcattccctccaggaggtgataacactcctttcacatggtgtcagtggtcacagggaggctgaacttccacccagtaatacataggcatctctctggctcctatatgggtgatgttggagaagaggccgagtagagaatccagactgttgctgacacccagcagtaacaaggacacctccacaatgtccgtggrggccaygtggagatcagtaacaaggcactgctctccctcccagtcagagagatgtcagtggaggactagggggctagaactcccatgtgcgttcagcagtaatccccatgaccgccactccttgacatcacaggccttgaagaaacctggactttcactcccctctggttgtagcgaggtggcactcccttttccytgytgccagtgctgtgtcagtggaggcttgctaaatyggaagatgtaaataagattcacattctcataacataataccccaaattttcaggatttaattgaaaatcactaagctgggcatggtggctcacacctgtaatcccagcactttgggaggccaaggtgggccaaacacttaaggtcaggaattcaagaccagcctggccagcatggtgaaaccctgtctctactaaaaatacaaaaattagctgggcgtggtggcacatgcctgtaatcccagctactgggaaggctaaggcaggaaaatcacyggaacctgggagacggaggttgcagtgatccaagatcgcactagtgtactgcagcctgggcaacagagcaagactccatctaaatttgtgtcaggattcccagaaggagatgagaaagggtggggctgaaaaaaattgaggaagaagtcatggctgaaaatttcccaaatttggcaaaagtcagaaacctacagattgaaaaagctgaatgaagctcaaatatgataaactcaaagaagttcacacagagacacatcacagtcagatttctgaacactgcagacaaaaaatgaagatctcgaaattagcaagaaatgaccttacctaagcaatttgaatgacagcagatttcccatcagagatcataaaggccagaaggaaggggtacatacaacattttttctagtgctgaaagacaaaaactctaggctgggcacggtggcacacacctgtaatcccagcacttttggaggytgaggcaggcagatcacctgaagtcaggagttcgagaccagcctggccaacatggggaaaccctgtctctactaaaaatacaaaaattagccaggtgtggtggcrcgcacctataatcctagctacttgggaggctgaggcaggggaatcgcttgaacctgggaggcgacggttgcagtgagccaaggtcgcgccactgcactccagcctgggcagttgagcgagactccatctcaaaaaaaaaaaaattatccaggcttggtggtgggcgcctatagtcccagctacttgggaggctgaggcaagagaattggttgaacccaggaggtggaggttgcagtgagccaagctcatgccactgtactccagcctgggtgacagagcgagaccttgtctcaaawwaaaaaaaaaaaaaaaaamcaagaaaaaaactctaaacccagagttacatatccagtgaaatatccttcaggagtgaagggaaaattaacgatttgtcttcaggagacctaccctaaaagaatggctaaaggaatttctctaaacagaaaagaaatgataaaagaagtaattttggaacatcaggaaggaagaaagaacaataaaaagagtaaaatatgggtaaacacaatagactttcccctccttttgaattttctaaattgtatgatggttgaagcaagaattatagcactgatttggttttcagtatatatattggaaatatttaaggcattatgttacagatgaaggagggtcaaaggatataaagggaggtaacctttctatatttcttttgtactgatgcaggcactttggaaaataatttcactatttgtttaaaaactgaacataccctgaccatatgacatagcatctatactcctgggcatttatcccagagaaacagaaatttatttattttttttttagtattacactccgtaagtgctgtaatactagcacttagggaggctgaggcaagcagattgcttgagcccaggagttcaagaccagcctgggcaatgctgcacagtcaaaaaagaaaaacaaacatttagaaaactattttaaaagtctttaattgctgaatgcctctttggctaatatttggaagatcattattattatttttcttttttaggcagagtcttgctctgtcactgaggctggagtgcagtggcgccatctcggcttactgcaacctctgcctcccgggttcacgccattctcctgcctcagcctcccgagtagctgggactacaggcgtgtgccaccatgcccggctaattttttgtgtttttagtagagatggggtttcactatgttagtcaggatggtctccatctcctaacctcgtgatccgcccacctcggcttcccaaaatgctgggattacaggcgtgagccactgtgcccagcctggaagatcattatttagtcctacaactgacacattgttccactgacgcaattgcccaggctggtcttgaactcctgggctcaagcaatctgcctgcctcggcctccctaagtgctagtattacaggcttgagccactgtgcccagccaaaaatagaaatttatattctcacaaaaacatgtacatgaatgtttatagcagctttacttgtcataatcaaaaactggaaacaaccaaartgtcctacagtgaaacaaactgtagtacatccatagcatgtaatactctactgtcaggattaaaaagaaacccactgttggcacaggcagcaccgtggctggatctcaggggcattatgctgagtgcaaaaaagcctcaaagggtcttacactgtatgattccacttgttcaactaaaaatgacagctgtatagagatagagaacatattagtggttkccactagttagasaaagtgggtaaaagakaggtgggtgggaatataaatcgatagcagggagatctttgtggtattataacacttctatgtcttgattgtagtggtggtggttacatgaatacacgtgtgataaaatgccatgtagaactacatataacgttgtgccaatgtcaatatctaggttttagtttgatctttagttacataagatgtaactattgggtgaaattgggcaaaagagtacacgaaacctctcttaaatatctttacaacttcctttgaattgacagtttttcaaaatagaaagttgggtttttgtaaatacatgaattgttgatatacacaacaaatctcaaatgcattatgctacgtgaaagaagccatattcaaaaggctacatacctactgatgccttttatatgacgtgcaggaaaagataaaactgtaggacagagaatatactggtggctatctgggattaggaaatggggatcgaccacaaaggggcagcatgggggaattttctggggcaatggaatggttgtgtatcttgatggtgtatttgtcaaaatatatagaactataaaagtaaattttgctttatatgtattaaatcaaaaaaagaaactcgtgctcaaatagaaatacattttctgagaacttgccttttgatgactttgagaattttctggaaattttaaagaaatgtggttttgtttcccaacaggtgatgctatgagtgaagaagacatgcttcaggcagctgtgaccatgtctttagaaactgtcagaaatgatttgaaaacagaaggaaaaaaataatacctttaaaaaataatttagatattcatactttccaacattatcctgtgtgattacagcatagggtccactttggtaatgtgtcaaagagatgaggaaataagacttttagmggtttgcaaacaaaatgatgggaaagtggaacaatgcrtckgttgtaggactaaataatgatcttccaaatattagccaaagaggcattcagcaattaaagacatttaaaatagttttctaaatgtttctttttcttttttgagtgtgcaatatgtaacatgtctaaagttagggcatttttcttggatctttttgcagactagctaattagctctcgcctcaggctttttccatatagtttgttttctttttctgtcttgtaggtaakttggctcacatcatgtaatagtggctttcatttcttattaaccaaattaacctttcaggaaagtatctctactttcctgatgttgataatagtaatggttctagaaggatgaacagttctcccttcaactgtataccgtgtgctccagtgttttcttgtgttgttttctctgatcacaacttttctgctacctggttttcattattttcccacaattcttttgaaagatggtaatcttttctgaggtttagcgttttaagccctacgatgggatcattatttcatgactggtgcgttcctaaactctgaaatcagccttgcacaagtacttgagaataaatgagcattttttaaaatgtgtgagcatgtgctttcccagatgctttatgaatgtcttttcacttatatcaaaaccttacagctttgttgcaaccccttcttcctgcgccttattttttcctttcttctccaattgagaaaactaggagaagcatagtatgcaggcaagtctccttctgttagaagactaaacatacgtacccaccatgaatgtatgatacatgaaatttggccttcaattttaatagcagttttattttattttttctcctatgactggagctttgtgttctctttacagttgagtcatggaatgtaggtgtctgcttcacatcttttagtaggtatagcttgtcaaagatggtgatctggaacatgaaaataatttactaatgaaaatatgtttaaatttatactgtgatttgacacttgcatcatgtttagatagcttaagaacaatggaagtcacagtacttagtggatctataaataagaaagtccatagttttgataaatattctctttaattgagatgtacagagagtttcttgctgggtcaataggatagtatcattttggtgaaaaccatgtctctgaaattgatgttttagtttcagtgttccctatccctcattctccatctccttttgaagctcttttgaatgttgaattgttcataagctaaaatccaagaaatttcagctgacaacttcgaaaattataatatggtatattgccctcctggtgtgtggctgcacacattttatcagggaaagttttttgatctaggatttattgctaactaactgaaaagagaagaaaaaatatcttttatttatgattataaaatagctttttcttcgatataacagattttttaagtcattattttgtgccaatcagttttctgaagtttcccttacacaaaaggatagctttattttaaaatctaaagtttcttttaatagttaaaaatgtttcagaagaattataaaactttaaaactgcaagggatgttggagtttagtactactccctcaagatttaaaaagctaaatattttaagactgaacatttatgttaattattaccagtgtgtttgtcatattttccatggatatttgttcattacctttttccattgaaaagttacattaaacttttcatacacttgaattgatgagctacctaatataaaaatgagaaaaccaatatgcattttaaagttttaactttagagtttataaagttcatatataccctagttaaagcacttaagaaaatatggcatgtttgacttttagttcctagagagtttttgtttttgtttttgtttttttttgagacrgagtcttgctatgtctcccaggctggagggcagtggcatgatctcggctcactacaacttccacctcccgggttcaagcaattctcctgcctcagcctccagagtagctgggattacaggcgcccaccaccacacccggcagatttttgtatttttggtagagacrcggtttcatcatgtttggccaggctggtctcgaactcctgacctcaggtgatccgcctgccttggcctcccaaagtgtkgggattacaggcatgagccactgcgcctggccagctagagagtttttaaagcagagctgagcacacactggatgcgtttgaatgtgtttgtgtagtttgttgtgaaattgttacatttagcaggcagatccagaagcactagtgaactgtcatcttggtggggttggcttaaatttaattgactgtttagattccatttcttaattgattggccagtatgaaaagatgccagtgcaagtaaccatagtatcaaaaaagttaaaaattattcaaagctatagtttatacatcaggtactgccatttactgtaaaccacctgcaagaaagtcaggaacaactaaattcacaagaactgtcctgctaagaagtgtrttaaagatttccattttgttttactaattgggaacatcttaatgtttaatatttaaactattggtatcatttttctaatgtataatttgtattactgggatcaagtatgtacagtggtgatgctagtagaagtttaagccttggaaataccactttcatattttcagatgtcatggatttaatgagtaatttatgtttttaaaattcagaatagttaatctctgatctaaaaccatcaatctatgttttttacggtaatcatgtaaatatttcagtaatataaactgtttgaaaaggctgctgcaggtaaactctatactaggatcttggccaaataatttacaattcacagaatattttatttaaggtggtgctttttttttttgtccttaaaacttgatttttcttaactttattcatgatgccaaagtaaatgaggaaaaaaactcaaaaccagttgagtatcattgcagacaaaactaccagtagtccatattgtttaatattaagttgaataaaataaattttatttcagtcagagcctaaatcacattttgattgtctgaatttttgatacyatttttaaaatcatgctagtggcggctgggcgtggtagctcacgcctgtaatcccagcattttgggaggccgaagtgggtggatcacgaggtcgggagttcgagaccagcttggccaaaatggtgaaaccccatctgtactaaaaactacaaaaattagctgggcgcggtggcaggtgcctgtartcccagctacctgggagtctgaggcaggagaattgcttgaaccctggcgrcagaggatgcagtgagccragatggtgccactgtactccagactgggcgacagagtgagactctgtctcaaaaaaaaaaaaaaaatcatgctagtgccaagagctactaaattcttaaaaccggcccattggacctgtacagataaaaaatagattcagtgcataatcaaaatatgataattttaaaatcttaagtagaaaaataaatcttgatgttttaaattcttacgaggattcaatagttaatattgatgatctcccggctgggtgcagtggctcacgcctgtaatcccagcagttctggaggctgaggtgggcgaatcacttcaggccaggagttcaagaccagtctgggcaacatggtgaaacctcgtttctactaaaaatacaaaaattagccgggcgtggttgcacacacttgtaatcccagctactcaggaggctaagaatcgcatgagcctaggaggcagaggttgcagagtgccaagggctcaccactgcattccagcctgcccaacagagtgagacactgtttctgaaaaaaaaaaawawatatatatatatatatatgtgtgtatatatatatgtatatatatatgacttcctattaaaaactttatcccagtcgggggcagtggctcacgcctgtaatcccaacactttgggaggctgaggcaggtggatcacctgaagtccggagtttgagaccagcctggccaacatggtgaaaccccatctctactaaaaatacaaaacttaagccaggtatggtggcgggcacctgtaatcccagttacttgggaggctgaggcaggagaatcgtttaaacccaggaggtggaggttgcagtgagctgagatcgtgccattgcactctagcctgggcaacaagagtaaaactccatcttaaaggtttgtttgtttttttttaatccggaaacgaagaggcgttgggccgctattttctttttctttctttctttctttctttttttttttttctgagacggagtctagctctgctgcccaggctggagtacaatgacacgatgttggctcactgcaacctccacctcctgggttcaagcgattctcctgcctcagcctcccaagtacctgggattacaggcacctgccactacacctggcgaatatttgttttttttagtagagacgggcttttaccatgttaggctggtctcaaactcctgacctcaggtgatctgcctgccttggcctcccaaagtgctgggattacaggtgcaggccaccacacccggccttgggccactgttttcaaagtgaattgtttgttgtatcgagtccttaagtatggatatatatgtgaccctaattaagaactaccagattggatcaactaatcatgtcagcaatgtaaataactttatttttcatattcaaaataaaaactttcttttatttctggcccctttataaccagcatctttttgctttaaaaaatgacctggctttgtatttttttagtcttaaacataataaaaatatttttgttctaatttgctttcrtgartgaagattattgacatcgttggtaaattctagaattttgattttgttttttaatttgaagaaaatctttgctattattattttttccaagtggtctggcattttaagaattagtgctaataacgtaacttctaaatttgtcrtaattggcatgtttaatagcatatcaaaaaacattttaagcctgtggattcatagacaaagcaatgagaaacattagtaaaatataaatggatattcctgatgcatttaggaagctctcaattgtctcttgcatagttcaaggaatgttttctgaatttttttaatgctttttttttttttgaaagaggaaaacatacatttttaaatgtgattatctaatttttacaacactgggctattaggaataactttttaaaaattactgttctgtataaatatttgaaattcaagtacagaaaatatctgaaacaaaaagcattgttgyttggccatgatacaagtgcactgtggcagtgccgcttgctcaggacccagccctgcagcccttctgtgtgtgctccctcgttaagttcatttgctgttattacacacacaggccttcctgtctggtcgttagaaaagccgggcttccaaagcactgttgaacacaggattctgttgttagtgtggatgttcaatgagttgtattttaaatatcaaagattattaaataaagataatgtttgcttttctatttccttttgaatttgtgtttattgttaattcatagctattcaaagtgtgattagagctgggcttggtggcttgcatctacagttccagctacccaggaggcagaagcaggaggattgcttgagcctaggagttcgaggctgcagtgagctatgatcctgccactgaattctagcctgggcgacaaaacaggaaaaaagtatggatggaggaccagcagcatctgtatcacctgtgagtctttcagaaatgcagagtttcaggctacactcggacctactgaatcagaacttgcactttttacaagatccccaggacactaaagtatagagtgaagcttgagaagcgctgttgtgtggattgttcttaaccagctgcagtgatgaatatgaataaygcaggccagcacagtccattgatattctattccagcttactgcctgccaaaaggtccattattactggatcctcagtcttttccaagagaagctaagaattccaaatttttatttgaaatatattttttaaatgtttgttcaactggcccagtgccagtggctcaygcctttaatcctagcactttgagaggccgaggtggaaggatcacttgaccccaggagtttgagaccagcctgggcaacataaagagaccccatctctattaaaaaaaaatagagacaatgctgccttaaaaaagtcaaataaatgtttgctcaactgatttttaatastgagggccaaacaaagcacatcaaatytttaagtgctgcttttcctcattttatccaactctggacaccagaatccaaatgtagtgattggaatccacctagactgattgaggaatatattgtcctcaaattttatgagggttgactattcattttaactttaattargattgggcacaaattttgaaacataataacattacaggaccggggcccgatccagaccccaagagagggttcttggatcttgtgcaagaatgaattcagggcaagtccataaattgaaagctagttcattaagaaagtagaggaataaaagaatggctaccccataggtagagcagccctgagggctgctggttgccatgtccacccccgcgccccctccccccgctttgttgttgttgtttaagacagagcttcgctgtgtcatcaggctggagtgcagtggcatgatagctcactgcaacctctgcctcccgcgttcaagcaattcycctgcctcagcctcctgagtagctgggactacaggcgtgcaccaccacgcccagctaatttttgtatttttagtagagatgcggtttcaccatgttggccaggaaggtctcaatctcttgacttcgtgatccacccgccttggcctcccaaagtgctgggatgagccacctcgcctggctggttatttcttgatgatatgctaaacaaggggtggattattcatgcctgccctttttagaccatttagggtaacttcccggcattgccatggcatttgtcaactgtcatggtgccaatgggagtgtagcagtgaggaggaccagaggtcactttcatcaccattttggctttttcagccggcttctttactgcaacctgttttatcagcaaggtttttatgatctgtatcttgtgcagaccttctatctcatcctgtgacttagaatgccttaaccatctgggaatgcagcctagtaggtcttggcctcattttaccaaccccctattcaagatggagttgctctggttcaaat

SEQ ID NO: 13257 - DNA, 16933 bp, Homo sapiens
ggacttggcagtgggggtctagaatcccaccctatccccaccactcatcatcgtgaccctgggagaggtgcttggcccctccagtccccagcaacccaccctcccataatggaaacagaagagtcacccagagcctcctgctgctggggagaggaagagaaaggagggyggggcagggctggcctgggatttgggggacagtggccatcctcagggtggaccctccctttcccagcatcttcctcagctggagccgctgggcaacagcccaatgggcctggagagagctggcttcccacygggcctgggatcggacctgcagggctgtgctgggcctgtggcrtcagcggctgctgcagtcacggctggtggagyggtgggcccaggagcggggctggcggctggcacgagatgccctatgccactggcactcctgttggcagggtgagtggagacttggtcgggggcactgcgggtgagggcagggccagggtctgtctgagacccagactgcagccctggccaacaacttgactgtaaccgcatgggagaacttgaggcagaggctaagctacatctggactcctgacccatagaaactgtgagataacaaacatctgtggtttaaaactaataagtacttgggtaatttgttacacagccatagctaacaaatgcagttgatcagagaggtccgctgagctgtgacactgacctagctgggttcaaagaaaacaggctgaccaactcttacacrttgtgctatgaatgagcaaatgaatagacctcagctgtgaaatttccragagggacagtgactctgcagagtgcctcaccacccccyataccctcccatcccstagcaaattctggtgatgagacccccacagggcacacccaggagtcaggtggcagagcagaacctgggggcttggactctgtagtcttgagtttgaatccctgctcttccataccctgactgtgtgaaacttaaacaacctagttaacctccctgagtctcagcttacacatctgtaaaatggggataatgtagtccctatgtcatcacctttatcttcatccttatcctcacctggcctctaggagtcactggtcggagccctgagttgggagagaagtgggcagagtcatggtgcccttaggggccagcagagttagtcagggagggtcccaggaggaggtgaggagggctcagcgggcagagcagtggcgagagargttgaggcgtgggaaggggtcagcaaaatagggcagtgggaaggactggatttgcagaggctggctgagggtgcagtgtgytagaagccctgaggaatgtggccagtgaagggaggagggatggtcccaaggcaggcttgctctctgggtcttggcctctgggcaaaaagagctgttgcatggcccaaccagtctttttttttttttttttttttttttgagacgatctcgctgtgttgcccaggcatgcagtggtgcgatcttrgctcactgcaacctccaycccctgggttcaagcaattctcctgcctcarctcccctcgtagctgggattacaggcgcctgccaccacacctggctaatttttgtatttttagtggaratggggtttcaccatgttggccaggctggtctcgaactcctgacctcaagtgatcaacccgcctcggccttccaaagtgctgggattacaagcgtgagccaccgcacccrgccccaaccagtctytttataacctgatatcagaagtgacatcccattgcttctgccaaattctgtctgttaaaagcaaattagtaaacccagcctgtattcaaggcggggcattgcccaggacacgaacacaggatgctgtcttggaggctgcccactacaccgacatatygcattaatgagctggcaggcagggctgtggtggttctagaaagtcatgtcctgtccgctggagacagctgcttatgcagcccaatcattccccggcaggaacactgagccagtgtttccagaacttctagtttttacagaaaaattgaaaattagatttttgggcygggcgcagtggctcacgcctgtaatcccagcaatttgggaggcccggwctggcggatcacgaggtcaggagatcgagaccatcttggctaacatggtgaaaccccgtctctactaaaaatacacaaaattagccaggcgtggtagtgtgcgcctgtagtcccagctactcgggaggctgaggcaggagaatggcatgaatccaggaggcagaggttgcartgagctgagatygggccactgcactccagcctgggygacggagtaagactccgtctcaaaaaaaaaaaaaaatagaaaattagatttttacctgaattctccagatttgaaaatactgtggcaaaattaacaaacaaaaacaaacccaacaactctatgagctgggctggcctggtcaccagcaggacacccataatagaggctttttaacccagacagtcagggtggcctcctstgttcccacctggtagggggcgaagggctggctgcgtagaggcccatggggagaggctggggtgagcacccagtggctcttcagcatctctctggccccagggcagcagttcctgcatgaaaagtgccagacatgggtgcaggtccacctccagggcctgcagaaggtggtgttccggagctggcagcaggcagcagctcatcagagatgcacagtgacccggccagagcagctgctactgcagaggtgggtgggcctgggggtgggagggtgttggtcctccccacgcaaggaatagcaaggagagcacccagggggtgggaagctcagacggtggcccagataggaggcctgtggcctgggaaaaaaggggcatgaagggagatcctagcctggaaacacagggccatgaccactgacaccttattacctattttgggagtggtggcaaaccccacccctaacctgtggccccaacaagccccgggagtccagctcctggccaggtcagttctttggttttagaggatatgattaagatgggagaaatcagctgggaacagtggatcatacctataatcccagcactttgggaggccgaggaaggtggatcacttgagatcaggagttcgagaccagcctggccaacatggtgaaaccccatctctactaaaaatatgaaaaattagacgggcatggtggcaggtgcctgtagtcccagctacttgggctcaggcaggagaatcacttgaatccgggaggcggaggttgcagtgagccgagattgcaccactgcactccagcctgggcgacagtgcgagactccatctcaaaaaaaaaaaaaaaaaggaggagaaatccactcctcggaaatctaccataacgcccattgtgaggagttacagcaaggagaattctgctgtacactgtcgctaagagaagagagtgaaatcttcatttaagtaaagatgttctggtggaacatgtatacagttcatgaatgcatattgtaaaaccaagcrgaggacacagaatggctcctcccacagttcagtacaaatttgcgaatgttcagtgtccccgtggggcagtgaactgttggctacagaatggctgacgtctgtgcttttgcatctgagggtgtagatggttattttgtttgtttgtttgttttttgagacagagtttcgctcttgttgcccaggttggagtgcaatggcgcgatctcggcttaccacaacctccgcctcccgggttcaagtgattctcctgcctcagcctcccgagtagctgggattacaggcatgtggcaccacacctggctaattttgtatttttagtagagacggggtttctccatgttggtcaggctggtctcgaactcccgacctcaggtgatccgcccgcctctgcctcccaaaatgctgggattacaggtgtgagccactgtgcctggccgtagatggttttttttcttggcttctcastgagtgagagatggtgttcctctccctcaccaaccacctgggcatgtgatrggaggcagggcatggctgatgtgggacttgaacccatactgctggttcccatccccctcgcagggcagcccctgccctctgaggctgaggttgcaagatggaaagccagtgctttcacctgttactggtcgtttactgttttgtgggagatttgcaagtgtaactttgaataaatgtgacttttgactctgagaacgagacaagccctcccatgcatctgtttttgttttgtttttttgagatggagtttcactcttgtcacccaggctggagtgcacttgcgcgatctcggcttactgcaacctctgcctcctgggttcaggcaattcttctgcctcagactcccaagtagctgggattacaggtgcccactaccaggcctggctaatttttgtatttttaatagagacggggtttcaccacgttggtcaggctggtctcaaactgacttcaggtgatccactcaccttggcttcccaaagtgctgggattacaagcatgagccaccacacctggcccawtgtgtctgttttgcagctacttccaggcctggtgtgaggttgtaagagacacgggggtgctccgggcccagcatcaagcctttcaggatggcctgaggagaagagcactgggggcygtgtttgccacatggcgggaagcccaggaagtggcagccggggcacaggagcagcgtgtggcccaggcctcccttgcccgctggagaagctgcrggcagcaaggccaggaagatgggcagcagaagaaggcccgggccccacaggccttcccagcatggccagtggccccgggcatgcaccatgaggcccagcagcaggcaggagagagcgctggggcccaggcagcccagtgctggacttggtgctgggctctgtgggtgcatgagtcctgtcggggccaggtcagccgagcccatgcttcctggaagccgcgagcctggtgagtgctgtggtctaagtgcagccccactctgtgcttccagctcaggcctcaagcctgtttttggcaggggtagagcgtaattcatggctgggtggcagggcaaaggctcaagagggtggttgggggtgacagggagaggccgccctggccatctagtcctgggccacatcctgrcaccgcctcttgctgtgtgtcccctccttggggaagtctctaatggtcatgccttgcagtcaccagcacagccagccactcagcaagcgccataaacgcgctcttgccagggaaggggaggcaaagtggcactggcaggactgtcccctctctgcccctaaacaggatgcttgtccccgtctgtgattttctccttccaggtcgctctccatcctgtttacccagattctccctccagaaaagggagtgtgggaggtgggtgggccccagcctggggctgggcccrgaaggccccctcccgcagggcactgggggggctccctgcagagagtcctggccttkatggccctggctgcagactccttcctctcccgcagggtcctagaggcctcggtgcagtcggcggtgcgcggcggtgtccagcgagccatcctcacccagctccggccggctgagctcaggcgcttcctgcggacagtgcagctcagggtgcggctgggactgccaggggccggcaaggtacgccccaagccccagactgacctcacgctctggccccggatggccagcagggggagcctgctgctggacgccccagccccttggaaacaggtgaagggagcctaggcagggcgggaggtccaaaaatgaccctcggaccaccggccttagaatcagcttgattcagccsgtggtrgcagcatggctggatgcctccccaggggcccagcaacctcgtatgcaccacctctccccagttctcagtcagcctctgacaagcaactctgaatccatcagcaaagatgaacctggcacctctcgagtgccaggccactgcaggtccggccgcaaagaccagcatgttgggtcacagcctgttagggagacattgaaatgcatgctttctcacggtgcagttgaggatcagaataggtacacgaggacagtagcatttttttgtcaagtttttttgtttatttttgagacagagtctggctcaattgcccaggctgaagcagaggagtgatctcagctcactgcaacctctgcctcccgggttcaagtgattctcccgcctcagcttcctgagtagctgggactacaagtgcacgccaccaygcctggctaatttttgtatttttagtagagacggggtttcaccatattgcccaagctggtctcgaactcctgaactcaagtgatcctcccacctcgacttcccaaagtgctgggattacaggtgtgagccaccgcgccaggccaagttttttttttttcttattggaaaagtgaaatatgcttattacagaaacctcagaaaatataaagtagaaaaataccaaaatttctttcataattctctctacccaarggcatcggtcagtccctctccagaccagaagcagttagttctgacaccaacaartggtgataagaggttgayagcctagcaagggggaagaagccaccaccaaaccaaacacaaaaaatgacactgcacagcagtctggggacatgtccttgaaggacacagccccaaagatactggcaggtgaggtagtgtccctaagatcaacaggcatcatcatgaatcctatttcagaatgccacaaagaatacrttttagagaagattctaagagaaaaagctaaggtgattttttttttcagtcgttttttgttctcagacagtgtctcactctgtcgcccaggccagagtgcagtggtgcgatcacagctcactgcagcctcaacctccagggctcaaacgatcctcccacctcagccacctgagtagctgagactacaggcgtgtgccaccacacccggctaattttttttttttttttgtagaaatgggatctcactatgttgccagggcttgtctcaaactcctgggctcaagcgatctayctgccttggcctcccaaagcattgggcaggcccattacgccatgagccaccacacctgctggtttttgttttttaaatggaattgaaaggaactagccttggctagttgcagaattcacacatatggggctatggcaacagcagattctggagtctcagggtcttttctttctagataagttacagggcaattgcttttcagagtacttttacatttctattccattcttgtcagtaaagacaaggatcccataagctgatggagaaactgaggcctctagaaactaaacgctgggaatggcacccagggtgctgaattccagggtctcctcttttctgccacaggcacacatgccccagcagcccctttggagagccccctctctatagggtactagccgggggctcagactctggagtcagacggcttccgagggatgaggcctcagacaagtaactcagctttgaaatgttttcagtggggagagaaatagccccctcccagggctgtgctccgggaactgactgagggctaactattatgggcccaccccattgttggaatgtcttcagccacatgggggaatgggtggaagaagaggccgggatgtgtcctgccagctagagcagcgaagaaatcccagcggggccccaggaagtccaagcccatggggttcaggtgctcctctctggctaytccttcagacccrcagctgctggacacaggccacagagctggtgcctcccgcgccatcactgcagtgcagcctgggtggacggaggaagccaaggggaacggcctgggctcagagtaaggagaccttgccccgggggacaaacggtgtctgaagtgcaggggtgaagcggtctccagtcctcaggggcctggaaatcagctccttgggacacggtcttatgtgtattgaccattctccccatccattccctcttcggaatgtttcagctgttctgagaaaacactttgcattcctgccccgcccctgtgatttctctttgggyggcaggcagccgkgagaggctggaggcctggggagatgggggcagggcacaaggctaagctcagcaccttcctccaccctcctcactgtactcaactcctargcgggcactaagagcagctgccttcctggacccaccttaamctcttgtgactcaactcccctttccagggtgcagggaacattccctctgccctgccttccagctctggccacagtggcctggacagagtagctgggtcccaggcctgcccctgtggacgagggaccagggaccaagagcgcactccagccctgagcccagagcctscaaagcccaaagcaaggcccataaacggaggctacggtaagaggagctgtgtgtgcagtttggtgggtccgagggatgggggcaagggctgaggggcttgcctgagccatggctacagctgggccctctctggccagtgctcgttcctgcaggatcctggaaaagcaggcccaggcccatggctctgccctccttctggccctgaagggtcacgatgctcttggccatcaggaggaagtacctgcagcgccggtgcctcgaggcactgcttcacgggctgcggggttcccagcaggccaggtgcctggcagtggcatggcagcactgggtggatgcccaaggggcagagcagctggtgcggaccctggtgagtgggtgcacccctctccacactgaccatctcccatttcacctcatacttaacccaaacccctctcaaaagtatggcccttggacctactgactccaaaaccttgggggacaggcccaggaatctgcattcttaatactcctcagatgacacccccttgccatagccctttcactctggtgcagcagtgtcgggggagaaaggcagaagggctggggactgcgggggagcgtgagcacaagaggccttctctgccaactgtccccaaagctcagggagtggcacctgagatgggcctggcagacgtggtggcagcggatcctgcgactgcgagtggctcagcagttacagcagcaggaagatgggtgggtcctttcccaggtactgccctcttccctgcattccactcagccagccttccagaagtctgtgccacagccrcgcaccgtggagctttccctgcttgccagccccggggccccttcgttttcaggggagggggtcagttccattacagaacacacaggctggatgctggagcccttgctttgatttgtggccccagctcaggccaggcccacccggtccatcagtttgcgaagaaggtgtggcatgaggcatggctgccactcacactagcccatggagggcctgggtcctgagcgccccctccctcatttgctctgctctgagtacagcttcccagctcaccatcagatctattctgagcttgtgcatttggcctaggcaagactggctggctgcttggggcagagggaggggccctggggacaaaaggagctgggtacaggggttgctctagcaggcacagcacagaccccggagaaagcccacaacaatagcatttcctctcctccctggttccaggcctttaagaagtggcaccaacgcctggcagccaggagcccaaggagaggagctgccagtagcccaagaccctggagcaagccaggccccaagggccccgagagtggacaggaagccgccrgagcaccgcggggttgggggcytggggcagagcatggggcccagctgcagctgtgacttgttctcatagaataaaaaacagaactgaacttagccttcccagggaaggaaccatgccccacacatccagggagtgatgacagaggggacagcttgaagagctctgaaggacaataaaacccactcctcagtcctagctgctgctttcagtctctcctagcggctgcccctctgccccagccagtgaggccaggaagggagtaaagaggacatcccacaattgcgtccacccccttggccatcaggctgctcttccactacacgaaacagcccatctgcacctgccagtcactgcccccaggccctggggcttgcaggtgactcgtggggagccaggccaggcagataacctctgggacaggacgaggggatgaggaaggcagctggcaggacaagggcctacctgaaaaatacaccaggaagctgggctgctgcacaggcccaggcagatctggggcccctgtgctggcaaatctcatcttagcctctgacagggaacggggcagcatcaggcctccacagccaggcaaaaggggaaggccacgagccccaccaagcacaagggttcagactgccttcaacccttaaggggcactttttctctcaaggctcagaatagacaactgtgccaaaaagcagcatggtaggtgtcagcccaatgcccatccagggggctggtgccatggacggctaagtgggcaggcagggcagtggtgtgccccttcagtcacaagtaggtggggcccagctgcccacctctaggaggtggaagggtacagcactttgccacatctcttctacgatgccaccagtgcctgatgcccttgcgtgttttgcctgtactgcacgggctccaagkgtaagttcactgggagtcccaggctggctctggaggctgccttggttcgagggcttagttggcaacaaccactctcctcgccttctcaggaggtgccacccactgtggtcctctgcaggacgcaagtgctccccaccaaaagagcacagactcctggctagagcagagagtactaggttcccatgtggggccgactcaggtccaggaagagcctggaagcctcactccagtctagctgccattgtcaggtgggggagtggaggccggggtgggagagacacgaaggagagtggagttcccaagagaagcagcactgtggaggaggaaggcgggacaggagtggctccaacgcagggcgtcaggacgcagggtcatggagcctccrtttctctcgcattctgggtgggcctgttgagaagctccaatgtgtcttccaccacctgccagaggcagttgtccagtgggaagtcattgtccaccaggttgaccaggaagtagttgtcgtggatgtactggatgatggtgcgggacggggactcctcctcatacagctttccccacygctcaatccacagggcaaaggcctygtcctacacacacatacccccgcacacacgcacacatgcacacacacacasaggcaagattaacagggctctccaagggctctgctcaacaggacatttcccggaatagaacaaggcccactgccagtatcacttcccacccctgcccagaaataaacaccctgcrtcagcagtgacatgggtgagtcagagctgggtgtgccctgaaggctgggtccagtgtggccttcagyacacgcttgggacttggtcccaatccctcccsacggttttccaggtgggcggggcaagcttgcccccggctcctttacctwccagaacatgaagctgacgggatccactacggtgggctggatgatctctcrcycagggaagatgccccaagtgacagcattcggctgcagttcaggggcattggtgatgttttcaccctgaggggatgtggggtgggggtaagacctgggccaagaayaactggagtcccactgcctggacagccttgactcaatgaggctgtctgggctcaataccctctgcctgcgcctccactcccggcctmcactctccctgcgcctccactcccctctccctgtgcctccgctcctggcctcctctgcctgcatctgtgaatgatatctctccccacacaagcctgaacctagaggcgtcctggccacttcccctctcctccttgagcaccccctgctcactctctgatccattccctcttgtctagcccacctccaggagtgtgtttggcttgggtcactccaggggtctcttcactggcctccccggctctagccgtccccaatctctctcatccgtatgactatccactgtgatttgcctaaaataaagcaggaaccaagccaccccactgctggagaaaggcttcccttgcattgagggaaaactcaaattccagcaggacaaccatgatctctgcgggcctggcccctgcttaacactcccgcctcctcctgctcatgttcccsgtttccccagatggtgcagctcactgcctctgcctgtcctctgccctgtcccaggaatacccttctctcctgttggccaactcctctttstcctcagtgattcccacagatgaccctctgagaagccttccctggcctcccaggtgagatatccctcctytggaccygacagcatcctctcctgaacttgattttcccacttacactggctggtggtcacacattgatctgcctccctcactctaggctgggagctccttaagagcagggccccagttctgcctgtatctstctgtcttgcacaatgcctagcccaggctaggtgctgggtgtttgctcaacgaagggcytgrtactctgtgggaaccctggggcctggcctaccttcacattgacaaggtggtaattaacccggagctcgtacttcttcagcacttgcagaagtgcttccgctgtctcgcgggaagtgaaaaactctaagtaggcctgtgggagagacaggtgcctgtcaccaaccccagccctgccagacgccctttcgcagacacctaaggtatcaggactaytggcagcmatgtgggcggaataatgaactgtggcgttggcacgtccataagcaaagggtgaggggagtggggacgtgagtttctcagtctggacaggtctgagggctatcagccacccctctcccaatcagtcagggaagactccacgaagaagccatttctgaacagcagcaactggtttgacaggccgagtcatgggagagaggccccacacattccatcctccccagtgcaagctgacaatgacattgacatctcctctagaaccagtgcctatcagggattaagctgggtttactcaaactcatttgctagaatgctgataatacgggaggctgggcacagtgagccccacgtgaggaaagtgggttcagggaagttgagcacgttggctactctgacagtaaacagtagagctggtccttaaactcaggtctttctgctccagggccygtgggccttagatcagaacataatgttaactccagcagccctgggagaaaggtgtcaactcaggatagtaacagcagctgcctttcagggagtgcttcctgctcttaccatgtgccaagcacgttacatgctttgttaggtttcatgcccagaacacaagctacatcccattttacagacgagaaaaccaggctcagagaggtcgagtgacctgcctccataggtctgatttctatcttttttttttttttttttgagatggagtcttgctctgttgcccaggctggagtgcagtggcatgatctcagctcactgcaacctccgtctcccgggttcaagcgattctcctgcctcagcctcccaagtagctgcaactacaggtgcccgccaccacacccggctaattgttgtatttttagtagagatggggtttcatcatgtttgtcaggctggtctcgaactcctgaccttgtgatctgcccaccttggcctcctaaagtgctgggattacaggcatgagccaccaagcccagccaatcttttttttttttttttgagacagggtctcactttgtgggccaggctggagtgcagaggcacaaatatggcttactggagsctcaacctctcggactcaagcgatcctctcaccccagccccctaagtacctgggactacaggtgtacaccaccatgcctcggtcatttttgtattttttgtagagaatgggtttcaccatgttgcccaggctggtctcgaactcctgggctcaagtgatccacccgccttggcctcccaaagtgctggccgggttccgtgcccagccaggtctatctgacttaaagcatgagctcccatccgctccaatccatgctcattcaaaatttaagagcccaggagaggcaggctgctctgccctaagctctggggaaccmacgggtgccggtcaagagaggggggcaccccgtgcctccctaccacaccttctggaagacatagcccccgctggggccccagcccacgatggggtcggaggayggcttcccgttgatgttgggctgtgagttgatggtgaggatgccctggcggttcacccgcagcagctcctccttcagcaggctggtctcagccgccaggggctcatcgttccagggcaggcaagtcacctgggagagacggtgagctggctggggcgaccatcaggtttggcaccctgagtccctctcacggcccccaacaaagacccagcctgtctttgcctccctaagcccttccaggtggaggtctcccaacttacccttctccctttgccatgtccacagcatggaggggagggcacaggatggggaagtcacagccccgcagcctggcctgcagctggggtcaggccaggggcaggggatgaaccagggtcyccactccagcatcactcactttgtgaccattccggtttggttctcccgagaggtaaagaacraagacttcaaagacacttkcttcactggtcagctcmtcccccyacatcttcagcagctcctccttgggggacttgctcttcaggtagaagaggtagtagtccttcagctccccaaaggcaggggaagaggaattgcccctggcagaggggtgcccagaggtcagggcacactcctgacagagggcagtgccaccacatgcccaggaggccattmctgtaaattctgcccctgactcctcccaggtcaaccacaagcatgcaaacttcttctgccctcccgctcccaagaacaaagatrtatttgcaaggaaggtctgcaggccctcaccagcggycgttagggaactcgtcccactcctgggtacggtagatstaactctttggtctggaggcccagaagatgggacgtacatcttcctctcrgcgcttggggtgggcrctgagagcccagggtaggggacgcctgggygaggatggggacagagaattgagacaagggattggctagagggagccggaagcaggggagcacccctgaggctgagttcttccatctgatgccctctgagactggagccttygatgtgcccagctagccatggcacagacatccayctgtaccaccgtggggagccagcactgcagccggggctgctcttggaccctcctctggggatctctgggccactgccctcacctggggtcctcagtccacatccccaggcgcttcagcacctctgtggtagccatctcgcrgytgrgggtgtagaagtggaggcctggyaccaagccactggccagaagctcctggcacaggctcacrgccagctcgatgccatagttgcggatggcagcatcgttgtctttgattggctcaatcacgtccttgatctcctgtggcacctccagcttggacagcttcacaagctgccgaagggagtggtagccctgtccaagacatgaggggctgtggcggctgctggccagccygtctcccaccctaaatacttctcccccttccatcatccatgccaaccacagtgtcaggcagagggacccacgaaagtccgatcatattctaggagcacacctgggcttggcctgccgttttctcctcttttttctgtttttagagactgagtctcactgctctcaaacgccagggctcaagccatcctcctgcctcagcttctcaagtagccgggactacaggcacgtgccactatgcccagctttcccactttttacagagtagagcagctgccctaagcattccagccttgggttgagccagccttttagccctagatgtgtctgttggtaacatggtgtcatctaacccagctgttcccatgctgcactgatcatccgaatcacctgccaagctcaagaagtaaaacacacattccraggacctccctcagatttactgagtgagaacctccaggggtgggacctggagatccactttttgaaaaagcttatcaagtggttctgatgacagccacctttgggaaacactgatttaagcaggatttgtaatgagaattagaatcccttttggtgatgcttgttggccaaagtacaacaaacccctcaacagacactgttgctgggttttggggggaaaattagaggtaaccaaaatggggtggccaagcaacgctgtgcaagttctggacctgagaggagatctgggaagaactcagcgaactcagcactccacccagagcccccagcctgtgcgaggacggtgcggtgagagtggggtggagggagcttatgggctctcctgggcccctcacctggatgggaaagatcccggggacgatggggcaagtgatgcccatgtcggtgcatgccttcacaaagcggaaraatgtgtcagcctcaaagaaaagctgcrtgrtgatgaaatcgrctcccgcagacaccttctccttcaagtgcttcaggtcagcctcaaagctccctgcttcrgggtggcctttggggtaacctgccaatagggatgacagtcaggagaggctggcctccacctgttcaaggcgagggatgaagagaccacagggactgggcagagagagtcctctgctttgggggctctgatcttgcac

SEQ ID NO: 13258 - DNA, 15922 bp, Homo sapiens
  misc_feature (1)...(15922): n = A,T,C or G, or insertion/deletion polymorphism (see Tables 1-2)
ttgacctgtacaggcccctggctaagagtcaccccagtgggactgacacttctggttagaagcttcacctctttcccccactccagctttcaactctagacagctttctgactgcttctggagtggcagagcaygggataattgattcctgctgagggccttttctaccagtgttagggtgtagcccggaggtctcggtccccatgacccgcaattccattcctagyctccgggaccctgctcagcaagtgcggaaaacagcggggctggtgatgmcccacctgatcctcaaggacatggtgaaggtgaaggggcaggtcagygagatggcggtgctgctcatcgaccccgagcctcagattgctgccctggccaagaacttcttcaatgagctctcccacaaggtgagaggcagagaggcactgagggctggctgcagagggaatctgtaggtcacctcatctccttaacatggytctctctgtcttacagggcaaygcaatctatratctccttccagatatcatcagccgcctgtcagaccccgagctgggggtggaggaagagcctttccacaccatcatgaagtattgctccccgggccctggggcacattttccacatagcaygggcttaggaatcagacacacctgtatttgaattccacctcggctactctttagctgtacagccttcggcaataacttagcctctctttgtgcctatttcctnttcttttgaggctgatgatacttaacccttagttcttgaaaatattaaatacgataaagttcctaacatggtggcagacatacagtagcactcactccctagcagctgctcctgttaatttccattcacagtgaaaattcctgagccgggggcggggtggggtccctctctgctgaatgggacagggcaaggggagtggtgaggcagacaggggccgtggcagagaacatcagagaagacgagtgctgggggagggtccagggttggtcttagtggatggcagagctggccctgggccatcraacatcctcatctycccttcctgcagacagctcctctcctacatcaccaaggacaagcagacagagagcctggtggaaaagctgtgtcagcggttccgcacatccckgtatgctgccctccctgagggttctttgtgctgagcggggccctgcaggggagaaaggcccatccctcaccccttcaatgcccccactgtggcatccctgggactggggaggctgatggggaaggttgagcctytactagctggatctcccagttcctcacaaagcccttcctatctgcagaactgagcggcagcagcgagacctggcctactgtgtgtcacagctgcccctcacagagcgaggcctccgtaagatgcttgacaattttgactgttttggagacaaactgtcagatgagtccatcttcagtgcttttttgtcagttgtrggcaagctgcgacgtggggccaagcckgagggcaaggtgagcagcacaggacacttcaatgcctgttgggttctgggctggctaagacatctgccggccctgggcagcatacggctcttgcagtcaccttcccgtcctccttatccccagctgggttgcaaccaaattgccagagtgacctaagaccagatctttgtctccagttctttttttattactccaaaaacacaaccaaagcagcatctcatccaattcttgtttgtttgtttttaatagtttttatttttcagagcagttttaggttcaaagcaaaattgagcagaaagtacagggagttcccttctaccccttgcccctacacatcacagccttccccaccttcaacatcctgcaccagggtggcacatttgttacagctgaacctacacttacacatcatctcctaaagtcatggtttaccttggagttcactgcacgtaatgacatgtacccaccattgcagtatcatacagaagagtttcactgccttacaaatcccctgcactccacctatttatccctctctccccacaacccctgatctttttactgttgccatcactttgtcttttccagaatgtatcattggaatgatccggtatggagccttctcaccttggcttcttagtaatgtgcgtttaaggcctccatgtcttccatggccttgtttctttttaatcagaagtaactgttttcaggcctgctctgaatctccttttctccctccaggctataatagatgaatttgagcagaagcttcgggcctgtcataccagaggtttggatggaatcaaggagcttgagattggccaagcaggtagccagagagcgccatcagccaagaaaccatccastggtacgtaaggcagcctgtgcgggcgagaccagactgggccctcccctcctgcagtgatttgtttcttcttcttttttaaatcacgttttcctgccttttctaggttctaggtaccagcctctggcttctacagcctcagacaatgactttgtcacaccagagccccgccgtactacccgtcggcatccaaacacccagcagcgagcttccaaaaagaaacccaaagttgtcttctcaagtgatgagtccagtgaggaaggtatgatgctcccgcctgttcccgrccgagaaggcacacagctagggtgcagagggctggtttccataggacctgctgcgggggcctgagtgtasatgctctgccccactgccgcagaagggcctctcctgtacagcttggattttatttcttctgtgcggtgtgggattgtctcacttgttctctgatatctattttttyaccatctttgtgactcagctttttcttattcctttaattctttgcatagatctttcagcagagatgacagaagacgagacacccaagaaaacaactcccattctcagagcatcggctcgcaggcacagatcctaggaagtctgttcctgtcctccctgtgcagggtatcctgtagggtgacctggaattcgaattctgtttcccttgtaaaatatttgtctgtctcttttttwwaaaaaaaaaaaaggccgggcactgtggctcacgcctgtaatcccagcactttgcgataccaaggcgggtggataacctgaggtagggagttcgagaccagcctgaccaacatggagaaaccccatctctactaaaaataaaaaattagccgggcgtattggcgtgcgcctgtaatcccagctactcaagaggctgaggcaggagaatcgcctgaacccagaggcggaggttgtagtgagccgaaatcacaccattgcactccagcttgggcaacaatagcgaacctccatctcaaattwaaaaaaaaatgcctacacgctctttaaaatgcaaggctttctcttaaattagcctaactgaactgcgttgagctgcttcaactttggaatatatgtttgccaatctccttgttttctaatgaataaatgtttttatatacttttagacattttttcctaagcttgtctttgtttcatctttcacattagcccagtttcatgcagcagagagagggttatcagtgcagagagagatgagtgagcccagagtcctagggcctgtcccgggatggcagatgagcttcctgccccgtcactgccacctttcccctctcaacctctggaccctgcacagtgaccagacagcctctctggggagaattatgcagtgcctaggctccagatcagtgcttctgaaccgggggcaattttgtctgccagaggacatctgacaacacctggggcctgttttgttgtcatagcctataggggaagaatgctaccagcatttgtgggaagaggccagggatgtggctcaacatcctgcagtgcacaggatggcccctcaacaaagaatcacacggcccacaatgtcaatagcgtcacagttgagaaaacctgctctagaccaagggttgctttctgccgtgtgcctcaccccacccccactcgtgttccctaatcccatctccaaaggttggcagcagaccggcccaggctcgtggaagttcagatcatgatcccctccagctctgcaggagacaagacctgtctcccagcattcctcattgttcccgggtctgcagagggcgtgagctatgctgcaggcgggctgccccctgaagcctgcgcacccctctccagctcctcaagtcttctctgctgagtcaccttcgaaccggaggctgtgagctggctgtcgtgacyacactggtgcctctgctgtcatgacaacagcacactacgtcagtagtgctccctgggcactgagctccctctttgcggggagaagacagtaatgaaaaatgacaagcatgaggcagaggggaagatcacgcttgggtggtgcaggagcatggaggtgctcttaatgctctcaatgagaaagggttaacggtcctggttgcaggaatagctgagtcagaggtggggcttcctccactcccccaccccacccctttcaccattagggaccttcttgccttgctcttgctactctgctctgggtggtcattgtgaaaagcccgcaccaaccatgccagtggcagccagacgaggacacagcctggctctgggtcccagcaggaaaggcaatcccagaaaggcagggtcagggactggagtcctgtgggtgctttttaagcaaagattatcaccaggcaggctaaacttagcaaccggcttttagctagaagggcagggggctggtgtcaggttatgctgggccagcaaagaggcccgggatccccctcccatgcacctgctgatgggccaaggccaccccaccccacccccttccttacaagtgttcagcaccctcccatcccacactcacaaacctggccctctgccctcctaccagaagaatggatcccctgtgggagggggcaggggacctgttcccaccgtgtgcccaagacctcttttcccactttttccctcttcttgactcaccctgccctcaatatcccccggcgcagccagtgaaagggagtccctggctcctggctcgcctgcacgtcccagggcggggagggacttccgccctcacgtcccgctcttcgccccaggctggatggaatgaaaggcacactgtctctctccctaggcagcacagcccacaggtttccaggagtgcctttgtgggaggcctctgggcccccaccagccatcctgtcctccgcctggggccccagcccggagagagccgctggtgcacacagggccgggattgtctgccctaattatcaggtccaggctacagggctgcrggacatcgtgaccttccgtgcagaaacctccccctccccctcaagccgcctcccgagcctccttcctctccaggcccccagtgcccagtgcccagtgcccagcccaggcctcggtcccagagatgccaggagccaggagatggggagggggaagtgggggctgggaaggaaccacgggcccccgcccgaggcccatgggcccctcctaggcctttgcctgagcagtccggtgtcactaccgcagagcctcgaggagaagttccccaactttcccgcctctcagcctttgaaagaaagaaaggggagggggcaggccgcgtgcagccgcgagcggtgctgggctccggctccaattccccatctcagtcgytcccaaagtcctyctgtttcatccaagcgtgtaagggtccccgtccttgactccctagtgtcctgctgcccacagtccagtcctgggaaccagcaccgatcacctcccatcggrccaatctcagtcccttcccccctacgtcggggcccacacgctcggtgcgtgcccagttgaaccaggcggctgcggaaaaaaaaaagcggggagaaagtagggcccggctactagcggttttacgggcgcacgtagctcaggcctcaagaccttgggctgggactggctgagcstggcgggaggcggggtccgagtcaccgcctgccgccgcgcccccggtttctataaattgagcccgcagcctcccgcttcgctctctgctcctcctgttcgacagtcagccgcatcttcttttgcgtcgccaggtgaagacgggcggagagaaacccgggaggctagggacggcctgaaggcggcaggggcgggcgcaggccggatgtgttcgcgccgctgcggggtgggcccgggcggcctccgcattgcaggggcgggcggaggacgtgatgcggcgcgggctgggcatggaggcctggtgggggaggggaggggaggcgtgkgtgtcggccggggccactaggcgctcactgttctctccctccgcgcagccgagccacatcgctsagacaccatggggaaggtgaaggtcggagtcaacgggtgagttcgcgggtggctggggggccctgggctgcgaccgcccccgaaccgcgtctacgagccttgcgggctccgggtctttgcagtcgtatgggggcagggtagctgttcyccgcaaggagagctcaaggtcagcgctcggacctggcggagccccgcacccaggctgtggcgccctgtgcagctccgcccttgcggcgccatctgcccggagcctccttcccctagwccccagaaacaggaggtccctactcccgcccgagatcccgacccggacccctaggtgggggacgctktctttccttycgcgctctgcggggtcacgtgtcgcagaggagcccctcccccacggcctccggcaccgcaggccccgggatgctagtgcgcagcgggtgcatccctgtccggatgctgcgcctgcggtagagcggccgccatgttgcaaccgggaaggaaatgaatgggcagccgttaggaaagcctgccggtgactaaccctgcgctcctgcctcgatgggtggagtcgcgtgtggcggggaagtcaggtggagcgaggctagctggcccgatttctcctccgggtgatgcttttcctagattattctctggtaaatcaaagaagtgggtttatggaggtcctcttgtgtcccctccccgcagaggtgtggkggctgtggcatggtgccaagccgggrgaagctgagtcatgggtagttggaaaaggacatttccaccgcaaaatggcccctctggyggtggccccttcctgcagcgccggctcacctcacggccccgcccttcccctgccagcctagcgttgacccgaccccaaaggccaggctgtaaatgtcaccgggaggattgggtgtctgggcgcctcggggaacctgcccttctccccattccgtcttccggaaaccagatctcccaccgcaccctggtctgaggttaaatatagctgctgacctttctgtagctgggggcctgggctggggctctctcccatcccttctccccacacacatgcacttacctgtgctcccactcctgatttctggaaaagagctaggaaggacaggcaacttggcaaatcaaagccctgggactagggggttaaaatacagcttcccctcttcccacccgccccagtctctgtcccttttgtaggagggacttagagaaggggtgggcttgccctgtccagttaatttctgacctttactcctgccctttgagtttgatgatgctgagtgtacaagcgttttctccctaaagggtgcagctgagctargcagcagcaagcattcctggggtggcatagtggggtggtgaataccatgtacaaagcttgtgcccagactgtgggtggcagtgccccacatggccgcttctcctggaagggcttcgtatgactgggggtgttgggcagccctggagccttcagttgcagccatgccttaagccaggccagcctggcagggaagctcaagggagataaaattcaacctcttgggccctcctgggggtaaggagatgcygcattcgccctcttaatggggaggtggcctagggctgctcacatattctggaggagcctcccctcctcatgccttcttgcctcttgtctcttagatttggtcgtattgggcgcctggtcaccagggctgcttttaactctggtaaagtggatattgttgccatcaatgaccccttcattgacctcaactacatggtgagtgctacatggtgagccccaaagctggtgtgggaggagccacctggctgatgggcagccccttcataccctcacgtattcccccaggtttacatgttccaatatgattccacccatggcaaattccatggcaccgtcaaggctgagaacgggaagcttgtcatcaatggaaatcccatcaccatcttccaggagtgagtggaagacagaatggaagaaatgtgctttggggaggcaactaggatggtgtggctcccttgggtatatggtaaccttgtgtccctcaatatggtcctgtccccatctcccccccacccccataggcgagatccctccaaaatcaagtggggcgatgctggcgctgagtacgtcgtggagtccactggcgtcttcaccaccatggagaaggctggggtgagtgcaggagggcccgcgggaggggaagctgactcagccctgcaaaggcaggasccgggttcataactgtctgcttctctgctgtaggctcatttgcaggggggagccaaaagggtcatcatctctgccccctctgctgaygcccccatgttcgtcatgggtgtgaaccatgagaagtatgacaacagcctcaagatcatcaggtgaggaaggcagggcccgtggagaagcggccagcctggcaccctatggacacgctcccctgacttgcgccccgctccctctttctttgcagcaatgcctcctgcaccaccaactgcttagcacccctggccaaggtcatccatgacaactttggtatcgtggaaggactcatggtatgagagctggggaatgggactgaggctcccacctttctcatccaagactggctcctccctgccggggctgcgtgcaaccctggggttgggggttctggggactggctttcccataatttcctttcaaggtggggagggaggtagaggggtgatgtggggagtacgctgcagggcctcactccttttgcagaccacagtccatgccatcactgccacccagaagactgtggatggcccctccgggaaactgtggcgtgatggccgcggggctctccagaacatcatccctgcctctactggcgctgccaaggctgtgggcaaggtcatccctgagctgaacgggaagctcactggcatggccttccgtgtccccactgccaacgtgtcagtggtggacctgacctgccgtctagaaaamcctgccaaatatgatgacatcaagaaggtggtgaagcaggcgtcggagggccccytcaagggcrtcytgggctacactgagcaccaggtggtctcctctkacttcaacagcgacacccactcctccaycttygacgctggggctggcattgccctcaacgaccactttgtcaagctcatttcctggtatgtggctggggccagagactggctcttaaaaagtgcagggtctggcgccctctggtggctggctcagaaaaagggccctgacaactcttttcatcttctaggtatgacaacgaatttggctacagcaacagggtgrtggacctcatkgcccacatggcctccaaggagtaagacccytggaccaccagccccagcaagagcacaagaggaagagagagaccctcactgctggggagtccctgccacactcagtcccccaccacactgaatctcccctcctcacagttkccatgtagaccccttgaaraggggaggggcctagggagccgcmccttgtcatgtaccatcaataaagtaccctgtgctcaaccagttacttgtcctgtcttattctagggtctggggcagaggggagggaagctgggcttgtgtcaaggtgagacattcttgctggggagggacctggtatgttctcctcagactgagggtagggcctccaaacagccttgcttgcttcgagaaccatttgcttcccgctcagacgtcttgagtgctacaggaagctggcaccactacttcagagaacaaggccttttcctctcctcgctccagtcctaggctatctgctgttggccaaacatggaagaagctattctgtgggcrgccccagggaggctgacaggtggaggaagtcagggctcgcactgggctctgacgctgactggttagtggagctcagcctggagctgagctgcagcgggcaattccagcttggcctccgcagctgtraggtcttgagcacgtgctctattgctttctgtgccctcgtgtcttatctgaggacatcgtggccagcccctaaggtcttcaagcaggattcatctaggtaaaccaagtacctaaaaccatgcccaaggcggtaaggactatataatgtttaaaaatcggtaaaaatgcccacctcgcatagttttgaggaagatgaactgagatgtgtcagggtgacttatttccatcatcgtccttaggggarcttgggtaggggcaaggcgtgtagctgggacctaggtccagacccctggctctgccactgaacggctcagktgctttgggcagttactcccsggcctcactttgcacgtgtgcttacctagtggagacaaaagtacatacctcggtagagcgcgcacgcctgtaaccccagcactttgggaggccaaggtgggtgtatcacytgaggtcaggagtttgagaccagcctggccaacatggtgaaactccgtctctactaaaattacaaaaatcagccaggcttcatggcacatgcctatagtcccagctacaggcrtgctgaagcaggagaatcgcttgcaccccggaggcagaggctgcagtgagctgagaccacaccactgcactccagcctaggcaacagagtatgagactccatctcaaaaaaaaaaaaagtacctacctcagagttcaaactagtgaatattaggaagtgcttgagacagtgacaccaaagtgcacaataaatactcgccagtttcattattattaaagaatccatttgaatgtcagctcaacacagcctcctataccgaggcattgkgaaccgcatctccccagcttctccaggcttttccaagaatcagggacactgtagcctgttggtctcagtgtatgacagacacggaggaagcacatctttagctgatacttaaacagagaccctgagcgcacatacacccgcgcacacatgcatggagcttcaccttctctgtcattctgcagtgaccaggagagcaagagctcccacctcccttcaaaacactgtgcccatcccgggcactaaggcctctttaaagcacggcacctccacgagggagggccacagccacatacactccacctggcaggtggacagcgtkagcaygtggaccatagcagggacaaggtgccccggccagccccaacgccctctgccgctgacagggacagaagccctctccagctgcgtgtgctgcagaggccatgcgtagcctccagctgcattctattccactccagtgcctgggccagttagcaccagtgtggaagacagtgagctggctccggacaacagggatggaggaaaggtcccacattcacattcctgatacgtggacaaggtgaggggccgcaatcgctctggcagcattttaaagatggggaagtagcagacacccacgcgtgaaggcaggagagccccaactgtggtggaaatggccccagaatggtagggccaagcctagctccagacaccccagagccctggagaagccaagactgagggagaaagcctgagggaggagcgccccagtccccagggrccggcctggtgcagagctgcagctgatgttcccctctgtgcagccccaccctctgcctcgctgagctccctgctgcgagggcctcgggtgcaagggggaggcaggtctctatctcatggagctgtcagatgagacatcgcgatcggagtcctcagcctcgcttggcggcggcggcgggtcgctaagcgggaccgcagtgaaagcaggagactttctagaaaaaaacaccagttgtcaaccttggggcagkcaggaatcctgaagacggacggcactcctcctcctgctgcctcaccctctggcagcccgtgagaagtaccggaagcgagggcggggccgcgggatggcsagggagcggcagggactgaactctctccaaacccaccctgacagggaaatgggccccgcctgtgtcttgggaactcagaggctgaggtcaggcatgatggctcacgcctgtaattccagcactttgggaggcagaggcgggtggatcacgacgtcaggagttcaaggcaagcctggccaacatggtgaaaccccatctctactaaaaatgcaaaaattagccaggtgtggtggcgggcgccttggaggctgaggcaagataatcacttgaacctgggaggcggaggttgtagtgagccaaaaaaaaaaaaaaaaagaaatagctgaagtcacagtaggagagaagctgctgagcctccagcaccctgactctagggccttggctttatgtctatctgcagtatttttgtgatttttaaaaattcactttcttgttgcrgtgtaacttacacagggtcaaatgcacaaatcatggccctgactttagataaaaatctgcccccacaacccttctgttccttgccagtttttaaactgcctctaaccaggggaaccaccagagctggtggccttgggaggtttcagccctcccgtcatgaatggacatagctcatccaactgccaagggagagagctgtgggtctgggccagccccaccaggtaactcccaaagggcagccccacagcaagatgtgacccagtcattgcctgagggtctctggggctgtgttccaacctttctccccgctgtgtccccctggaaggccccatgcccaggggaggcgcctaccggtctccagactgggtgatgagccggcggcaggtctccatctgcacgtccaggccgcgcttcatgctgcacatctccatgtactcgtgcaggtgccggttcatgtcgttcttggccgtggccaactccagctgtggtggggcaggcagggccatcggggttaacaggtggcgttcacagcgcctctgttgcccccgccaggaggccaacaygccaagagcagtggctgggccgggggcccaggcagccattactgaaggctcagattttaaaataaaccagaccaaggcagaaggcagcgaatacaccattgtttcctctgcttttcctggaaatctttgcctatggaggaatgcaaaggtactgctgcaggctgtgttcttttaagactgataagagtggtgaggaaagtcagtgtgggcgggatggwgcagatccacaggctcccagggccacacaggttcctatggggcccggctcacccctcatcccctgtactgcgctggtcctgggctgtcccctcactgcactgtgagctcccgtaagggttagcgacaggttttcctcatcctggcagacccagacctcgaagggaattaactctctctgtgacccgtggcatacaagcctggctaactgctgaaaggggcccaatcctcttaccattctctccttatcactttattttctcacctaaaagccattttcagacactaaarggaagactcccatattggaggtgccattgattctgagacstgtcytgatttcagaaatgtcacacgtggaaaacacggggctcagaatcaaagaaatccrgtctccctccccgggcccattctgcagcccacactctgaggcaggcggagaggcagggcccaggcagcacaaactcagtgccagggacagtcgactgcctctctttgttttgggtacaaagggcaggggccgcaaggggaagcaaaatgaaacttcctggagatgacgttcgtgactgcctgagwgaagagaacggggaggataccagctgccataatgtggattggacagagagggtgggaacttagagaaagaaggaaacaggttacagggccagacagcagagatggtcaggacagtgacatttggggtgagatggcggctggctgggtgagaagccctagtggggacagcttccctggcaggcttggatccacagctggggccccacagtagtgggaggagcaggacacggtgactgttcaacccagggggaaaatacagtgccaccagcccttgttcagatcagctgcctacaccccaatttctccaccttggaagaaccggagtgcagggagctgggttctggaaccatcactcagggagactgggaagaaggaaatgaaccaaatatattctactgaaatacaaggctagtactgccaccagtagtctctgcatatgtctatgtccccacttaattcacaaatttacagcaggaacaaggtcaggaggtgaacgtgcatgtcaggagatgtccttgacaagccaccttgaaaactgcaggctcrctgtgtgaacagacttgggggtgggacgggaggagacagagagaggtgaggagcggtggggaagaactgcctcccgcccaccactctgggccttggctttaccttgctccatcttagtgaccctgagagatcaaaggtcacaaagataaaggcaccttgggtactcctgaggtcagcaagtcctcctaacggttcccctaatgcagaagtccccaaaccccaggccacggaccagtacctgtctgtggcctgttaggaaccaggccraatagcaggaggtgagcagtgggcaagtgagtgaagcttcatctgtatttacagctgctccccatcactggcattacrgcctgagctccacctcctgtcagatccgcggcggcattagattctcacaggatcctgaaccctaccttacgtgaactgtgcatgcgagggatctaggctgtgtgctccttatgagaatctaatgcctgatgatctgtcactatctcccatcacccccagatgggaccgtctagttgcggaaaacaagttcatggctcccactgattctacattatggtgagatgtawaattatttcattatatattataatgtaataataatagaaataaagtgcacaggccgggtgcggtggctcatgcctgtaatcccagcactttgggaggccgaggtggtggatcacctgaggtcgggagttcgagaccagcttgaccaacatggagaaaccccatctctactaaaaatacaaaattagccaggcgtggtggcacatgcccgtaatcccagctacttgggaggctgaggcaggagaattgcttgagcccgggaggcggaggctgcagtgagccaagattgcgccattgcactccagcctgggcaacaagagyaaaactctgtctctaaaaataataataataatttttaaaaatagtaataaagtacacaataaatgtaatgtttgaatcatctcaaaatcatttcccccgggtcagtggaaaaactgtcttccacaaaccagtccctggtaccaaaaaggttggggactgctgcctaaagtcattgcactgggagagaggaggagtcagatgatttgaaaatacttttttttttttttttcctgagakggaatcttgctctgtcacccaggctgtggtgcagtggcacaatctcagctcactgcagcctccacctcccagattccagcaattctcctgcctcagcctcccaagtagctgggattacaggtgcccaccacaatgcctggctactttttgtatttttagtagagacggggtttcacatgttggt

SEQ ID NO: 13259 - DNA, 387780 bp, Homo sapiens
  misc_feature (1)...(387780): n = A,T,C or G, or insertion/deletion polymorphism (see Tables 1-2)
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcctgtggctttaatttatcgagcactggcatgaatattccttccaattttatattttagacatgcctccagtggcattttttgggaacttcgttggtattatactaggagcaggtgattcaaagtaaatattcccagtctagagagtgagatggacactgaagagggacagttcctcaagakgtgaagtgacgtttgattcactgcatgactgtgtgggaaaagggaatccccaaagttctctcagatggtggcccatgagtcaccatgtagacaatggtggggcgggtgctttgtggccaagtgtagagacttggagaaggattggagaagaggttgatgtggtaggatgtggaagggatgggagccaggggcttaagatacaggggcacagtgagcagagactagattgaaattgagaagaaggtaggtcttaatcctgccaccaggaagatgagatttgtgagttgtgctttagaaacatccctctgttggggctcagctgtacctccttcacctccaggttgtgttggcctccctgtgcattgcattgagaggatattcaaactgaaggggagaagcacggattctgaaggatgaaaaaggaacaatgtgagttattccatgtcttagagatagtgtggtatgacagagagagtgtaaactctggtatcacatagtcctgtgttggagtccttcatggaatctggctctgtcccttgcttggtgaccttcggcaccttttttctgagcctcagtttcctctcctttccacttgcgctgccaataccccctgcagagtatggtggagattaaattgggatyttataggccaagtatgtggcatctgagaggccctgaataaaagtcagttgttctacactgaaccctgtccacatgtgggattctcggcaagggcttattggtgcttgtgaaacctaattaatcagaggtgggaagagagagctggcctttggaagggcttgcatttcataggagtaaacacactgtcaatatcaagaggagctgagtccctgggaggaaggggtgagacatggtggctcctgggaggccatgataactcttactggcaggtataaccatgaagtccccattgctctccggttctttaaaatatcaagaaaagcaggtaaaggcttctcagctctggatggcttaaaaatagccactgaacagagtggccaagctgttttccccatgacctggcacctgaagtcccccttcccacccactcctgctctgccgtctctgcccagtaatgactcctcatgtatcctcatcctagacactccagctaggaaccttgatatttattccatgcatatttgtttgcatttacattgcatgccggtggtattctaggggcgggacaacagtagcaaacatgacagagaaaaatccctatcctcatggactttacattccagtggggcaacagatagcaaacaaacatgaaacggatggtgtgtgagacgacaaatagtccttatggaagaaaaatcatctggagaggaggctggggcatgctggggagggtgtgcattgttaaatggggtgttcaaggaggctttccctgagaatgtgacactaagcaaagacccaaaggagctgagggagtgagcacacggcagtttggggagaaacgattcctaggcacagggcctgccccatgcagagaccctgataactgcatgcatggcacattaaaggtacctcaaggaagccagtgtggctggagtggagtaagtgacaagaaagttggtgcaggaaaaggttgatggggtggggatgagggcttaaccttgctgggcattttgtggactttagcttttgctctgaatgacaaaagcagctcttggagggttgtgagtggaagaatgatatgagcttggcttaccctttttttttttttcctaaccagtgtattagtttatgctcacactgctataaagaactacttgagactggataatttataaagaaaagaggtttaatcagcacatggttctgcaggctgtacaggcttctgcttctggggaggcctcaggaaacttacaattatggtagaaggcgaaggggaagcaggtacatcttacatggcggagcaggagaaagagagagagaggaggaagctgtcacacacttttaaacaagcggatctcgggagagtttatcatgagacagcactagggggatggtgctaaaccattagaaacacctttcatgattcaatcacctcccacaaggcccctcctccgacactgggaattacagttctacctgagatttgggtggggacacagatccaaaccatatcaagcagtatttgctgtctgcaaatgcttaatgctggtgagagtggaagcagcggcagtggtggggacggctgaactctgaaagtatggatttcttcttcctccctcaactcatccaaaccatggctaagctgggtcagttctaccttggccattgtagggagattgggaggactttggagatactatacatcaagtttgttagtctgtcagccgctttagaacaggaatgtgtcttctttcttaagtgtccttaaaacctagcccagtgcctgacataacttgtaggcattttaaatgcttatgatgattagcctgtcattctctgatccctaagattgaatttggagccatcttcagtgctcccaggatcccccttatgcttaaccttttcaaaacatctgtcactctgatctttcattgtctgtctgttccctctgctggtccatgagcttcatgagacccatgctgttttttgttctttgtgttttttgagacagagtcttgctctgtcgcccaggctggagtgcagtggtgagatctcggctcactgcaacctctgcctcacgggttcaaaggattctcatacctcagcctcccaaacagttgggactacagctgtgtgacaccatgcatggcttatttttgtatttttatttacatatatatatatattttgagatggagtctcactctgtcacccaggctggagtgcagtggcacaatctcacctcactgtaacctctgcctcccaggttcaagtgattctccttcctcagcctcccaagtagctgggattacaggtgcctgctaccatgcccagctaatttttatatttttagtagagatgggatttggccatgttggccaggctgatcttgaactcctgatttcaagtgatttcgcccacttcggcctctcaaagtgttgggattacagggataagccattgcgcccggcctgacccacactgtttgtccactcttttwtttatttatttatttatttatttttattgagacggaatctcgctctgtcacccaggctggagtgcagtggtgagatctcggctcactgcaacctctgcctcccgggttcaagcgattctcctgcctcagcctcccgagtagctggaactacaggcacctgccaccatgcccggctaattttttgtatttttagtagagacagggtttcatcgtgttagccaagatggtcttgatctcctgacctcgtgatccgcccaccttgacctaccaaagtgctgggattacaggcctgagccaccacgcctggcctgttttgtccactcttgtaagtgcagtacctgtctctgggcctgctacctggtagatgctcaggaagtgctcttttaaatgaatgaatgcacctggtcccttttatcacctgctgagaagggcagtgtttccagccagtatctcttccaatcccagcatgtcactgggaagattaaattgtttaaaaaaaacaaaaacaaacgctgagcctacaaggtagcctctgggctttttgaagggaagagcaaagtcagagagctgttactgtttgaatcagcggtgctgaagggctcttgggaagtggagtgctctccgaggcttgtctacatggcagaggcatgtggataattgcatcaggagagtgggggctaggccgtcagaccaataggctgggggtgggccggagtcctcctgggctgggagatctgggacagtgttttccagaaattctggttgactgagtttgcctgtatagaccagagaatgggcagccgcagtctcatgtgaggacattttgcaactctcccattttcaagctcagctcacatttattgatttttttttaacctcaaggccttttatagtttcttttgttatccattttaaattatatttttgtaatagctttattgacatataattcacatgccatgcaaatcaccatttaaattgcagaattcagtggtttttaatatattcagagttgtgcagccatcgcyrcagtcaattttagaacattttcatcaccgcccttcaaaaaaaactccatccatactcattagcagycaccccccattttcccaattctcctcccccagccctagataacctttaaagtactttctgcacaattactttttctcctccaaatgtaaacatagtaaatgctcataacagaaaattcagaaagaacaagaaaagataaagaagcaaataatsatcatccataattatccagccaatgagagataaccacttttgtctctctatgctgatatactcatagacacatagtttttgcgaacagtgacatcttacacattcttttcaacttattccttcatataatatatagggactctccttccatgttgaataaatatagatttacatgatcatttttgctggccatggatagatcataatttatttgactggttcttttttaatggacatttaggttgtttctagtttttgcwtgtacatacttgtccaaatacttacttttgacaaattcccagaggtggaatttcagggacaaagggtrggcacattttcaagtgttgtacatattaccaagccaccctccagaaaggtttaccaatctgtatttctatgagcaattttgcaagtatacatttcttgcccgccccaggcattatcaattatgttaatttttgcatagctgatggactaaagataaatgttctttatttgcatttttaaatttaatgctaaagttgaacatatttcccagctatgcaggtggctgatgcaggagaatcgcttgaacctgggagctggaggttgcagtgagccgagattgacccactgcactccagcctgggtgacagagcgagactctgtctcaaaaaaaaagtataaatatggattgtaatagttgttgtaaactgaccgaaaccaatggcgcaatttagttctattacttggtactgtgcttatacatagacttggattctagacctgactttgccgtcaactgtgacctcaggctgcttaacctctgaggacctcaatttcctattctttaaagtgttggaggtgaagcagatggatatttgaggttgtttccggatccatctttatcattccatgttaagaataatagaaggcagcagtggaggaaactgaggcttcagcctgcttactggcttgctccaagtcccagaattcacaaatgacagtggagatttgaacccagaacttgctatgaacccaggaccaagcctcttgctgttccctggctcctgtcccctttatgggaaatgaaccaagatttgtcaagatgattgttaatctccaggcctacttcaaggagtgtgaatcccctccaagaggctgatccatgggagagagttttgggagcacagagaaggaagggtttagattattagatttctaaggacaatggaatcttgacagagacagcttaggaggaactgcagagaagcccgaggcaagggagaaggcgggaaagtacactgtgtaagagacaagcacagcccagggagcaggagccaggaagcgtgggtgatccgagcctgggaatttacttttctatcaaggaattagaaagtcaggcctcatctggaaagggctagattagattaaatcagtgtttctctgtagtcacagtttatatgctcctggaccctcaccaggtgactgtgatggtctggctccagagtcctcatcggcttcatctccacgcccccttcttccctttcctccccttcctccacctgcagctgttgttgaagatgtgcccatccccctcaggcctccacactgtggctcaggttggtctctgaaggcctgtaaggtttgtctacatgatgagctccttattctgagctggagtattcccctcttccaggaggccgttcctgaccagcctgattctgggtagaattgaccaccttcttgtttgtgcccaccccctctaccttgtacatttcactgtctgttttgttcatacctctgtctcccccactattttgtggctttctgagagcagatattcttatattatgtttatttggaactcacaggatttctcacatagtaggtattcaggtgaagccttttttggatgaattaatgaaaccttctgtaattcaattcagtagacacatattaaggagactgggatggtgtattagttagtaatatagtgataatagctgcaataacaaatagtccccacgatgtttattggctcaaacacaagaaatgtttttccttcttcatgtaaaagcccaaaatgtgtatttctagttcggtgggagtctctcatccatgtggtggctcatagacctaggcctctgctacattctgtggccctgctgccccctggagctttgttgctgtcagcttccactggcagaagagggaaggagcctggagaaagcacacccacttcttaaaaaccttggcctgaagaatggcatgcaacatttctatctcattccttagctagaagtctgacacatggtcacacccagctgcaagggagtctgggaaatgtagtctagccatgcacccaggaggaagagaaaacagagttttggtgaactagcagtgctgccacagatggtgaatggggctcaacatcttgtcctctgaggcttggttgaagggatggggaatgtttggcttggagaagcaaaactcctgataaagtgatatttgtgaccagggctataatttgccaacccctagtctggagagatccaaagtccctcccaactctagacactgtgatttttttgttgttgttgttatgcacccagcgtatgcagaacactaagactgttgctggtaggaggggaggagagaggcagaggacaagcaagcttgaagtaatttgcccaaggtcacacagctagtaagggatggagctgagattcgggtccaacaagctggtaacagagcctgcctgcttagtrgctatactgtatgttcctcattggagcccgatacccattctaccaagtaggtattattattgccagtgagggaagactcataattttgtgttaagaggaatgaatgaagtaacttttttttttttttttgagttggagttttgctctttttgcccaggctggagtgcagtggcgtgatcttggctcactgcaacctctgsctcccgagttcaagtgattctcctgcctcagccttccaagtagtgggattacaggtgtgcaccactacgcctggctaatttttgtatttttagtagagatggggtttctccatgttggccaggctagtctcgaactcctgacctcaggtgatccgtctgcctcggcctcccacagtgctgggattacaggtgtgagccaccgcacctggcctcagtacttcatttatatttatggctgaataattgcattgtatggctgtaccacacttggtttatccattccattccttggctgataggttttgggttgtttccacctcctggccatcgtgaatagtgctgctatgaacattcatttacaagtatttatttgaatgtacattttcacttcttctaggtatatggccaggagtggaggtgctgggtcatctgataacccatgttttgacttttccaaagtagctgaaccattttgcactcccaccagcaatgtatgagggttccagtttctctacatcctcgccaagacttgttattgctattktgtgtgtgtgtgtgtgtgtgtgtgtgtgtgtgtgtatttcattatggccagcctagtgggtgtgaggttttatcttactgtggttttgatttgcatttccctaatgactaatgcctttaagcatcttctcacctgctttttggccacataaaggaatctttaagtaggtgtaagctggttggctgggcgtggtggctcacacctgtaatctcagcactttgcggagcagagatgggaggattgcttgagaccaggagttcgagaccagcctggtaaacatagcaagacccccatctctattaaaaaaaaaaaaaagaagaagaaggtggtgcaggcagatgtagggaagctccagggatagcaaagccccaaggctcctgtgtgtgcctagttttgaggagcaaggaggaagagttattggaaaccggagacagcgagggctgtgcgaaggagccctggccagagctgaaacttggattgaggccagcagccgtttcacagtgacccctagagagggagccccagggaagagatcggatgcctcagcctccctctycctccctcctgtcttctgctggggctccctgttgctraaaccaccctgtagcagaggaggagcaagcccttgcactagtccctgaggtcaatttggggtgcagagtcagacggaaaagggaggaccagtggagggggactggcacagtggctgcgcagcttccttttcccgtagttctttgggttcgaccttcctatgttggcatctccccaagactggtagtgagatcggctgcagccgtttttagcttcacatctttcttataacatccaaaagaagggagaaaaccccatttcagaaacttctggacaaaagagaaagggctttctcagaaacctccagcctcatatcttattgaccccaattgggttacatattccttctaaagtaattagtggcagaygatggggatggttttaagccagtgaggcccacacctgggactgtgggcacatgtacttcatgggaagggagatcccagttgaaatcagcaatgaggagcgatgctgggcagaaaacccatagcgccgtgtccttggggagtccttggaccatctgtttgackgaagcctcggtttttttctgctccaccacacactggctggggtgagacaatgcgtgcgggaccctggcctccaggaagggtccctgccctggctgcagggcctgatgtgccatgttcggctcaggcctgctgaacagcaccatttccagcttctgccttttaccaggcctcttagggagggtctcctaagcctctcattcctgtggcccatgtcgctgaagggatgaactgaagccccttccacagcagtgattccagggattgagacttcactccatcagagccacaaggtcagagttcaactaggagtttagggaaggagatctttttgtagattttgccacaaaagaaagaataattaaaaaaaaaaaactcctattttttttggcacctattgtatgattctatccaaataggcaaagctatataaacagaggttatattgttatttttgccgggggtgtgtagagggtggaacggggagtgactgcttatgggttcggggtttcattttgaggtgatggttgcacacttctgtgaattatgctaaaaaccattgaattgtacactttattttatttatttatttatttatttatttatttattttgagacagaggtcacccaggctggagtgcagtggcgctgtctcagctcactgcaacctccgcctcctgagttcaagtgatcctcctgcctcagcctcctgagtagctgggattacaggctcatgccaccatgaccgactaatttttgtatttttagtagagacgaggtttcaccatgttggtcaggctggtctcaaactcctgacctcatgatccgcccgcctggccctcccaaagtgctgggattacaggygtgtgcgaccgtgccgggcctgaattgtatactttaaattgtgattaattgtatgtgaattataagtcaagaaacctgttggaaaaaaacattaaagaaagacttatgctcctattctctttgttttatttaaggctgaagttgattgctaccttattctctgataaaaattatggtttacaccatctcctttcctctcctctctcttctgtccttgtggccttggggcaagttctcctcccctcccttggtctgtgggtcttgtggagctgacccgctccccgtgtccatctgggcacataagcaatacctggctagtccagtgagtgttccagcccctggccacagaaattagttcaaggatggatgaacagtcagagtcaatcctgagacttttattrgaaccaccagtacagcgaggctttcctgcagggattgctgaattgtgtctggatgtaagcctgaaagccagtggcccctttggtgagatcctgcctgaaaatgccatccttcccctgaacagaaatacagagccaacagatgaagactaacctctccctgaccacatcctctgagcccttgaatctagccaggcctgaatttccatccttcctggacttgtcagttttgtcagcccatgcatttgcctctcctttttttttttttttcccctgaagccaggacttgtggggttttctgtctcatgaagcatgtctaggtatgggttctgcaaattcggaccctccagcctgaccccttttcacaacaatctctgaacygtgagaagggactgctctttccgcccgtatcwcttgtgtcagagcgagccaagaaaactgcttccacagaggaaacgggctgacaatggaatgtcccgacccagcacatgaagtcctttggaagggcccctggaagggcatctgggaaccgcccagcatcctttccatgggcccacagggaacagccctgctgctgcggcacatagtccattgcatttgtgtatgtgtgtatgtgtgcatgcagttggacttgggttgtatatctgtctgtctgtatgtgtgcagttgtacgtgggttgttttctgtrtgtgtgcagttgtacgtgggttgttttctgtgtgtgtgcagttgtacatgggttgtatttctgtgtgcagttgtacatgggtttcacttctgtgtgtatgtgtgcagttgtacatgggttgcactttgcatgtgtgtatgtgtgtatgcagttgtacatgggttgcacttctgtgtgtccatatgcgtgtatgcaaatgtacacagatgtgtgtactgggagctatggcctttatttcttccatttggctatgtattatcccacttgggtcatagtcattcaagatttgatgtgtttataacagaagagagaaggttgccccatcagctcaggctgccgtgataccagaatgggaagtctgatgctctttcccacagtggttgtggcatgtggtcattatgatttctgttttaccactgtggcatcagagtctccgaggagccagtggactttccattaggtggcagcctaagcaggtagctgagccaaatctcctgccccttttggggcactaatgcattctgcctcagactaattccttgtagttctctgtcattcaggggaaatagggttcggaaaggtgggaagccttgattgatttctaagagaaatctagtttacagcagcccccagaagatgacagtcaggaatacctattttggagatagttgcaaagcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagtcttgtggaaattggttgatccttctaagtttacaggcagtaaaatttctaagaaatggagatggattttcagaaagatgtttgaggactggaacagtggtgttccctggtcacaggactttgtcagggttggctgaaatgtaatttgttgtaggacttccagtggaagggccagtgttaggtctcatgaatattttcctgtagtttttttttttttttttgagatggagtttcactcttgttgcccaggctggagtgtgatcttggctcactgcaacctcygcctcctgggttcaagcaattctcctgcctaagcctcccgagtaggtgggattacaggcacctgccaccatgcccggctaatttttgtatttttcgtagaartggggtttcaccatgttggccaggctggtcttgaactcctgacctcaggtgatccaccagcctcrgcctcccaaagtgctgggattacaggcttgagccaccacacctggctgttttgttttgttttgttttgtttttttaagagacagggtcttgctgtcttgctgtgttgcccagactggagtgcagtggcacagtcataggtcattgcagcctcaatctccagggctcaagtgatcctcctgcttcagcctccagagtagctgggactataggtgtataccaccacaccccactagtttttaaatttttttagagatgaagtctcactatattgcctaggctggtcttgaactcctagcctcaagctatccttctgcctcagcctgaattaccctgtagtttaaaargcatccccagtttcccattttgacaatgcatatagaagtcttcctgatgcttcccttatttgtttttatctaattctgttaatgtattcatcaacagataatttattgagcacctgctgtgcactaggcattttaagagttatggaagtgtgccgggcacagtggcttacgcctgtaatcccagcactttgggaggccaaggtggggggatcacctgaggtcaggagttcgtgactagcctgaccaatatgrtgaaatcctgtctctactaaaagtacaaaaattagctgggctgtggtggcgtatgcccataatcctggctacttaggacgctgaggcaggaaaattgcttgaacccgggaggtgaagttgcagtggaccaagatcttgccactgcactcctatctgggcaacagaggaagaccctgtctcaaaaaaaaaaaaaaaagagttatagaagtgaacaaacaatattcccaccctcataaataagacacgtatatcaagaaaaaagaatttcattgttaaatagatcatgtactttggctgatacatttgcaatattttgaggctagagggccaaataattggccaagagaagcatcagttatgtgtgtatttctggatggaaatcacaaggcctgattcacagcaggcacctgagtttaatattattaatgccagttttacagatgagaaaactgaggttcagagaggtaaggtggcttgtccaaggctggtagagggaagagccaggactctcaaactcttgccccttaattctgaaaccctggnnnnnnnnnnnnnnnnnnnncctggctttttccttctgcttctctgcacctttcaggtcaagaaccttgtaaatgcaaatctgcctgtttgtataggtggtaacaaggttttagatggaagcacagacttaatggcttgaaacaacacacatttattatcttaaaattctggaagtatcgtcattgtgccttggacatggcagatgggtcagcaaacattygtccartgaaaggtctttctaagactgtgcctttgaacctactgttctgtccattcagaattccctcttcctacctttctgtctggtgtactcctgttcatcctcaaaaccagaagctgctactatgtcccccatgaagccactcactatccagtcctctgtattattttctctactttatagcaacttctgttcttgcaggtaccagcaatcatcgattcacctgtctgccttacagcagaggaaaatgcctcacttgggtgggctcctcataggcaactgttggagtgttacataaatgaatgaatgaatgaatgaatgaatgaatgaatctggcaaaatagaagatgcagtcaaatatatatttcatattttaacaacataatcggcactcattagatgttatctgtggactgacaagtgaggaactgatctcctttttttaaattaaaaatgcagatatatagggattccatgagatttcagagccacagatagatggtagtgggctgctgtgtggggtgaaactttatgcaggcacagatatgctttgatggatttttggggaagtctgaaggagatgattcaggctcctcatttttcaaacttacagtcttctaaggcctgatctgggctttatcttgatgagatttgaacatttcttagatatactttatttcctttgattctgagatgtctttgatttcaagatgcattattgatatcatagcagtgttgggagagaaaatagttctgccacattatattttattgataggagacacgtcctgtttcagaaatgctaaaatgtgaaaatgtggtcatcataaaatggaggaaatacggtaattacaaagagtgtggtcaagtgggctgatgttaattggacctactcctaagtgttaggaatgagctcgagcgaggctggtcttgttagtgtgttaaagatctttttttagttctaaaactagaagggaaatacatgcagcagagacctctcctgaggctggccctgctctgaaaggctggtgagatttaaaggaaagataagtctttgtaatcagacagacctaggttccatttattagctgtaaaaactctggcaagatactcatcctgtatttgcctcagtttccttctctgtaaaatcaaacagcaatacctgttgcctaggtttgttatgaaggttaaagaagttattgcttgtgtagttagtgtcagatacacataataactatgcaatatatgctagctttgttatttttaaaaattgtggctgggcacagtggctcactcctgtaatcctcacactttgggaggccgaggtgggtggatcacctaaggtcaggagttcgaggccagcctggccaacatgtgaaacctcatctctattaaaaaattagccaggtgtagtggcatgtgcctgtaatcccagctactcaggaggctgaggcaggagaatcacttgaacccaggacgtggaggttgcagtgagccaggatcgcaccactgcactctagtctgggtgacaaagcaagactccatttcaaaaaaaaaaaagaagaaaagaaaagaaattgttatttattctgctagactcgtattaggtcattcttgcattgttataaagaaatatcggagactgggtaatttataaagaaaagaggtttaattggctcatggctctgcaggctgtacaggaagcatgatgctggcatctgctcggcttctggggggcctcaaaaaacttaaaatcatggtagaaggtgaagggggaacaggcacgtcacatggcccaagcaggagcaagagagagagcaaggcgcaacacagttttaaacgacacatctcacggaaagtcactcactcactatggcaaggacagcaacaaggggatggtggctaatcattaatgagaaatctacctccatgatccagttacctcccaccaggccccacctccaatactggggattataattcagtatgaaatttgcactgggacacagatccaaactctatcagacctgttgttatttattctattaaaattgttatttatcctgtaagggctgttgtttcctctgtaaagtgggatgacattcctagctgtacctctcactgctctgggctgggtgaagactcagcgtgattgaaaggggctatgtggccgatacccatacagggcctgcgtggtacctggtgagcactgggtaatgggggcttcctgcgagggagtaaactcctttccatgcagacccctttccatcctggttcccttttctttggacagggtggaggctgggacactggggtgctgctcctggaaggtgacttccaggccttggttgtattctctctgtcactgggacagtggtcagtggacaccaacaggatttccagccacataaaacatgcctatggtgctggccttgctgggaagccgctgagtcaggcccctgggctgcagatgtcatttctagttttgggctgtcataatactggcagttgttcattgtacacctgctttatgctggcatttctacacttatacaacttcctttttttcctcctaacaacactctgttaaaagtatcatcatccctgtcttagggtggtttccccaagaagccagcactgagaaaatattggagcatgcatagtttctttgggaggtgatccaaggaaacacaggtggaggaatgaggaagggagacagagaagagaaggagccaacgaatagcatgttatcaggcaggaaactagggtttcattcctctggggacctctcaggttgtcagaaccaargggcaaggagctgggatattgtttcctgatttccactcatccttgtctgaaggccacagctagaagcattcatttcctggcactccgagcctgtgccttggtggctgagagcaagctcttggggcagagtggcaggtgttgcttgcagtaagatgcacctggcctgtaatgacctgtgagagtcaaggcattgtgtgtgggcatcatcatagtctgcagaaatctccatttttcagaagaagacacagggctgggcccagtggctcatgcctgtaatcccagcaatttgggggcccaaggtgggtggatcacctgaggtcaggagttcgagaccagcctgggccaacatggcaaaaccccgtctctactcaaaatacgaaaattagctggacatggtggtgggtgcctgtaatcccagctacttgggaggctgaggcaggagaattgcttgaacccgggagacggaggttgcagtgagcggagattacgtcactgcactccagcctgggcgacagagcaagactctgtctcaaaaaacagaaaaagaagatgacacaggttcccagaagtgatttttyatcactcaagatcagccagaaattaggtgggagagccygtgttggaatgtgtctttctgtcccaagggctctcctctttgctgtgcttgggaaattcccccagccctgggctgcagcatgagggrgcagctgcccagatggctctgcgctcagcatactcgctgagagtgaattcaagattgtttgaaatgaccttgaagatatgatcacacaatgggcagcmcarcagaccctaggctcccttggatttcacattccacacttgcacttcttcccaggggaaccctgaagaaaatgtataatttgtggtggcccagactgggttgagcctgctcctgctggcatgaggaktggattgcgtggctagttagtgagcctagcctccctccgartatagaataaacttgagaactctcaagtttatttcgttgttctcttcttgggggtcccgaggctgtttctctggcattcacttattctaagagtcacaaaattcttaggatgtaactttttaaaatgctgaggatttattaatcgcttatagtaggtaggtcctatggtaccagtacgtgccctttttcttgttgtcggtgaggttttttgaygaaggtcttattccttaagcagagaccacgtctattttgctaaccaatacttccttgatatttagcttaatattttttcttcagtatattagtggatgaatagatgcattttcccagaagataattctcactatgggaagctgtagccaatggaaaatagcatgcagtaggcacttaagagatgtttggaaggcaggtcctatgacattrtgttcacacccagatgatatcactgacaaccattcatcctgtctgtttctatacctgtccctgccccaccagactgtgagctctctatgggcaatgaccttgtgttactcaactcaccctcctcactgtcaggcccagtgcctgcartatactcagagtaggctataagacatgcagtcacagttgtcatgagtgtataatccagcaagacagtggttctggtcttttgggttgtgggtccttcacagtgacctcttctttggagaggaaagacccaaaccatctttgattgttatcatttgaatcaacaaatgaggcgggcggttgggggcagagccaaagctaaggtccagcagcctcggcattgtcagggagaatacctcagcccttcttggctttcttcttggggtgggcttctgcaaggtctcctctgtatctctctgaactgtagcctattggattatcctgggaagatagagttatcagaagggcccatctcaaacacatgcatgctggccagggagaagagggattaggaaaaatagcaggagtccaaagttacctggcctgaggttacagatgcctaaatcagggctgatcagggttggtagggaggcaggacttgttgcttgccagcagatayggaaactgaaagacctagcgattagtacaaaatccccaygaccaattcaaatggtctcagcatttacattcaagaatcaccacaggagaggaggttttttgtktttttttttgagacaccgtctcactctgtcacccaggctggagtgcagtggcgcaatctcggctcactacaacctctgcctactgggttcaagctattttcctgccccagcctcccragtagctgggactacaggcgcctgccaccatgcctggctaatttttgtatttttagtagagatggggtttcaccatgttggccaggctggtctcgaactcctgacctcaggtaatccacccgccttggcctcccaaagtgctgggattacaagcatgagccaccacatccagccaggagaggagatttgacttacctctatgaacaatcaggaaatgataccaaatggggtgtgtttggtcatgatccatagtgccttgcttagcacagcagataaagttctgagctttgaaatcgagctctttcaagtttgagttctgagtctgccaccactaaccagctgtatgacttgggaaatgttatgtaactttggtgagcctcagtttccttatctaaaattcagacaatcacarttccttgcaaagttccttgtaggatttaatgaatgtgcctaggatggggtctgatatgtaaaagggttcttcagagaaacagaatttataggatatatgtaaggggatatttattatagggaattggctcacccttataataagtggaattgattatggaggctgatctgccatctggaagctggacaaccaggaaagccagtggtgtaattcagtcctagcccgaaggtctaaaaaccaggggaamtgatggtgtaaatcccagtctatgtttgaagttctgagaaccaggagcgccartgtccaaaaaagaagatgcatgtcccagcycaagcagagagcaaactcacccttcctgctactttctgttctattaatattatgccttcaatggattggatgatgcccactcacgttgggaagggtactcttccttactcagtctcctgattcaaaggctaatctcttgcagaaacaccctcacagacacaaccagaaatgctgttttaccagctatctgggcatcctttagcccagtcaagttgacacataaaacaamaataaggggttgctatggttattagcagtgctgttagagttcacaagtggatagattactgggctgggaaagtttgagagagcttcctggaagaggtggaatttcaactgggactagacaagttgggcttctgatcgcttaagaggaatcgtatcacaaaaatatatttggtctattttctttaggtccctgattttctaagtacagcttccacagaacaggaaagaattacatcagtaaataggaaaagtgcttggtttgatattatggggaaaaaattgtccaagctgtaaccagctgcagatgactcaagagtttataacatcctctataaaaggatacaaatcccaacattcgtggagtcacttctgttgaataaaaaacacctatttgaggaatggcaataaagaagggtttatgtaccaaatgatttatgtccccgattcctgcatggcatcaggaattcctgtcctgactgacaaactgtaagtcgtagaacagaatttcagtggaaaagcagaaacgtgggtggtaacaaatctgatgcttgrtggtaatgaattctggttcactttagcaggcaggtgctttaaatctttctgtcgctggtggcagcgggaaatgagaggttgtacagaagaccgtgggggttgacagacattgttcactcactccttcgacagatatttattgagmgtctatgtacagatgctgccgctcccctgctcatgtctttgagtgctccccggaaggcactgcagacagtgcycattcacacagagggcttcctgcatctcagcctgagactatgccctggttgtgtctgggcagttagggatggaaggtggcaggtaaatgccccagattcctttcccttcggtggggcaattctgagatgtgctctccrcagtctctcagaaggtcccttagtgggattgagcctgaggtgcccaagcaataaccttggacacgttcctcaatgtctgagtttcagcttcttctaggataggtatggggattaaacgaggcagtaatatcactaccaccacaactagatcccatgcattcatcagttacggggagccaaccattttttgcttagtgctttaatcatgttctcttattaattcttgctatgactgcatgaggtaggtactttccttatggttactagctgtgctgtaagagttcagaaatggacagattgttgcgctgggaaaattggagaaagcttcctagaagaggtggaatttcagctcggactggacaagttgggcttcagatagcttaagaggaatagcatcataaaaataagtttggtctattttcttttaagtccctaattttctaagtacagcttccacagaacaggaaatccaattttaaagatgagagaactagggcaggcacagtggctcattcctgtaaccccagcactttgagaggccaaggcaggtggatcacctgaggtcaggagttcgagatcatcctggtcaacatgatgaaaccccatcactactaaaaatacaaaaaattagctgggcatggtggcacatgcctgtaatcccagctacttgggaggctgaggcaggagaatcrcttgaacctgggwgacggaggttgcagtgagcagagatcgcgccactgcactccagcactccagcctgggtgacacagcgagactctgtctcaaaaaaaaaaaaaaaagaactaaagtatgaaaggataaataactcatcaaagattcataatctggattctaacccagatgtgtttgttctaggggccaacttttaataagtcatactgttagagtacaggatctggcaaggaagctgtcatcatcattatcatcatcatcatccagtgcccagtactggatgtgggtgacccatgtttatggaatttaagaataatgaatgaatgaatgaatattagtcctttaagatcatgaactttcttttcttttgttctttgytctgtctttaggcagcaggagcagtccctggcacagggtagttccctgcttctaagaaaattatggtaattgaaatgtattctttgttttacccttaacaacaacaacaacaaaaaaccaacagaaagaaaagagtcccagaaatgaaatcgccttagtataggaacagtatttatcttcaggtattgggataataattgattttaattttatgccttaatattttttctgatgaacctagattactttcttgactagtataggaacagtatttatcttcaggtattgggataataattgattttaattttatgccttaatattttttctgatgaacctagattactttcttgactagaaagaaataatctctgtttgaataaaaaatcattctcagagcatcagatgggtctccaagtgccgtgggtgaggtacggacatagacgtagctgctaacctacttcgaattagttcagagtcaaggcagcagaatgtgaactgactatggtgtcacacctcacacagctctttcacacttcatctctctgaaggttcacgatggtctagtgacgtaggccaggctgggattagtggcctcatttcataaacctgagggctaaagaggctcgctgacaagggtgaagctctccataggggtggaattgggactggaacttttgatgttaggcccagtggccttcccccygaccccagcagcctctcatgaagacccactgaaggaatgggacaagagtggaggtaggttggtacatcacagactcatggggcagcatctgcaagacccttytatgatttatgcagaggaagcctggcttggagttttttagaccacccrggtcaggatcttagttctgccrcacactgtcttggacacgttatttcatatcttgtgagttatgatttttttcatctataaatctggcccagtgtctcccttgcaggattgttgtgtgagtccarctggcaccaaggaggtgggaattctgcaagaacagctgtcagtggtcatcatacttgtgctgtctatgtgcatggctttattgatactcggtgttcataaattaatattcccatgtgaattaggcagttttttctgagtagcaaaaacctcaggatttcagaggcttgtttgacagcagatatgtatcttcatgctcaaggatctatgggttggttgtggtttggctgatctagttgcatggctggttcatgccggacttgtggttgattgggatctgctccacatgtctttgatctgagttcagactaaaaggcagcaacagacagcggctatggagacatattccttttgtggtgcatcataagagggcaagaggaatagacttgggaacagcacactgtcacttctagccacattccattggctacagcaagtcagtgatccagtccagaatccagtgggacagggaagtaaacaccattcactctagtgggaagtactacaaagtcccatgacaaagggcagaaatgtgtagttcacagtcatgttggaagtgaactgggaagactcatgcagtctaccatactaactcagctgctccacttgggtgaagcaaggaaagcaaaagaataataaactgaggagcaggctgggagaggcattgactatgtatgcaagtaacagatacttatttttcataagcgtgtgcttagtaaagttgggttctggaggtcaatattataggaagatcatgatctttgattctgaaggatagcatatgtttatccttatgccagtaccacactgtcctgatttctttcaaagtcaggaaatagaagtccaacattgttcttcattttcaagattgttttggctatcctgagtccattgcatttccatatgcattttaagataagcttgtcagttccccatctaatttaaatttgtgattcagtgctcaggaagattcaattgctgttggcatctaagtttgaaggaaatggtttgatcgtttatccaacaaatatttattaatattgttgtgccgggcattgtagagttggtgctgcaacatacaccaataaacaaatccaaacacaatctttgtatccacatggcttacaattgaagaaaattagcagatattaatcagtcttcacgttgaaacataattaaaaactgagataaattccatgatctaatctgaagatgcagagtttctctgagaatataatatttaaggaagtacaggagttacctaggcactgaagatgagagaggaagccttccagacagagagaacaacatgggcaaaggacctgtggtggaacaactgcagcatgttccaggatctaagaaaatgtccaatgggccgggcacagaggctcacacctgtaatcccagcactttgggaggccaaggtgggcagatcacctgaggtcaggagttcgagaccagcctgctygacatggcgaaaccctgtctctactaaaaatgcaaaaaagtagctgggcgtggtggcggacacctgtaatcccagctacttgggargctgagggaggagaatcaattgaacccaggaggtggaggttgcaatgagccaagatygcgccactgcactccagtctgggcaaygagtgaaactgtctcacaaaaaaaaaaaaaaaaagaaaaagaaaaagaaaatgtcttatggctacagcattgtgcctggtagacaggataaggtcagagaggtgaacaagastcagaacatgttcagtgatttggatttttattctaaagcactgagaagctgttgagggatgttaagctagtggtggagagttgagggatgacacaatcaaatttgtgttttcaaaattgtattcttcatatcactcaattgttaagtgtcagtcttatttggatctgggttttttaaaaaaaaacacttgttaaagacaccatttttgacatttatgagactattaggaatttgaacactgtgtgaatatttgatgatatcaaggaattattgctatctttttaaggtatggtagtggttttacagtgttatttttttccaaagaccttatcttagaaatccatgcggtaatatttatgactgaaatgataagatgactggaaatttcctcaaaataataatgcacgggcaggaaggttgagggtttggatgtggtgggtatgattatgggttaatgtgattagactggctggtgggttcagggggtatatgatacacttctctgtttttatgtctgtacacaattccctgtaataaaagattwaaaaaaaaaaaamcccacaaaagattattctgctttcagcatggaagactagatttcagagggagaaatggtgatgaggggagatcagttaggaggcagctgcagtggcccaggtaagaatgatggaggcttggtccagagctggaccagtggaggtggggagagataartggagagatctttaggaagtaaagtagacatgaattggggatggattggatatgggggtgagggagatggtggaactgagatgtctctcggtttttygccctggatggagatgccacaytgagctaggaatcactggataaaagccaaggaggtcccttggctcartttatttttatatccccacctctgtttccctctattctgcaaatattgaagctgttcccttatgtaacatcttttatcccagacttcctgtgctctgtgcactcagcaattaattaagctttggtatgcatgaattaattaaaatcctctcccaggttcagaggggctgtcctgaaatatgtatattcttctatatctgccttcttcctgsaactggtttcctttgccgggtgaacacttttgctttctcgtgggcacmcagctgcaggtgtctgtctrtctgtctgtcgcatccatcagcacactttaattttatgtttaggagcctaggtctagagaagttaatgacttgtaaattgctctccaacgtagagctagaaatagaatgccagaaggattcctgagcacttacttgcacagagattcaatgatggaggtatcagccccaccataggaagctgaaatagtagtttccttcatatttctggacagccactctgtggtgcaagaacattcctgacaaaggtgcagcctccatatgaaatccgatcttggtctgagacaatgtcttctgcccagtttcacyggatgactcttgtcccctttttgtcctgccccctatccaggtcgttttctgatgtgacggctgagacatgagatcttcagcctccaggctctccagtttttcgtcgagagattcactatggaatcggtgagtgatctctagcccatcctgtccagaaaactcggcgtgggagayacagcgggattcttcttgggagttgaaatgcaaaattttatcaaacacaagcactggaatctaacagagactgtgtgcacgattgttattggagaacagatctctagcatttgtacaggtgtagacygcctactatgttttctgtcacattatccattgcctttatttataaggaaagttgtctgggtggtggtgcctataagaagtcaagagtagcaacaacagtgacaccagcaacactataaggtgctataggagtccactgtgttttaggttctttaaaaacatttcaggctggacatggtggctcacgtctgtaatcccagcactttaggaggctgaggtgggtggatcatttgaggtcaggagctcgaaaccagcctgaccaacatggygaaaccttgtctctactaaaatacaaaaattagctgggtgtggtagcatgtgactgtaatctcagctactcgggaggttgaggcagtrgaattgcttgaacccaggaggcaaaggttgcagtgagccaagattgcaccattgcactccagcctgggcaacagagtgagactccttctcaaaaataaaaattaaaagtacaataaaataaaatttcatttactcctcccaacaatcctgccaagtaagaatttctacattcagttgggtgcagtggctcatgcctgtaatcctggcactttgggaggccgaggcgggagaatcacctcaggttaggagttcgagaccagcctggccaacatggtgaaaccccatctctactaaaaatacaaaaaattagccgggtgtggtggcaggcgcctgtaatcccagctactcgggaggctgaggagggagaatcacttgaaccccggaagcagaggttgcagtgggccaagatcrcactgttgcactccagcctgggggtcaagaatgagacttcgtctcagaaaaaaaagaatttctacattcattttacgggtaaagaacttgcccagctagatgtaagtcaattttcccttactgcaggacccttgccttttttttttttttttgagacggagtctggctctgttgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggcctttttttttttcctatgccacgttacctcttgggagaggtagagatatgatttattccattttgcagctgggaatactgaggcctggtgtagggacacatgatgaagagtctaaggagtctggcctcagtggatgaaagtttgtgttagaggatgataaaaattagactggacaggaagaaccatgaaaagctaggccgggaaaacttgtagagtctgagaatcttaaaaagctggcagactgactggcacagggttgacctgttggggccagggtttctaagaagtccgcgtaryggaaagtgtgtgggtgctagaaggggtggttgaatcctggccctggcactgatttgctgtgtgatctcacacaagacaccggctttcggccaggcgcgatggctcacgcctgtaatcccagcactttgggaggccgaggtgggcrgatcacctgaggttgggagttcgagaccagcctaagcaacatggagaaactctgtctgtactaaaaaagacaaaattagctgggcatggtggcacatgcctgtaatcccagmtacttgggaggctgaggcaggagaatctcttgaacccgcgaggcagaggttttggtgagccragattgcgccattgtactccagcctgggcaacaagagcgaaactctgtctcaaaaaaaaaaaaaaaaaagacactgactttctctgtttcttctgttttcttatccatgaaaaaggggtaatatttatgtttcagattttttttgtgtagtttagaaaaaatgtaaagtrttttacataaagtaggcacatagggcattgtaattacttcaatttttaggttgaaaatagtttttaaaggatgattagataagcaaatgtgtcctgaatgggtggatgaagtgagaggctggaggcrgagaggccaacctgagaggcttttgatatgatcgagacatgatacygccttccagggtaaatgaagctttacttttattttcaaaatttttctattataggattacccaaagtcatgtttattttgtttttttctttttttaagtcaagagtccagcacaaaatggcattcattttrcaggtatcttttyaggtgatattaattataattgcaataactcagtgcattattagaattaggttttgctgacaatgacataaaatctaaaagaacattggcttagagaagtgtctctcttacctaaaagttcaggtacaagtaacacagattttctacagcaatctgtgagagacctgggctttttctctagtttgtttgccatgtgaacctctattcccaaggtcacctcacagccccattttagctgcttctgctctagccatcacatctaacagcaggaggaaggaacgagacagagaaaggcaygtcccatcctttaaggatgtttcctggaagttgcacctcctgytcctacttatattctactggccagaatttagttctctggctacattttgcggcaragaaggctgggaagtgtaatctttattctgcaagactgtgtgcttaccaaattgagagttattrttatagaagaagagagcagatattggaggacaaatcttttcctccacactactcattcttgaaagatcgtgctgacaggataggctctgcagccagcctgctggagtttgcattctggatccatggtttcgtagttctgtgaccttgttgaaaagctacttaacttctctgtgcctcggcttcttcctgttctctcctgttttatagacttacaagggttgttttgagcactagttgagttaagctaaagcacttggaacagtgcctggtacatggtaagtgctatataagttctagctattatgactactactattgctagtagtatctctctagtacttctactactactgctactgccacttctgatatgactactgctacttctgttacttattactattaatacttttactcttaccatgactgctgcttctactaatattaccactactgcttctactgtcacttctgctgctgctactactgttgtgactacttctacttctcttctactattattactactataccattattatttttaaattgtatactcatagcatagtaagtactatttttcccaatagaagataagagtcagagaggatagtaacttgtcagatgccattcatggtctacccttgggtgggtaggggatagcgacttgaaggaagcataaggcaggtttctgtggttgtgctaatgtgctgtttcctgatctgggtgatgtttcattagtgtaaaagttccttgcatgacacacttatgacatagataattttgtgtatgtatcttatatgkcaataaaaacatgtcatgtagctgaaaagtggtggaacatgagtgaaacctacactcgcctgattccaaagcctgtgctcttagctgtaacacaaggccagcacctttagtcctctgactgactgattgattcattcatctaacttgtattgataactgcttattacttatgtgccagtaacctggctaggatgcctgggatacaaaggtccatgctgtagacatgaccctgccctcatggggcttcttatctagaggaaaaggaaagaggtaaataccattcagattaccagccaccaggttaggttcagtatgggatgccctggggccacaggaggggcatggaagctaacccagccccacaggctcatctgctgaaataacacagatgtgcttctcaaccaacccctttgwtgggggaaaagttcccacatcagtgggtaagctgaccacaggagggctacatcaagaaatataaagcagttccccccatccyttgcttaactggcactaagaaggggtcagcttttcttgtcttgttgtcactgtcatagttgtgaacctacctgatgttccatggggtaggcaagtgctcgcccttgtgagttcagtagaagacaagggaatcacaggagcagagacttcacttatgaagacgtgtatacagggacctcttatttaaaataaatatacgggctgggcatggtggctcatgcctgtaatcctagcactttgggaggcgaaggctggcggatcacctgaggccaggagkttgagaccagcctggccaacatggcgaaaccctgtctctactaaaaatacaaaaattagccaggtatggtggtgggcgcctgtagtcccagctgcttgggaggctgaggcatgagaattgcttgaacctgggaggcagaggttgcagtgagctgagatcgtgccattgcactccagtctgggcaacagaactagwctctttcttaacaacaacaayawcaaaattctcataaatatgtgaatgaatgaatgaatgaataaaatcacagtccacagcaatgcggttgtcatccctgggaaaactcaagtccaagggaataaagaacaagacccgtttcctttattcaccccaaataccataagggagacaggagcgcagcacatggaagtggaattgaatgctgaattctgagccagcagtagaaatcagttggccttatgttcaggtttttctccatatgtagaaaagaagtgacctaaactttagaccctcctcaaccaagcccatgagaaacctctgtgactcctcctccctcttttgcctttccaaatgtcaagcagacgccctgtcattatcatgccacaggctgtcagcccaaattgaatttccctgagcccagctgatgtccctttttggctgcagggcagggatcaggaatgcatgctgcacatggacgggaaacgtgtccctggagctgaatgcagaaggctgacctctcaactctgcattgctaacatagttggaagggttaggaagccttgtgatttctggatgtaaaagaaaaagaaatgtgttttaraaaaacagtattcaagttctgctgcgaaaatcctttcaaaataattgagtctatttaaaattcaactggttgtttcacagcattgactatacttcagttaratacataaaggaaggaaggttatggctaaactgagagatgggaagtgrtgatgctggtcttgtcttcctccctcccttcatttttccctccctgcctttaaaatttattaagcagcgactgtgtgccaggtcctacactcaarcctggggaaatacatgaataagactcatggcaaagccttcttgagcttatccttcatttgtttttagaaaacgtattcattctacaaatgtttcctgagcatctaatttgctcaagtctcttagtagagataaaaaacatggttcctccttttactacatgtatactttattttttgatcacttttctgacgacctactawgtgccagggtctgtgcaagctgccaggataycaagggaaacaaaaacagcttctgctttgatggagctaaaagactagaaaatgttccattagtttcctagggctgctgtgacaaagtaccacaaacttgstggcttaaaacaacagaaatatggccaggygcggtggctcacacctatmatcccagcactttgggagacggaggcgggcrgattacctaagatcaggagttcgagatcagcctagctaacatagtgaaaccccatctctactaaaaatacaaaattagctgggcgtagtggcgggtgcctgtaatcccagcccctcgggaggctgagrcaggagaatcgcttgaacctgggaggtggaggttgcagtgagccgaggtcacrtcactgcactccagcctgkgtgacagagtgagactctgtctcaaaaaaaaaaagaaatgtattgtctcacagtttggaggccagaagttcaagatcaacgtgttggcagtgtcgtgcttcctctgaaacctgtaggggagaatccttccttgcctcttcgtagtgtctggtgtcaccagcagtcgttgatgttcctcagcttgcagcctcatcactccagttcctgcctgtgttgtcctgcggcattctgcctgtgtgcctctcttctctcttacaaggacagcagtcatactggattgcgggactgcccttctcccatgtgacctcatcttaatcaccaccttaattatatctgcaaagaccctatttccaaataagtccacattcatggatgagggggtggctaagatctccactttttgcaagaggacgtgtcaaacgtatgtaatattagaaagcgcccacagtacctggtgcatggtgggccttgttgttgccttccctttctttccactttatctcagcatctaaagggtgagcaccttgagggcaggaactctgtgttactctgagtgagtgcttccagatttcttgccagggaagtgagacggatgtttttcttgtgctgcggcagggacattcttgtgtggtccctggttgatgggaaatgctctttcttgctactgtccttagtttttgcttcttatgctgatggttgatgagggagtcatggggaaagaataccttgattggaaagctgggcctggtgggtaaagtggttaaaccaggctcctctcctggttctgctgtttgctggtcatgtgagcctggatacatttcctcctctctgtgcctccaggcatctcatctgtaccccttaggagtttgtttgtttgttttgagacagagttatcagggaacctgcccctgatagtcacgtaggttcttttctgttttccctaagcgttggcygggttgagaaataaagagacagagtacaaaagagagaaattttaaagctgggtgtcctggggagacatcacatgtaggtaggttccgtgatgccccacaagccgcaaaaccagcaagtttttattagggattttcaaaaggggagggagtgtacgaatagggtgtgggtcacagagatcgcatactttacaaggtaatagaatatcacaaggcaaatggaggcagggtgagatcacaggaccacaggaccgggacgacattaaaattgctaataaagttttgggcaccattgtcattgataacatgtttgagagcaaccggtctgaccaaaatttattaggcgggaatttcctgtcctaataagcctgggagcgctatgggagtctggggcttatttcatccctacagtctcgaccatagaagatggccacacccaagggggccatttcagagacctaccctcaggggcgcattctctttctcagggatgttccttgctgagaaaaagaattcagcgatatttctcccatttgcttttgaaagaagagaaatatggctctgttccgcccagctcaccgrtggtcaaagtttaaggttatctctcttgttccctgaacattgctgttatcctgttcttttttcaaggtgcccagatttcatattgttcaaacacacatgctctacaaacaatttgtgcagttaatgcaatcatcacagggtcctgagttgacatacatcctcctcagcttatgaaaatgatgagattaagagattaaagtaaagacaggcataggaaatcacaagggtattgattggggaagtgataagtgtccatgaaatcttcacaatttatgttcagagattacagtaaagacagatgtaagaaattataaaagtattaatttggggatctaataaatgtccatgaaatcttcacaatttatgttcttctgccacggcttcagctggtccctctgtttggggtccctgacttcccgcaacacagagtctcgctctgtcacccagtctggagtgcagtggtgagatcttggcccrctgcaatctctgcctcctgggttcaagtgattctcatgcctcagcctcccgagcagctgggattacaggtgtgtgccaccatgcctggctaatttttgtatttttagtggagatggggtttcaccatgttggtcaggctgttcttgaactcctgacctcaagtgatctgcccgccttggcctcccaaagtgctgggactacaggcatgagccactgtgcttggccttcctaggagtctttgtgagggccaggtgggatcaaatgtttaaaagagtaccaggcccacagtaaatgtttgctgcttgtttgtgggagtattccaagacttttaataccttccagggagaagggcttccctggcccattcagcacattcccctcagtaaagactcatgctcactgtttagcactgttcaccatcagaacatttcctcatgattttcctaaggcaagtttttcaggaatatggcaaacagcccttgcacaaagatatccattggagcatcatttaaaatggtaaaccgctacaaacaagataaaatcctgctctacaatgagcagtgggttaacaaattaggggcagaaggatgaaaaacaaattagggtaaaataatgcagccattaaaaagaagataagttatgagaacactcataatataactgtcatgttaaaaaaaaggtttatttttgaggaagtgacttaatttctgtgtgcctcggtgccatggtttggatatttgacccctctaaacctcatgttgaaatgtgatccccaattttgaaggtggggcctgatgggaaatgtttgggtcatggaggcggatccctcatgaatgagttctcactctgttagttcccgtgacaactgtttgtttaaaagatcccagcccctcccccacctccttctctcaccatctgatctctgcacatgctggctccccttccccttctgccacgagttgaagcaacctgaggccctcacagaagcaggtgctggcttcttgtgcaacctgcagaaccaagagccaaataaacctcttttctttattaattacccagcttcagttattccattagagcaggacaaatggactgagacactcagcttccttatctataaaatggagatgataacagtactttcctcatacatacgattgttttgagaattaaatgggatagtacctctaaaacacatgaatagtacttggcacatattaggtgcttactaaatactaattgttattgttagttatttatcatgtggtctaaaccatgtgcagaatattcatagaaaaagattagaataagtaacacagatgaatgcacatcccttttccctrttagatgtcttattcaaagggacttccttttgtctgtcagcaaacattgcacagcttctctgtatcaagcactctgatagtctctaaggcagcaggtctccctttaggagtgtgtatgagagtcccttttgggggctttttaaaaaacagatgcttagagatgctgattcagtagatgtgtggtgagtcccaggcatctgcagtcttaaaaactattccacaaatgattttgactctcaaggttgatatataagttacagtctttcccctcaagaagtytgcaaaccagatgagaagatgggacaagcagtggcatgaggcagaacgtaagtgctatagattaggcgctcccaggtctggctccccctgcacaactttgcaaaaataaagatggtctttgttgtaccactagatgtggaatcagaacccacagggtgaagcctttccaggggttctggtgatcagcctggtaggggaccatgtgtgaggactgtgagtgcttcctgtttgagagaacccaggagggggtccctctggcctgggattgtyacaggagctctctctaaaaaggtataatgtgctatctaagaatacattattacatttactgwattggactgaaatgacctgttagatatctattgccactgacatactctgagtgccttgaaggcgggaaccatgcatgcattggtcagccctgtgatagtgcctgcatgtctcaccttggcattgacctctcctgtcccctrgtacctgcctaggtgcagcaggatagattgagaaccaaagtttttccaaagctattttytcaaagccatgaggactgatatattttctctggttggtagtagtgaatgctttttaaaaaatctttattttaaaatattttaattgtggtgaagtatgcataacataaaaattactattgttaactgtttttaagaacaattcagtggcattaagtatgttcacattgttgtgcaaccattgccgcgaaatccatctccagaattcttttcatcttgcaaaattgaaattctgtacccatcaaatgacaactccttctcttccctctcccttcccatccctggaaataaccattctactttctgtctgtatgaatttgactactctaggtatcttttataagtggaatcatacaatatttgtctttttgttactgccttacttaacataatgtcctcaaggttcatccttattataccatgtatcaaaatttccttcatttttgaggctaaataacattccattgtatgtacatatcatattttgtttatccagtcatccgtggatgaatacgtgtttgcttctaccttttggttgttatgaattatgctgctatgaatatgggtatacaaatagctccagatcctgctttcaattttgggggggcgggggatatatacccagaagtggaattgctggattatacaataattccatgtttacttttttgaggaacagccaggctgttttccattttacattctgtaccagtttacattcccaccaatagtgcacaagagttcccatgtctccatatcgtcaccaacacttgttattttctgtttttgtgatagtagccatcctagtaggtatgaatgcttgtaactggtgaatgcctttagcgaggacattccattttcagctttgtatttcacttaggttgtgtggcccaattaaacagtctccaagcatttatttaagccctaggcactgagaatacagacctaaataatacatgcatggtacctgccttcacggcactcagagtatgtcaggggaaatagatatctaacaggtaatttcagtccagtatggtaggtgtaatcatatattcctaatagcatattatgccttaaatacagttgaagattccgggaaatcttgactgagtttggtgccttagtataaaacacatgagtacatcattcaggcagtctgagattcctagattgtttaggctggaagggacttgtagactttccagtagaactttctatgaaatggaaatattctgtgtctgccacatgtggcttttgagcacttaaaatgtgcttcgtacaactgagaaacttataaagttcatataattttagggaatttatgtttaaattgaagttagctataggtagtggctactgtgtgagacagagaggtaaagcgaggtaatagtgagcattctttcctggttctcatgcttgaatatgcatgtgggtcacctggggagctgttaaaaatcagattctcaggccctccctttagtgtttctaattctttaagttgtagtagggtcaaggaacctgcattttaacaaccaccacaggtgattctgatgcagacgtagtttgagaaatgccaagtcttgtggttttcaagcttttgtatcctcagaatattttcttcaaatgaaagcttaaagcctgggcaacataatgggaccctgtctctacgaaaaaaaaatttagctgggcatagtagcacacacctatagtcccaggtagttgggaggctgaggtggaaggattgcttgagcctggaaagttgaggccgcagtgagccgtgactgtgccactgcactccagcctaggcaacggaaggagaccctgtctcaggaaaaaaataaataaataaaaagaaagctaaagagctcagtgtatagaacagagagtagagttgttccagcttaggtagttctggctggtaccagaactttatacacgttaggggatcacactctaccctctctggggaaggaactggggtttcttggagtataatttgtacaactctaacctagcacaaccacatcactttattcatcttaaatcctgtgaaatgcaaaataagayttggttttgtaatacctataaacatgccagaaccaattacagaccaacaggcacctctggaaatgcaggttgaagcagaaacacaattagtgcattagtcagccattttttcccttgtcctggactttaaccagccatcttggcatcacatggcggaactgcagagtagtgattaaaaacaggctgtctgacctggcaggaaggcagtctccaccctagagcttactgggtggtgctaggcaagtttccttatctgcaaaatgggtataacagtagcttctacctgagacaatacatgtaaaacccagcacttggcactaagtattcattattgtaacaacaacaacagcagcaacaacaatactaatagctaatgctcacagagcatttaacgtgagccaggccctttcttctaagcacttgctgtttattaactcattcaatccttacaacaatcctgtgagtagatagtattgttatttccattgtaaagacaaactaaagctcacagaggtttggaaaattatttaaggccacattgctggtcagtggcagaagtggaacttggctgcagggartctggccctggagcctgcagttttcacttttactccgtgtgctactatattatccccaggctctaaggaaagcctgttaagatgatcctttcatcccctcccccaagccctagctctaaatctcaaagctttggaattaatctgtaagtcaactcagcttctgcgaatcatctgacccagttgatcactcccttcctctaaaaacacggttttcttttggcttctatgacaccaagccggcttggatttcttcttgtgaytctaccctctcagtctctcagttgggcaccccttgctccaacttacctctaaatatttttgaagatgtctgcatgcaaattatacagacatgcaaattatattatatgcttacaaattttatctccagctgaatctgtcctctgagttccagacttgatgatctgaaatgcctaattaatatccccatttggaagtctagcaggcctctcaaacttaatatgtccaacatggattattctcctcactcctcytgcagctcatgctgcacccctgcttacagccaccgctgatctccaagacccctgcccattttacttagaatgaaattcagatttcttaccgtggcctacaaagactagcatgatctagcccctgcctatctctgtaccctcctctgcctccaccccgtttccccaagaggcttcagcacattggcctccgttctgttcctcacactcagcaagtgctatcctgtctcaggaccctgcttcatgctcttcttctgcctccagggccttgtccctgtacctcctgtcccccactccatggtcgtcacatcctgaagtctcagcttaaatgctatgtcctcagacagatcttcctagccactctagcctttattctctttggttgctccccgtatgttttcttcctagcagttgtaacaatctggaattgtttgttctcttgtgtatgtctgccacccccaccagactataagctcctaatggacaaggtcrctgatggctgctcatctgctaaagttactccagtgccaggcacagagtctggtacatasatgttcagtaaatatgtattgttgttgaaataaaatcaatggctgctgctaagtcaaccatgagcataaaataccaattctaggcctgttatttgtagaatcctttcatggactagacarttttcatatatatatacaagtggttaaaaagttggttgggacttgggctttttttttttttttctgagatggagtctcgctctgtcatccaggctggagtgtagtggtacattaracaattttgatatatgtawacaagtagttaaaaaattggttgggacctgtgcttttttttttttttctttcttgatggagtctcactctgtcacccaggctggagtgcagtggtgtaatcttggctcattgcaacctccacctcctgggtccaagtgattctcctgcctmagcctcccaagtaagtgggattacaggcgagcgccaccatgctcagctaatttttgtattttgagtagggacgaggttttgccatgttacccagcctggtctcaaactcctgatctcaagtgatctgcccacctcggcctccccaamtgccgggattacaggtgtgagccaccactttcgccggacctgggttttttaatgggccttggtctccattttcacatttcttcttcctgggtcatccagagtgttaggatttactgagattctcttaagaaaaacagcagccttggatacccaattcatatgaaagcaggtttgatttcggtttaaaatggaaactgtgagctaatgcattttacagatttgaggagagaacaattttctctgtttttaagaaaataaagaacaaaacgtgggataactttttgtgagtcaccatagtgccacaagctcctgaaaggggttctctgcaaatatttggggtttggtgcttataaacagctacaaaggttttcttgagcgttggtaaccacggcaacaaggacgtcacttccacggtgcaaacatgcttgccaagctgaagtgtggagtgacagtttttggctgagccrtgaacctaaaagtggaggtttacaaagttactgcagacaggtcattagcacgactggctgcagtgagctccctaagtcttcatcgctcctgccttttcatcagcagcgagataattgactgttagactcccgagccacagaccacggcagaggtgagtccgcttctaactgtttctgcagrgtgaggtacagttgtcagaagttcccaaacaatgtgagtttggtaagaggagactggaaatggagttttcaccagtaaagcgacgcgtggcgattgtgtatctacagggtggagagcrcagcgcttagccctgtgtcgacagccctgtgggctgaggccacagtctgaatttgctgtgcccagctgtgttttttcatcaggacagggtgtgggagcgggggcaggcagagcttcaagctatggactcggcaatggaacgtgttacctccgtggtcagcacagttttagttttgggtgatagaaacccaattcaggttgccttaagcaagaagggaatgtactggcttaggtaagagaggagtccaggggtaaaacctggccccagaaatgactggattcctagatttggtctctcccttttctctgcatcaccactgaatctctcgcccccttcctctctagtgctttctcctccactggctgtattctcaggttctccaagtatggtttccagaagcatcggtcctaaagccaccggtttaaagaccccaccaggtagagagctcttcttcccagaagattttgcaaaatctctggattgattcccgttggtctatcttgggtcacgtggtcagccctgtaccagtcactgtggacaaggccatggactattctgattggacaagcccatgtcacctgatcattcccagactycagggagaggttgaaagtgagacccacaggaaccaaaggatgtggggggactccccagtgggaatttgaaatgcattcaccggcaggagtactgggtgctcgggaagtaaaaccgcaaatgcccacccctctaaccaagtaactggatgtagggagagttagtagctcaagttcgaatcagcttccttagcgggctgttgaagagcctctgttgggagagtgatgtcagcaacatggcagaagagaagctcctgactctccctccactcgtggacacaccaaataaacatccattcaccaatcacttccctctgagagagtcagagaccagttgagattcctacccacctggtaactgagaaaacatccccatgtaacgggtcggaaaagctgagactctcttgggcacgcccccacctcgggcgctgagccacaaaattgggaaaggaatctctagcacccagcatctccccatggagaggaggctttgggcctcacaaggcccgccctaactctaaggtgccccacggttggctcttaattcaccaactctggggctgagggaattagacacactcaagtctctgttctgctttggctctattttatttatttatttattttagtggagacggggtttcaccatgttggccaggctggtctggaactcctgacctcaagtgatccgcccacctcagcctcccaaactgctgggattacaggcgtgagccaccacacccggcctgccttggctcttttaaatgaacctcaagcgaccaccagctagcaacgtgccttctgcctctgggattgctccaggccatgtctgtgtagtagaaggaggtgatgtttcccattcccctcttgtagctccttgttcaagctcatcctgttagatcaaagacaatatttggacctcaagccccggcctccatagagccatggtgtgtgtatgtacgtgggacactgtctcgcttttatttatgttcagtctctgcctctctcactagattataacttccaggagggcgggggtcatctcggccttgctcaccacagtgcatagcttggaggatgtagtggacagtcagtaaatgtttgttgaaagaacaaattacaggacaatggggagtcattgagggatgtgaagtgtgacagggtaacttgcccaacattccccagataataaaagacactatcagtggatcacctgaggtcaggagttcaagatcagcctgggcaacatggtgaaaccccatctctactaaaaatacaaaacattagccgggcatggtggcgggcgcctgtgtaatcccagctactcgggaggccaaggctcaagaatcacttgaaccggcgagggggaggttgcagtgagccaagatagcgccattgcactccagcttgggagacaaagtgagactccgtctgaaaaaaacacactatcctccctgaatcccacgtcttctgactcccaatgtcccactttctgccccctgcccagcagtggagttctctgagtaagaagagggggagggtggcacatactaacacagaatggatgcttgtatgcagaccaggctgtaaattacatagcaatgacagctttgatgttgcatctgaaaaggtgtaataaccccttctagcaggtctctctcatggtggaggggaaagtggtttgtgctttattttaatcagcgaggcccttccctgctggtaacttgaggtcattccatctcatctcagaaggtcgtcttgtccttgggttgccataatctcctttggttataaagaggacctggagccatgcaagggtgggatgttgacttgccatctcagtagcacatttaatcctacaggactctggcttcccctatgcaagcattagaataagagttcaggtgagtgtgacctgcgttacaaagggcagtcttcaccatgaaccgtaggaagggcaggtggccagttctggaaaggagccaggagacctgggtccttcttacagcacccagactgctggggagggagacatgggcaagtcctttcacctctgtgggagaaatgggctggtgctcttctgtatcagttaggtgtcttttagtgtcaagtggtagaaaagaaagaaaaatccaaggctagtgctggcttcagggctctcctggatccagggatgccactggtgtggtcaggcctctgtcttctgttgtgatactacatacataaacattaagataaacataaacataataaacattattatcccccatctaacatctccctgctgtgtggccttggacaagccacgaatccctgtgaccctcgtttcctcatctgggaataatattagatcccacacgccactgcagtgaagattaaacaaggcagttcatgagagagcttagcactctgtacctggtgcatggtatatagtaggtcctctgcactgtgcctggttcatagtmgatcctctgggctctgctgtcctctcagatggcctcattttcaggcaggctttctccccttgatggtctctactggttctgtgcttacagactcctggcttgtagtccactctaaagaatttattttcgacaaaaagtctgggatgtggacatgcacccacgctcactggctgcaggcatatgctaccaggcaggaagcactcctcccaggggctggagcctggggaatcctttgggggagaattctgagaagtgagcagtctgcctgccttgcagggaggtttggcaaaaagggaatggggaccagattgaaggtaagatgtcatttccaggcagaagatcgaatagagccttgcaagcccttgttttgagagaggggaaaccaggagagagggaagaccgtcagtgtgtattagcaacatataccatgctcttctgtgcctctgtgcctttgcacatgctgttctctctgctgggacttccttatccactctgcacactcccatgcatccctgagacccaactcttcaatgaagctttctctggctaaagtgaaagctttacccctcccctcccgccccatttccctatcattaattgcttttcttttctttttttttggagacagtcttgctctgtcgcccaggttgaagtgcagtggtgcgcaatctcagctcactgcaacctccacctcccatgttcaagcaattctcctgcctcagcctcctgagtagctgggattacaggtgtgccgccatgcccagctaatttttgtatttttaatagaaaygaggtttcaccatgttggccaggctggtctcaaactcctggcctcaagtgatccgcccacctcagtttcccaaagtgctgggattgattttccatttttgaacaagcatctattgggtggtagcactgcgtgctggggatacaaatgagaatacatgacagtgcctgtgtcagagtgagtttggtccttcctccctgttctgcttctcctttatcagagcagttacttgttacttattcaacacatctttattaagcaccttgtatttttctgagcattggtctagaagctggagattcggggacagtgggagagacaataaaatcaataaataatattaatgaacaaggtgatatctttaatttctttttttttttttttttttttttgagacagaatctcgctctgtcactcatgctggagtgcagtggcgcaatctcggctcactgcaagctccgcctcctgggttcacaccattctcctgcctcagcctccygagtagctgggactacaggcgcctgccaccacgcccagctaattttttatatttttagtagagacggggtttcaccgtgttagccaggatggtcttgatctcctgacctcgtgatctgcccgcctcggcctcccaaagtgctgggattacaggcttgagccaccatgctcggcctgaacaaggtaatttctgatggtgtgtaccttaagaaaataaacacgggtaaagggagaacaagagatggggattagggtgggaggagagtggtcaggaaggagggaccctgtggaataagacctggagagtgacaaggaacaagcatgcagaggcctgsgtgcagggcattccagctgaggggaacagcacgtgcaaaggccctcaggggggtgtgttccagaaatgacaaaaagcagggctgtagtgagaagagaggacaaaggtttggaaagtgaggtcagggagatggacagtggcctggtcatataaggcctttagaytaagtcatgggagtagattttattctaagtgccttgagaagccaccgtagtgattcttttctagcttggaggacgcattctccaagccaggcgtcatcctgtcccttaggtgcacaattctccattctcttttggtgctcaaactgtgtcatctaatacagtagccacttcaagtagctactaagaacttaaaatatggctagtctgaatggagatgtcctataagtctaaaatatatgttttcaaagactttgtatgaaaaactctgtctcattaataatttttctttcaatccatgttgaaatgatagtattttgaatatattgggttaaatgacatatgttattaaaattgggccaggcaaggtggctcatagctgtaatcccagccctttgggaggccaaggtggaggactgcttgagaccaggagtttaagaccaacctgcgcaacacagtgagacctcctctctacaaaagatatttaaaaagtagctggggctgagcgcagtggctcatccctgtaatcccaacactttgggaggctgaggcaggtggatcacttgaggtccggagttcaagaccagcctggacgacatggcaaaatcccatgtctaccaaaaaaatacaaaaattagccaggtgtggtattgcatacctgtagtcccagctacctgggaggctgaagtgggagagtcacttgaacccgggaggcgaggtttcagtgagccaggatcacgccactgcactccagcctggacaagagagagagaccctgtctcaataaataaataaataaagtagccaggtgtagtggtgcgcaactgtactcccagctactcaggaatctgaggcgaaagatcacttgagcccaggaggttgaggctgcaataagctcatgactgcacgtcagcctgcatgacacagtgagaccctgtctctaaaaaaatkaaattaatttcatgtgttccttttaacttttttcctgtggctgctgacaatttgaaactccatgcatgggttgcactgggttatatttctgttggccagcactgcccttcaagcaccttcagccattgcttttaccttcatgggttatagtcacctcttgacttgtctgtgctcctccttgaggacagtgaccccagccggttggtggagtcctcaggcaccacattggtgctccccctgggtccccttggcgcaccctggttccctgcaccctgcaccctgcaaaccctcaggctgctgctcctgagggtttctttggcatgctcaggctgcatgcagggcaggtcagaagtgctgggagttcactccccaggagcagccctcagccaaggaaggagcagagttggagaatacacactccatcatcctgcttctcaggtgcacagctctgaggtgtgttctctagcatctcccgaaggtcaccttcagtggtaacctgctctgcagtacacccattgttggcttcctttctgccgctgttttatttccccattcatctagttgggatcacttcccaaatagactccttgtactcagatcctccttccaggctgggcttctgggggaacccaacctgagacctggggtgcccaacaggtaggtgcttagtaggaggagagggcctgtccctccagcacatgtctggtgcaggctagctgcccactgtcaggggtggggagtagggtgaggtcgcagggggatcctggccagtctcctgcagcctctagaccttgagcctgaggacaaggagcagtgacatgagtgtgccaggctcagggcgtggtgtctggctggtccctagtgcctctagctgccacacccagagggacagttgaatcagccactgagttagtgagggcagagccaccctgatgagcactggcctcttgtgtcactgtggcagtagggcccggggagtgtctcagcaggaatggcacaggcagcrtccagcatctctggtgaagtagagtgtttccaggtgcaatgtcttctttctgacaccacttctgactccaaatgtttggggttttctctataccaagcarttctccaattttcctacccgaactacatgttcaacaactgaatttaattctgaccctaactgtctggaattagggcaacccccacaattctgtgggctcagtcccatagaacagctcccacttcagatgccagtcacaattcccagaggctgcgtgtgtctgaccaaccagctrtaaattgagaggtttccacaatttccttctcaagtgtgatgattggctagaactcacagaactcaggaaaatacatctacagccataccaccctgaacacgcttgatctcgtcagaactcaggaaaatacttactattactggtttattataaaggatacaactcagggacagcccaatagaagcgatgctagggccaggtatgggggagggggcggtggtacagtctccatgccctctcgggacgtgccaccttcccggaacatggctgtgctcacccactagaagctccttgatctctgtggtttaggggtttttatggaggtttcattacataggcatgattgattagatcattgaccattggtgattgagctctatctttagtccttcttcttcccccagacatctttttggccgtctcattagcgtacagaagacactcttaccactcaggagrctgcaagagttctgtgccagaagtcaaggacaaagaccaaatctattttttatgataccacaatgatctcataatattaatgagatcagatgagaaaacatgtggaaaggcctgtgactgtgagttgcccagatcatggcatgttatatgtgtgcacatttattggaaggaagtagggaggtgacagatcttgctgtctagaactgctaatatgcatttgacagacatctgcagggcacctactgtgtgttcatgcggtgcccagggcaggcccaacattgcagccagactgaaccttctcagcatcaaaactgttcgtgtccattgccgtcttagaaactctccctcacttttaaagcaacaaccaaattccttgacatgacatccaaggtcttcctcggccacccttgcctacccgtctgacctcagctccaatccctccctgcacgtgttatttgttttcattgcactgagctatttgcaccactccacatctatgtgcgtgtcaagcctccgtgcacttgcacctgctgtactcgtgcctggaccatcctttgccagccatcctgctagttaacctccttcaggaggcagctcagtgtcaccttcgccgtgaagtccttcctgatttcctctttaccattgccttgtcccttcttctgtgtcccagtatctatttcttttagtgcttccatcattcatcagtcacttgctttattaaaggaattgcaccattaactatataggaatccctgctaatatttgtcagcattgaggcactctcgtttaatcctcatggccaccctattaagtaggcactactattaaccgcatatttcaaaagtgcaaactgaggattaagaggttaacagagatagtcagtagtagagcaaggatgtacaacccaagcaatcagattccagagctcttttacctcactgggaaacaacattatcttttactgttctgcattatgttgtaactgtctgtttacatggctgtctccctgtatcagtcagggtcccaggaggaaacagacagcacactggaaatagggtaatccgaagagagtttaataagagagaagtgtgggcagtgggcagggggaccatagagattagtcgggcacccagatcctcaaaggtctgaaggggtgagagagaggaggcctctgggaagcaggagccagagaggctgtgtggagagcaccctgagacacagccgggagggctggagcctggagagcaggggagcactcccctcctctgactttctgctggctgcattttaccacatgcctttgcctgaatccaggtagaagccagagggtggaggagccctgagatgtgtctggagcaggtcagcaggagaaggagggtacagagtgggcctggcaggccatctgcatactctgattgaccataggctccttgagagctggggccctgtattgctcacgtttacatcccggtactcagcacagaggccagcaggcaggaggcgcttggtcagtgcgtgtcaaatgaataaacaacaagggactgatcttcagtacaaaacaccccttctgcaatgtctgcttgtcgatcacacatggtctcaggaattctttttttttaatttaatttttggggaacaggtggtgtttggttacttgaataaggtatttagtggtgatttgtgagcttttggtgcacccatcaccttgtgtgagcagtatacactgaacccaatttgtagtcttttattcctcacccccttcctaccctttccccctgagtccccaaagttcactgtatccttcctatgcctgtgcatcctcatagcttagctcccacttwtgagtgagaacatatgatatttggttttccattcctgggctcaggaattctaagtgatgtatgtgtgtttgtctgtccatgctatttgtgaggtttgtcatggggaagatgatggcaaagtccattcaactctgagatgatctgattcttttctgtggttctcgcaaaacttttcacatctcttgccccatttcaacttggatgtgaaactggagagcaagactttttttttttttttttttttttttttgagatggagttttgctcttgttgctgaggctggagtgcaatggtgcgatctcatctcaccgcaacctctgcctcccggcttcaaacgattctcctgcctcagcctcccaagtatgtgggattacaagcgcctgccaccacacccagctaatttattttatttatttatttatttattttgagacagagtcttgctctgttgccaggctggagtgctgtggcgcaatcttggctcactgcaacccctgactccctggttcaagcgattctcttgcctcagcctcccgagtagctgggactacaggcacgcgccatcatggccagctaatttttgtatttttagtagcgacggggtttcaccatgttggccaggctggtctggcactcctgacctcatgatccacccacctcggcctcccaaagtgttgggattacaggcgtgagccaccgtgccaggcctttttgttttgtttttaaggaagcaagtataaatgccatgctcttcttgytccagctgcatacagccacaattactgagatgactgggccttgtcctatagcctttgcctgaattcctgagataaaggaaagaaaagcagcctggatgcggattccaccaggccctggctgtgtggacccagcaggatgctctggcattcagggtggagcacccagcccagccttgtgaccacatctccacgccttgtggttaggaggccctatctgtgcttccaaatggaaagtatcagaatagctcccaaccagagagagaggagagaaacaacctgaattactgtagtatgtgcatctgggagcccacatttcctggaagctctaattccaaattgattatgtctttttgttgttgttgttaatttgtgtatggcgtgccaatgtgtatttatgtctctgaagaggcaggggtagaggtaaattaactccccgccttccccactactcctcaggacatcagatcacatggaaatgtatgttttcctgtttattattcatttctcaggcacatcagcaaaggtayggctgtagacagctgatgtagaaaacagtcctggctttgaaatcatgctttttagtatttaacctctctgtgcctcaatttccttgtgcataaggtggggaacatcttatgccactcacaggatagtgtaagaattaaaggagatttaaaaaaacaaaggagtagaggttgagtgaaggcaggtgggcagtcatgggaactcccttctttgccctccatttcttgctggtaggacttcacttgcctaaactttctattaacacatttcaaagcactttccagtgaaaccagagggaggagaccttttttttttttccctcgagagtccaacttatactggagagcagtggcacaatcatagctcactgtaacctcgaactcctgggctcaagcagtccttcagcctcagcctctccaattgctgggattacaggcatgagccactatgcccagctcattttgcttgcattactttttttttttcctctgctgctcccccacccctaaccatagccagaccccttgggcctctcttcccagcagttctccagggtctcactctccatggcccattcctgcagtggccaatagaatattaaccagggagggcgcattatcctcctaacgcctgggggatccaagggtttagagccctgcgactaagcacaagacaataaccataaaccatccctgacactggcctaggttctttgcgcctgctgatccccaagtgcccaccagggaaggcagctgtcttaagtagccccaggctgagagtggcaatatggagcagttaggaaaccggagccataaatgtgcaagtggacgaggtgaggcagccagtgatgagtccagttaggctaagmtcccaaagctgactttgctaagaggcagattcctgaagggggcccacaaatgattctttttgtggaatcctctttcacatgttaccttggaggtagtcttggatgtcttgtgtttgggggctctgtgaacagcgacaccactatccttaagggataaatcattgcagctctgttatcctctttgtgtgaaaagaagctggatgcactgggctcctgaccttttccaggactaggaggttgggcacctcctgtggaagctgcaaccatggtacaggtcaggattcagacacacttgctcagcgcaactttaacatctgtgctgcttccccatcgggaagcaagtgatgatgatgccagttcgctgagctgggcaaaacttgcattttattaaagtygwcaagtatgtaagcttgttaaaaagcaattatacaaaataatatagccacctagaccaaagcttgaccctaactaaatgcctcggcctcccaaagtgctgggattacaggcgtgcgccaccgcgcccggcctagtcttgaacttttgggctcaagcaatcctcctgccttggactcccaaggtgctggaattacaggtgtgagccactggtcccagccctatccttttattttaattaacatcatcagagaaataatatttttagtattagcttcatggaaaacaatgaagattcacatacgtagtaaaatctcagttctttggattgaaagaacatttatgggctacatatgttgtactctcacatatcttatttaatgtttataacagcctctgaagttgctgtcattagcctcattttagagatgaggaaagtatgtctaagttgattcttttgcccaatgtcatgcaatctgtaaatagtagggcaaggatttgattgcaggtcttttgacttctaagttctgtgcttagcttggacatggctgcttttttttttttttttttttttaaagggagttacactttctccaaggcctttgagcaccaaatattttttaattttatattatctttgctgatttgattggaaactcttataaagatctgcatccagcatggtatcttgaatatagcatcatgcctaaaacctttttttattacacaggtttatcttttttttttttttttttttttctggagactccatctcactctgtcacccaggctggagtgcagtggcacgatctcggctcactgcaacctctgcctcctgggttcaagcaattctcctgcctcagcctcccaagtagctggattacaggtgcatgccaccatgcctggctgtttttgtattttttgtagggacagggtttcaccatgttggccaggctggtctcaaactcccaaactcaggtgatccaccctccttggcctcccaaagtgctgggataacaggcgtgagccactgcacctggccaagtttattattttgaatatcacttatttgaggttgggatcggttgagtagagtgtttttcactaattagcaggcccatgtatttagaatttattttttgtggaatggtgtattagtaaatttctagtttgtggtggtacattttcctcccttccttgtagccccttttcactattcccagcataactgctgtgttcagtttgttgaaggtctaaaaactagctcaccaaacttgttagaattttgagtatggtaagagaaaatgggagcaagtgaaagctcagagggtgcacctgtgattaaaatccataggttttgtatgcaaaaaaaagccattcataatgaatgtgtctgtctagagatttacatggtttttttttttttctggctcttgttttccagaaaagatgagactctgtgtgtgtgtgtgtgtgtgtgtgtgtrtatgtatttctgtgtgtgtgkgggggtgtctgtgtgtgcttatgtctgtgtctgtgtgtgggtctgtatgtgtgtatgtrtgtgtgtgtstgtgtgtatgtgtgtctgtgtctgtgtatgtctgtgcgtatgtgtgtatgtmtgtgtgtgtatatgcctgtgtatttgtgtatgcgtgtgtgtctgtgtatgtgtgtctatatgtctgtgtatgtgtccatgtgtccatatgcatgagtgtgctctctcagaaaaggaaagagtggggtaaaaattccagccaagtcctggagaaaggactgtaatacatttcaatctgaattctctctcaggcaacagcctgtaacagaaaataaaaccagaatttttgccctcataaggaatatttgggttaccagctctagccatccatagtgcatacaaaattagatatatcaagctacagaaaaaaactgtggaaaaatcttttcttcctgcaaatgtttcatcctcacttatgtcaytgtggcttgaattctaaagaaccctgatgagaaagaaggaaaaccaaagaaaagccactctttaccaaacagtactgtatcaacctgctgttggggtatagataatacactggtaggtatcacatctattttatgtaaacaaattaacagcaaacctggggttctgtttcagctgtggcaagcccattgctgtttgtctctttggcagggaacattattgtggaattttaaatgattgctctggagagattgggcagaacattgattttaaagcaaagaagtctttgagctttatcatcttccttcctgtgtggaatctgccttgtctcctctcccttagccaaattgtgcaagggttgtgtaaataaatttgcttcttcagaaatccattctgtgggagcctgttggctcctctgtgactgtatctctgaaacaatttctgagatgaaatttaagtgcttataaaatgtaatgcctgtacttggtgaattgagaccagtcttttcagtgattctataatgccacaaaataggcctgttgcatgtcttcagaagaattcagtaggatccctaagcctcttaaatatacaatcccaaacacagaggactagttgggaaaatgactctggtagaatgcttctcatttgaccacttctgagataagccgttttcatatattcttagttggttcagcattttcatgggcccattrtataaattaggattagatttcaactctgtacaaacaaaaacccaaataacattagcaattatgtttgtttgtttgttttccctctctgaccagagaagtctggaggtagttcaaagctagtcagtgcctccatggttatcaggagccsaagccttttctgtttccctggttctactctctttatcatattgctttaggatcccaaatggttgctggagtgtcagccgtcacaaccacattacagtaggcagcaagatgcaataagaagggaaggataacaggagtcctcttccagctgtgttagccctttttaaggcactttaccaaaactcctacatagcatttctgcttacatctcactggctagatttagccatatagccaccttagctgtaagggaggctggaagatgagtcttttagctaaacacattgctgccccgaatcaaactggggctctgttagtgaagaaacggggactacatagcaggtacataactggtagtcctgccacatcagcagagtaccatttgtacagagagtgcggtttagtgcaaagggcttgaactttgaaattagatagacttctgtttgaatcttaactctaccacttactcatttcagcaccctaggtctagcacttaacctctctgagtctcaatttcctatctattaaacatgaggagaataatagctactttgtagggttgcagtgagggttaaagaaaatcataaataaattgccttgtatatagtagatactaaatcatcgtcattctagttgttattaacaggtaaggtatgccttccatcttcaccaccatagtggttattttaaaattgagataattcatataaaatttgcacttttaagatatacaattcagtggtttttagtgtattcacaaaatgatagaactatcaccattgtctatttccagaacatttttgtcactcctcacaagaaaccctgtacccactggtagtcattgcacattaccacttcccccacagcccctgataaccactaatctgctttctgtctctatagatttgcctagtctggacctttaaggtatcatacagtatgtggtcttttgtatctgacttttgacttagcataatgtttccaagtttcatccatgttgtagcatgtgccagtactttattactctttatggctgaataatattccattgtatggatataccacattttgtttatccatttgtttgttcatgaacgtttgagctgtttccatttttttgaatgttaagaatgatgctgctgtgaacattggtgtacaaggttttatgtgcacatatgttttcatttctcttgtgtatatacctaggagtgtcttagtcagtttgggctgctataacaaattaccctagactggatggcttacaaacaacaaatgtatttctctcagttctgaaagctggaagtctgagatcagggtaccagcatggttggattctggtgaggccctcttcccttgcaggctgctgacctctcattgtgtccttatatggctgaaaaatagctagagagctgctctctgttttktttgtttgtttgtttgtttttgagatggggtcttgctctgtcaccccccaggctggaatgcaacggtgtgatctcagctgactgcaacctccgcctcctgggttcaagctattctcctgcctcagcctcctgagtagctaggattatatgtgtgcgccaccatgcttgggtaattttttgtatttttggtagagacggggttttgccatgatggccaggctggtcttgaactcctgatctcaggtgatctccccacctcagcctcccaaagtgctgggattacaggcgtgagccactgtgcccggcctggggtctcttttataaggcactgttcccattcatgagggctccaccctcatgacttaattacctctcaaaagtgtcacgttgtaataccatcacattgggttaggatttcaacatgtgaatttgggtgggacacatgcattcagtccacaatagtaagcagttgctgggtcagatgataacacttggtttaaccttttgaggagttgccaaattgtctttcaaagctactccaccattttacattcctaccagcaatgtggtgggttccagtttcttcacatccttgacaatacttgtcaatttccatcttttttattacagccatcctagtgggtgyaaagtggcatttcattgtgtttttgatttgcattttcctaatgtttagtgatgttcagcatcttttcatgtgcttattatccacttgtatatctttggagaaatgtctatttaacccctttgtccacttttaaattagttatttatctctttattgttgggttgcaaaagtttatatattttgaatactaggcctttatcaaatacaagttgagcattcccaatctgaaaatcccaaatgtgaaattctcccaaatccaaaactttttgaatgccaacatgagatgctgacacttttgctttctgatatttcattgtatacaaactttgtttcctgctcaaaatcattaaaaatatagtataagattaccttcaggctatgtgtataaggtttatatgtaacataagtgaattctgtgtttagtcttgggctccatccccaaggtgtctcattatgtatatgtaaacattccagaaataaaaaaaaatatctgaaacacttctggtcccaagcatttcagataaggaatactcaacctgtatacgatttgaaactattttctcccattctgttatgtgtattatctaattgattctgtataacaatcctttgacgtaaatatcattatccccattttacggatgaggaagctgaggccctaaggcagtgaacagcttgcctaacataacacatctagtaactgtgaagatggtactggaacccaggaaaagattagccagggcttttttagtattagtggtagaaacccaactcagactagcttacactaaaaaagaagtacagttgctcacattactaggaagtccragggttggactaacattaggcatgggatagatttttgtggatccagtggttcaaatgaggtcaccacgactctcccgyatctcttgccatcttttggttatgatcattcttaggccagctctctgatgtgtggcaaagatggtcaccagtagctgaaggcctactaagtcttagagagaaaaggcatattcctctgtatcctagcatctatatcagtcctccatgaaggattctggttggccatgcttgagttaaatgcctgttctagtacccatcattgctgttatcaggattctggaatactctgattggacagcctgggtccagccctttagttgggaaagtagagacatgactgacagtctagaaaattacctggagtcagggaggagtagttcctacaagaaggggatgtaggagagacagacaatgtagtcagtatgctaaaagtctgtctgaactgctgataatttcaagatgttaaaattagttgggagtaagtgaaagttaattcttaaacccaaacatcgggagaaaagtagtttattcacacaaaaccccccatgatattgaaaataatattcatgaaaataatatgatattgaaaataagttctctgctgtctatgtaaatatagcaattttataaatttgtttgtataatgcctctcaacmtctaaggccagagcaaaaaacctaattttttaaaaacaaaaaaccagaaaatattagggaacagaagctggatgctgtctcagaaggtttgctagcaattgtagagacttgtttttttttctgaattagagcccctagtgtgattcaaatgctcacacttgaaaaaggacgttaactaaatagcatatgttaagaagaaaactctgcagtgggcgggcagttttcctgtttcaagtggagcaatgccctacatttgacatggttatggaaaaatcctgttatgatacagctcattgttatgtgggttcaaatacattgcaggcgaaatcatatttttgaaaagcaacaagagaatactgtgacagattcatgtaatatagggtatctttaacgggggccccaacccagacggaagacctccagacagttcttagcgttttgaagcagagctggggacctctttgtgtttggagttggtagtcacactgatgtcaaaaaagcatttattgagctataggatgccattgccaagggacctctgagagcctgtgccccaaggtgctgattttaaccacaaggaaaatgaggccgagggaggtgaaattatttggctgaggaaaaggagcctacctccctggcattccatgtcacaaacatcttggtgcaaaagtcacaaatagctaccatttatcaaatgtttcttttggagtagtatttcagagcctcagtggctttgaaaagtgctcataaaaatagatctagctgggctgtgggcaaatcagagagagagcgttacatcaaattacttttacttggactttacattcattggtcacttttaaaatacacctttattttctgtttgaattatttgaatattccatcacttgtgctgaaaaccagtatctctgcctacatatgagctccttgatgacagaggttgtctcttatgttttaaaatttatttttggctcttaaagtatctagcggccgggtgtggtggctcacacctgtaatcccagcactttgggaggccgagacaggcagatcatgaggtcaagagatcgagaccatcctggccagcatggtgaaaccccgtctctactaaaaatacaaaaattagctgggtgtggtggcgcacacctgtggtctcagcttctcaggaggctgaggtaggagaatcgcttgaacctgggaggtggaggttgcagtgagccgggattgtgccactgcactccagcctggggtgacagagaaagactctgtctcaaaaaaaaaaaaaaaaaaaaaaggaatctagcatagtacctgtttagaatgcaaatagtggtattagtagctaatgtttattgatcacttactatataccaggcactgtgctaagcatttgcacagattatctcatttcaatcttaccacaaccttgagagagagggcttatcatcatcttccttttaacaataaagtaatttaaattaaataacttgcctaaggtaacaaatcctgttaaatggcagcactgagattgaaccccaggtaatctgaatccagatcgcacactcttagcccctagaaaggttataaagctgcttaataactgtttgtggattagaactgaactgactggttccctcctaatacctctgtacccaggggaaaatgttgtcagagactcaggaggcaatgatctcatctctgaaaatgaccaagggaggaggaactgtgtcaatcacaataggcaactggacttgagaaaaggagaaatttgacctacactctgcatgtgctgggaagcttctctgggtaaagggtgggtggcttagaaaaacagtacaactaggtgagtactgtggggcacagtcctcttgccccaaattaggagtgtcagttaagtgatggtgtgccaaactttatactgttacaattttwaaatagtaggcaattgtgcataggcattccttgattctgtgatgcaaagacaacataatctgttgtagaygggagtttctgaaggtctttaatcctatccttgaaatataactgggaaaggtggagtgggaaacccttgggaaccaggatacttggcatttggctcagttcccacaaatctgtcagggaacactgggcaagtcacctaactgcttgggaatcagtttccttatccaaaaaatgaaaagtttggaaagcatgttatccttaaaattctcgctggctcttatggcttatagtgatgtaaaataatgacagcgactctaaaaaccgggatcacttctgtggatcttactctcttctggatctctccatttctcctctctcaattcctctcatacccttccccctataaatgtttgttcattcattcattcagtcttccttctattcagtaagtatctcttaaacacttggcactttggggccataatagcaaatagaaaccctccctggtcttaggtaggtcacagtctagttggataaatataaatatttggaaaatggtaccctggaaaatgataccattgaaaagggccataaaagaggaacgttctcattcttgatatagcacagaagttgggcatcattaaaggtgatgaactcaacttaaattcatcaaagaaacctgggtgtattgtaagtttttctcatttttcaggttaatgtgactttatcagaaataagcaagattttaaatccctcgttcctatagatcgcaagtttttaggactcccataaaacaccatgatttttttcttcattggaggttgttttacttgtattagaaatgatgtagctcataaaagggagccagttcaattcaaaacacatttatgggggcccacaagggaccccaactaggcagtgctttcctagagaagaaaaagcctacagggtttggattcagactgactgaatagcatttttccacttattaactgttaaccttgagcaaattgtgcttatctctgagttctcttgcagaaaacacactacctcactaggttactaggaagatttcaggagatggtgcttgtaaaaggccaagcctggggctccaggaatcttctgtccttgctttagttgctgggggatgtaggtgatacagacatgggtaggatttagtccctgaatgctgtcagggattgatagtctgggactttgcggtataggatactcacttggaagatacaaggtgtttgtttgtttggcrtttgttttttgtgttttattttatttatttattttttgagactggattgctctgttgtccaggctggagtgctgaggtgcagtggtgcaatcatagctcacggcagcctcaaactcctgagcccaagtgagagatgagtcagagccaagcccttctgctaacagagctatktgttgctgaggaagttctcagtttctcctctgaatggtgccaatatcctccagttgcttaaggcagagtgagagaagctgactgtggatacccacatgaagattaatcccacctggaggaatggggcaaggagctgctctctagaccagtcaagcttgcatttgaattgggcttgtaatgagttccccagaaggaaaacacacgcacatataccccaacagaaaaagcatcctggggctgtggactcatccattgtctttgataagccaacagagcatggtggctgatcacatgggctatgaaatcagattgcttgagtcctgctccactacttgacaggtaacctctaagcttcaggtttcccatgcatataacatggggaataatacagtacctgctttatattgttgctgcaagtattaagtgaggttgcgcctgcaatgactcaggataatacagggcgcataatactaagcacaattattctttcataggactaaacagaaatacatccctgagttcattcagttgatatttatgctacatttcttctaggttcccaccattctgcctcttttcttcctacttccatcagaggaacagggaggtagaaccagagtagttttttgtctccaaacaaaccatgttcttctctttactgagaaaactctagtggttttgcttggagtatttaaattgaattaagtacatttgggactagaattggctttttttwattattattattamctgaaattgcacgagtgcaattgggaagcactcatacaaagaacatgaaaaaagcagtttatgtagactatgggaacatgagcctaagtgtaaaagatggaatcaagtacagccccctccctccatcctgctccttcagcactttcctttcctccaccacttcattaagttggtagaaaatgaattcataagttgtcaggtgaaatacagatacttcctttggttgcctgggctgggaaaaatactgtatctaacaaagtagccctatacagaatacagtaaagagaccaattttgcaggcagcagaaaaagcattggatttagagtctgccaggctcagggacattaacttgcagtgagattttattgtgtctcagtttccattattgtaatacttgcatctcaggactgttatatgaatgaattcagacattacatatataaccaccaatgcagtacctgactccagatggaaactgagaaagtcatattctataccccagcagccttaggtttctctggtaagtttgggataaatatacttactttataaagttgtcatgaggcttaaagaaggataaatgtattytaaattctatacttagcaaagtgtctggtacgtagcaggtcatggtgaatattttgtttttgcaagaatatcagaatttattttattttttattaaaaaaaatgagatgcagtctcgccatgttgtccagactgctctcaaactcctgggctcaagcagtcctcccacctcagcctcccaagtagttgggatgacaggtgtgtgtcactgcacccggcaagaatatcataagttatatctccagataaggttttcaaagttcccataatatcggaaaaataattgtctacttaggatgtctgagaccctgctaagcactttatataccttagctcgttgaattctcagaacactgagataggggttgtcattgcccccattttatagatatgaaaactgagactcagagaggagaaatactttaacaaggtctagtagcttcttcatggcagagacgggagcctatcttttttatgtgagaatcagcccataattcatgctcctgcaaaagaaatgccccatgctatcatcccctagaagttgttttgctcagattatccttctttacagggactatgttgcatgaaaataggctattttattttattttagtgagttggtcttaacttacttctcatcttgattggtatgcagccagtttgactctagatactatttatttacctccaaaatccaagccatcactaatgcatctgacctaacaaaggatactttgaaaataagcgaggtctctgaagactgtttattcccaaatctgagatcccagacttcgggaattactgtgcagccttccccgctccctcttttttcctcctcctagtgactaatttagagatatctgagtcgtggaatgaaagcagatgtatttatagtcatctttcacagaaaaggggagttcaaagggaattcacattggttgattattcactatgcatcagcctacttatccatattttctcattttatttcacacaataatctgaaacatagtttagaaaagaaggtgaataaacaagaaagtagagttttaagctcaggtccatgtaataaaaagtgtgttcccttcccactttagccattgtcgtcattccatgagggcatcgggagcctgtgatgaatgctgtcgctggctaacactgtggatcaaagctccttgtggtttcttgggcccacagagcacctctgactccccacccacactcccccacctctggtttctggtcagtcatcttgcaaatgcatccccccttggttataagacagatggatgagagtgaggtctgcaactggaaatgtaactgagagccaattccctgatggcaagtgggtcgttagcgccattgctgttcagaagaataagccaccactgttcctgctgcctttttttcaaggcgacaaagtgcatcctgccataatcatggtgttagaaacctcagtcagcagtgctcagagtaagaggcaggcatgaggaggacaagagtgctgaacagtcttattataatggcgacaacagagatgatgcttgctttatataaagccaggtgcacacaaatatgtgtgtgcgcacatttttcctggctttggggaggatggtgtatatttcggggcagctccacacaaagaaatccagcatttacgttttgcccatgtcagtctctatttgctttcagatatccaggaatgattttcagagtatttgagaaaatgagaggtgcagatggttttcactgaggcatggtttcaaatttaaagaggattatggcccagaaatggtgagtagaggtgtgaacctttgaaattstaattgcagaccagtctgaggaggtatatacttaccaaagcacaatatctcattgtgagcatattcctttcttggccaaaggagatgggggaggagcagatacataacataatcttcaaatgaaactgaaacagcaattgatggcagcagtttggagtctttggtgaattcagtcaagaaagaaatccccagctgtctaccattgcagttagcttagcttgttgtaataatctttcttctttgcatctccagagctgactgtatacacaagtcggctcctgctgggaggaatctgtggtcattttgacacactcactcctttattttacaaaggatagcactaaggcccaagatgacagcatcagttactaggagggaaaactctggaacccagggcctcttggaattgaggcaattaaacactgacttttggcttttaataacagctcatatttattgagtctttactataatgccagatgaagaagatggaaggaaccaccacctcagtggaggtgacaggtgctagacgactacctggaatagatgggagaacaaaataaatgcaagaatccaagtctgaaattgtttccagcctagaggaaggaaggccttcttggagtgaagcctaagtgccgtgtgttgtcagtgctccatggggtaactgagtctcagagagcttaattagctyaactagcatgggccatatttgttccaagtcacagaattttccagatgcagagtgacttggttagtatgtggggaaggatggtaggattttctcctgggtagctcatacttcaaaagaccatgttctgtcaactatggcacatgagcaagtgacctccaggtatggatcttcagctgtctgctatcatcatctggctgtctcctctgaacttcaaacttggtgtgtcccaaaccaagcttttaaagtgctaatgaggacaaagtgggtgcctgtttatttatttactaattttttaaagaatgtgttttgaagttgacttctcaacttccctttgccagggaagaatatttatttatggacattccccttacaaaatttccctttaattagctggaacccttgttagctgaagcatggcctcttagaggacattgatgagcatctcgctggaggcacagtrcaggttcagtacagccaatagagggaggtgaacatctcacacttttctaatggctttcctgtgcacaaagcactttctcttccatcatcagtgaactcaacataacagccaggtcctggggttggtgtccttatcttttgctttcatgtgaggcagctgagggcccaagatgccatagacaacaggattatctgggtgacttactcttgtcattcttttctcaagatgtcaccttgtcagcaaagccttctctgcagattctttatactatagcgactccttcactttcttactttatatttactccactttatgtatttgtgagttgtctagttctgtcctagaaggtaagcttcatgagagcaggggccttggcattactcaatctccagggcacatagtgcttagtaaatatttgagagttaatgaggtgctgtattttgacagccactctgctacttctgtgtagcaggcccaaggctaagacaagatccctgctttggggcactcccttgtagtcaggggtaagaaccagagaacggatgtgaggcttaacagtgcaagatgggccgggcgcggtggctcacgcctgtaatcccagcactttgggaggccgaggcgggtggatcatgaggtcaggagatcgagaccatcctggctaacaaggtaaaacaccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaacagtgcaagatggcagaagcccaatcccgggggtgaggggtagggcgcggtgggtgtgtgtcgcagaggacaggctcagccttccatcctaaggctatcaaaggctctcctggcttgaattacaggtaccaatcctgtggcccttcccaaaggcctagctttttttttcttcttcttcttcttttaaaccaaattcatactcagcgaatggtgagaaattaaatggattcttcggactaagtagattgagctagttttaaaattagccatctgtcaaggccgaggagtgaggtggtactttttccaccgaaatttggcatctgcttagcatcgaacaccatttgcagctcgggcaatgccttttacattccctgaccctcggctttcctgcaagttaaaaaaaaaagtgcaaatgaaagattagaaaattattttttttaaaagcccccaaacccttcattcgtcttcacgctgcattgtagcgacctaaggcaactgcacaaaaccagcctgtaagcggtgaggagcaccctgcagagagatggggcgagcgggcagctgcaagcccgggccccgggaggccgcccctgcgcccagcgcttccttcgcggggtcgaaggccctcgcagtagaaggcggctctcccggggcctcacttcctgcacccacacgcgactaaaaaagaacacgtacaggtttttgggccccctcttgcaaaaagctcagcgcaacgagctcgggaagggctccacaccaacgagggacagggctatcataaggggtaccttaccacaacgcatccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcctggacgctgaaaccccatgttgtggaattcgcgcacgccccagcggccggccggagcccagacccccgcgaagaccccgcgcgcagccgcgtcccctcccccgccgctgaggagctgccgccgccggcatgagcagagggaggcgggtcccggagagccccctgcctcgcgcgcggcttggagtttgaagggccccgcgccgagccccgccagcgccgccgccgcctgccttcgcccgcctccttccctccctctcgccgctgccggggacgggagccgcgcgccaggccgggcggcgggtggcgggctgcgcgccggggttcatgagcctccgggcggcccgcggccccgggagcctgcgccgtgactcaccccccgcccccgcttgtgtctcgtccctcccggcaggatgccggaccagatctctgtctcggagttcatcgccgagaccaccgaggactacaactcgcccaccacgtccagcttcaccacgcggctgcacaactgcaggaacaccgtcacgctgctggaggaggtaggtcgggccgggacccccgccgtccacgctcgccgctgccgccgcgcagctggaggatctcctctccgagctgggaggaaggggacgcgggggccgggggcgccacaccccctcagggagccgccgggtgaataagggacttcggacgggcggcgccttccccatctcctcgccctttctgggtcttgcgggttgaaaggcctggggactggaggtgggagaggactgagcgagctgtggacactccagggaggacagaagatggaagtcctgtccctggcatgcactgttcggcgcttccacatcttcgtgaccctcctgtaaccctcgaggtaggtggcgtcaggccaccgagggcccagaggcgaagtagtgcagccaaggtcaccagcaagggactaggagatgggcagtgaacgcacccctcagcggcccgactggaccaggcaggcgtagctgcggagacgagggccgttggaaaaatcccagaggacccagagagaactcaggctgggactgtatccactccaggagtcctccctgttagtctctggtgcctgaagcccagatggaaagagatctgtgcacataggtttccacccggcttccctaacccggagggtttggtagggcttagggctgctgcgccagcaggacctgcccgcagggcactccgaggctggacaaggagatcggaggccggtgcagcctgcttgagctgaccagacacggagaagggaggcccgaggcgacagtcagacagctcctcttacctggacccttcaggaaagcgttgctggtggggggtggggggcagggccaaggccaaatcgattttctttaggattttcagtgagttaatgagagagtggtatgggcaaagaggaacctgaaagccaaggagcagcagaagcctctggggccacgataaaaataggatatttgcccaggaactcagcatcatcaataagtgccataaagcatccctccccttcaaacaaggcaaacgtatttcaactgaaaatggcaccattgggtggaaagtaggaagggagatggttttccctgggtgggttatgctgtggctggtttaggtgaggtttggggagctctttctgatgtaagccccccaccccaaggacggacctctgtaatatggggaagcttgggcttctgtgggccgactcatcttgaaatgagctttgatactcatgtttccacacacgtagaactgggattcagaagtagagggatcccaaattttaggaggagagagacttctgttagtgctgggtcccatctggcctgcttggtgctatgactgaatgtgtcattccggcatacttccagagttctctctggagtcagtattgggtgatgggactgaattgtgaagtgaatggagaaataccacctaactaggtttgtttgaaaaccagaggtaaatggattttttcttttcttttttctttttttttgtctttgtgaactgccagtctgttatactcgtctgggattaaacagaattgccaggcattgaaccccatcatgggtctgtctttcacttaattgtaataaattgaaacatgttgatacaggagcattttgcatcccctttctgtactaattgtatatacttctaaggatgtgacattgattagactgagtggttattttccttctagataagtttttcagtgcctcctaatagagctgccagttattttaacgttctcttcctgcacatttagatagtgttgctgtattctgtttgtgaagggtgtgataagattaagtattcggtgatgctgtttgtagaggtatgcgagcatattttccagcaaccctgtagtagagggttaatgttaaattacatgcagttgctgttgatgttagtttaaggttaataaatttaaaagcaaatatttttttttatgagaaatactgttgtaagattaggtagaaaaatagagttaactataatgcaagtgtagtcacttaggaacttggaaccaggctagaagttcagtgtcatgttagagtacattgatgatacccatgttctcaaaaatatagcaatgtttcaggatggcacaataattttacaatttttattctgaacttgaggaaggtattggccaggaaaacattgtctccggtcggcatattttaattcttgaggttgcactctcttgagtggttactttttgcatagatgtgaaaagtatgctttaggtttttttactgawggatagccaccatagttgaattttaatttttcccccatgcttacatatgtggaagtagtgcattattataaatatcttaggtgggtcacaattcagttctttaaaaatatgggrcttaacattaccacactcaatataagaaaaaatttgggggcataccacaaaatcttgttggcatatgcttcacaactgagatatttggaaactttaagaatgtggcttgtgttattttgtggttattcttaggaagagaacttttgggtactttttggtgatatggaaactccggaataggaattaatttgggtaacttggaattctcatttaaaaaaaacattttcctagttctagtaagtaccttcctgttgatgacctttttttgctctttrgatcactaatgcacatacatagagcgcaactgaaaaactgttagatctccaagattggagccccaaattaatccatactctttcttttactatgtctccttggtagagattgtggtgtgttgtgcagatgttgatgctttyagttaaatctctgtgatgagcactcttggaagtagatgagaaatatatggtaagaaggctgggcgtggtgggtcatacctgtaatcccagcactttgggaggctgaggcaggtggatcacttgaggtcaggagttcgagaccagcctggccaagatagggaaaccccatctctactaaaaaattagccaggcatgatggcgcatgcctgtagtcgcagcttcttgggaggctgaggcaggagaatcatatgaacccgggaggccgaggttacaatgagccaagatcgcaccactgcacaccaggttaggcgacagagtgaggctacgtctcaaaaatggtaagaagaggcaaagaggagtttacttctggtttacttctgggctttaccttttggggcgaagggtcacacatggctcaggggttcacggtttggctggcacacaatgagtggctaccttggggaggcaggaatggatgagctggtgttctgccaaggtttcatcctggcgtgtgagtgttttccaagcaaaaagccagtgttttacttattcagcagtgaaagcacactgatgtgtgccattttactcttgacmatttttaagttatgagtaagtgactaggagagcataagcgttttccctaaacgggagcaggcaggcattttaggactgctgtgacccagacagtagaagggaccctctatttaaagacttagagtggctaatacttagtacctttgtcagagagagagtccaacatgataaatggaagtctacttggttattttatattgggccacattttaatttggtgacaatgaaggaggcaagttctgctcatttattgagcagctgctccataccaggcctgctgtcgacacatggcatgaatgcttacatttacctctcatatgagctctctgaaagaggaacatttatcgtttccattttatagagaaggaaattgaggcccagagagatgaaatgatttctctctaaggtcaagtggctagtaaataaaatggaatttaaaaatctccctcccggctgggcgcggtggctcaggcctgtaatcccagcactttgggaggccgaggtgggcagaacacgaggccaggagatcgagaccatcctggctaacacagtgaaaccccatctctactaaaaatacaaaaaaaaattagctgggcgtgttgtcaggcgccttgtagtcccagctacttaggaggctgaggcaggagaatggcatgaacccgggagacggagcttgcagtgagccaggatcacgccactgcactccagcctgggcgacagagcaagactccgtctcaaaaaaaaaaaatctcactcccttctctccgtgaaacaggctctctcactctgtcgccgaggctgcagtgcagtggtgcgatctcagctcactgcaacctctgcctcccaggttcaagcrattctstcacctctgcctcctggggcagctgggactacaggtgcacaccgccatgcctggctaatttttgtatttctaatagagacgcagtttcatcatgttggccaggctggtctcaaactcccgacctcaagtgatgctgcctgccttagccttccaaagtgctgggattacaggcatgagccaccacgcctggcccagagtttagaaatcttaaaacagttgagacataaaataggtattctaaatgtctacaaaaacatatttcagtggctttatagggaacataggagactttgctgtcattgcaccttcaagttttggtctgattaaaaaaggtgcctaagttccttggaggcttagtgtttcttcatgtttatatttcagagttcttaatagtgatacttaaatatactattttttccctgtactttcgaagatttggatatgagttttcagatttaaatgtgggaactcatttgagtataatccgtgaacagcatttgttcaacacatttttggggaggccctgctatatacaagtcattttccaagtcctactgaggtattggggttatccagattgtattatggagaagctagtggtctttaagaaataaagaaataaggctaaaactctttaacagggtagaaaggggcagttcataggggagggaaatagtatagaacattcatcctaggaatacaagtgaaatcactcaaattaccatgtagtcaatatacagattgttcagtgcctcctatgtgcccagcagtgtgctaggcccagggatacaatgaagaagaaccctgccctcaaaaaatgcagcctaaaagttttcttatggaaactggaaatcaagtttgggtctggcattagaggcttttcttaatgtattcacctggtgtgttcagttatttctgaagatatagaaatgtttgatgaaatgaatgaagakacagaatgtagattcagtatcaagctctatctcataacagtaacattcctactacatgcaaaccctatacatactattatttaataccttttttcaccctactatcatcaatggctccattttatagatgaagaaattcaggattacagcagttaagtattttgtccagctaggtcgtacagccagtaagtattctgcccaggtcatacaaccagtatcagatttgtgattaatcgcattactgtcaagtcctcatgcaggccagtcagacttctgtgtgtgttccctcaccttccatttaagtttcagcctttatctatgtccttttgggtgtctgccatgctgatgatagagctcatcagtctttgataaatactgttaggtccttaagtgattttctgtgaaatcttacgcataggatttctgtggtcagggtttgacgtctgatcttgttcgtcagctccccttgctcaagaatgcaagtgcattacctcttaaattttaaaagctggtaaacttaataggaagtgcttctttatattgcaggtgctaaacttaaggagcccattaattacccccaaggagattgtagtcttaaaaaaaaaaaaaaaaaaacccttaggaaggatttagctaaaatcaagatttatacttttgcttaatgtagagaaagtatgtttgggtctgtctctgacctcttgaagataatacaacaaaaggcaaacaaaccttcccataatgtttctctcccacacacaagtcaaggctctgtgcccaggcttttgacccagtctggaggtacttaggatgaggttttgtctggatgaaaccagcaaaggtcagtgagtgaatatatctgtctgtagaatcaaagggagaaggaaattgtatatgttggaactcatgctctttctaaaacaaggcacaagcctgttagccagatattccatgctaatgcttttggtcctgatatggtttggatttttgtcccctccaaatctcaagttgaaacatagtccccagtgtcggaggtggggcttggtgggatgtgattggatcgtgggggcggatgcctcatgaatggtttagcatcatcatccccttggtgataagtgagttcttgctcaattagttctcttgagatccagtgttttaaaagtttgggtctccacttttctctctctctcgcccctgctttcgccatgtgatgtgcctgctcccacttctcctcctgccatgactaaacactccctgaggcatccgcagaagccaagcagataccagcgccatgcttgtacagcctgcagaatttcctttctttataaattacccagtctcagatattcctttataacaacacaagaactgcctaacacaccttatatatatatctttggatttaaaaaaaacattttttacacctatcatctaataaaagcttattctagtagcattcttattattgctttacatatgaatacataaaggctcacagacattaaataacttgtccaagatcacacagtggtaaatggtagacttgggctctgaatgcagaatctgcattgaaaacccattccgtttcttctgtatttcactgtcttttatgcttcctgtctgccagtttgttttgtcttgcaggacccgtgagaaaggcatctattaattatctttttacctctatttggtttctagtgctagagagaaagagtttgggagagggaagaaaaatgaaaagatagttgcttttctctgttcttctgagacctcttgctggacccctcagtaaatctctgccttttgtgatcaaagacagtgctgcaagcaatcctycttggactgggcagatgtgaaaatgaccctgttgcttccagctccaccctggcatgcttagtctgggactgttgacccaacytgatttgcctatgagctgcccagagccctggctaaagaaccactactctcagttgcagtttcttcagggctgtctggctgtctgcttccagcttcctggctgtacaagagccctgagtttttgctgggtgttagttattcagggaattgccaagtgtccaagtaaaagcgaccttggagaatatctactctggcgtttgccaacctgaaagcctgatctccaaaaggctcatgaaagctgtgatgggggtctgtagccactttgtggaaaaattagtggacactgctagtaacttagtttggcataactctcatgccaaatgtgtttgattttggctgaaatgcatcagctcagtggtgtaggacgaatcatcttctgctgatcagatgcttggattgccagttataaagtgggaaagcaaagtgttacctcattgaggtgattggcttcctagaagggctttgtatctccacgggaggaacctcatgaatgatgggacccaccagatctagtttagtcctcattgctttgagaggtggagactgaggcccaaagatgagacagaaaccatgcagggatttgaattcagggctgcccaacccagggatttttgcactctgctgtttaacagggttgtggggactggcaattcacagtctgggagtcctccccagtaccactccatgtaacttgcttctaggtggaaagagtggagagtaaaccttaagtttggaactggatcttgctagcccagtctgctgtcattaagtcctggtctcagaagacacactgtgcgaggccgcagtagctttccctgatgttaggctagcagcctttcattagaagccatttgtggtgttggatgttcaaacactacccagacctttgccttcattgtctgtttgtccagggagcctcagagagatggtttccatatatgtaacctagtcatttggggactaaaaccagatctgggtcttggccattcccacatgtattacttaaacatgagtaaggtttggggctacacttcatgtctaagcctctgtttccccatttgataaataaatgacattgctttttgagtattaaaggaggcaatgcatgggaggcactcatcaaatgactttatgtgtcagtaaagtatgtccctatgggtgtcaaggtctgactactcagctctcctgtgaggcagggaagaaggggaggcaaatgaggctagaagcattccttcatggagagttagataggtaggactgctctctactgaggaccagtggcaacacttgggttgaggagggtgaaattctcttgccaaggttaattgtatccctattacttctagcgtgtgttgggcaagttactgagccttactgtgtcctactttcctcatggggataagtacctacctctcagtgagtcagtatctgtaaagtgcttacaacagtgcctggtgtgctaagtgctctataaatgattgttcttattatccttgttgctattgccctgtattattgtattattgcattagacaattgcatgtgtaactgagaagatgagacttggtagactcatttctgaagggtcagtgatgaggtcagatgacagagaaatgaagtcagatgtgtatacttcagggacccggactggggaggcacagatgggactaaggagaggactarggcaacaccaaacactttgaccattgtgggtcatggtcatagccaatttgatctgaagcagactgtcaactcagtgtaactgtataatcagcccttagtgggctctgtactctctgaagtaagggaaccagtgaccagtgctgcccactttgacccaggccagcctgatgggctctaccagtgcaacctcattgcccatgcttccttgtgtcactgctataatctttctgccttcttctacaccccactcgtcgagtcctctccattggtgtgtgaaagctgccccttctgattcttgctggggctttggggtaatgagctgttttctctgttacataataaatgcaggtatttattatgtacctgcataattgattgtggtcatttgtggggaggtgaaacatttatgccttggccctgactggtacagagcatggcagctaggttaggtgctttactgattacagtttgaagcactgagaccacaagaaattctattttggttaggaggcaggagccttaaagcaaaagagatctctccttgaattttcatttctgtgtgcttcatagcttgttttcagtgtcagtaaaacgagttttaattatttgtgggcaggagttaggtcaagatcaggaggcacttgactctacttggtcttaacagaatccaggagttcacagtaggctctttccagcccacagccctgtctgaacagccctctgtcatggtgctgtttgtggtcagttgtgtaagaactgaattttaatgccaagctatggtataattttcccccaaagaactggaatatgtgtccccttgataagacagcacctaatttagccactcaaaagctgggaaaataaaatcagaacctcatatgccaaggaggtaaagcccaaaagacgactgcattttggcaccaactattatagaaagcagagttggctaagtcaatctaggccacccctttccctgccagatgcgttttgggtggaggaaaatgtaagctcttcttagctctattattaaaatagcctggataccttgcatttctgtagcattgtacccaaaggctagggtcagaatggccttgtctccagtgcctggtatagcacccagcacgcagtgggctgtaagtatagtgaggactatgttattatgacgcacattctgtagaactggaaaaggcctcagagaccatctagtccaactcctctttttatggatgaggaagctgaggcctagaaaccccaagtgtgttaggctgttttattgtaagaggtcccttccccttccccagcaaaatgaaatacattggttaaagcaaaatggggacttattggaaggattcatgggagatattttatggaacatgaggggcaagaatgagggtcttctcttttgggcaaatggtagatgaaggcagctcgcaccaaattattcccagctccagtgccctacaccacattggtgtctgcctgattctgaggcgaggatatctgggaaggaggattggattggctccacttgggtcaggagaccacccttgctccagtcagctttggccaggatgagggggttatgtgatgggtggggctaagtcttcstcttcagcctgggggtgatggtggtcctcagaggagagtaggaggatagggaagcacaccgtttatacccagatcacacagcaaagctgggactagattcagttcttctggcctcatcttcatttttcattgacatgacagttaaatgtaaatgatggtacttcacagctgttgggagaatcagtaggaatataagggaggcagatgcctggcactcagtgacgcttggaagatgttagtttctctgcccttccctctgcaagtgtcacctccccttgatcctttctgctctgtactcatttgggatacttggaaggactgtggtcagagcactgtgctgcctagttttagctttgctgatgtggtcaggaaaaatcaacattccacatagggtatggccagaaaagaaacatcccattgccactaaatccaaagtgatggcatggtgctccttgaataatctttccgtagatatccaggatggatggaagaccaggcagggcaacttggctgtcttcggaaaatttctggtttaattggtttttcctcagtgttaaataacagagcctgcttaaaggtccagtgaggactaatggctttacttccattgaacggcttcttcactgcccagttacatacgaaataaaattgtcttcattgttttgaaacatggggagccttcctttatgttgcattaatcattttttatgatgcccatttccttttccttgtaatgtttattcacattaatagcatttacataaaattagatactccttatttccacaaagtacaaatcaaaataagcactcactgctggcccagcagctgctgctgctttaataatagtaatatttttcatagcaaggcaagtgaatacactgcctcccaataaataaactggtgccaagtcagtgctgtcacatcccaaggcttctgcattttgtgtgtaagagtttgaacaaattcagaatctgcgaacattgctgttaagaacctactctatgccgggaactgtgctgattgccctacccatatcgtctcatataatcctcccaacagccctgtggggtgggtgctgtttcttcatttcacagatgatgaactaggtttagaaaggattcaactcaatttatgctctttctactcagactcatcctcaaraaaaaaaatgcagatatgcatgcaatgctaatgaaaaagaacaaacaggaaataggcttctgctgagacatgagatatgtaggttagactcaraagaacttcctgacagtgtattaaataccaaccggatggccatggaagtaggatttttttcttcctgattttgggataattttgtcaatgataggctggtgagctaagttgtgttcttattcatgttcacgtatgtcttcacttttagtagattgtaagtacctcagggacatcccccctcactttttaaccctaggtttttaaacttgttttgtttttaatgtagttagcattcagatatttgagtaaaattatgaagattgtagcaaaactacatttgatttataaatcttgaaggcagacctggtaaaaagttttccaaatacggttaagtctacctctctgggctttatatatatgcctaccaattgcatagagcagttggaaaaacccacagttactaaatttcttgaaggttgtgctgcagatgcttagcagacctgaatgctaaagccagattcctagtctgtccttttggtgtctgcaacctgcagtcctctgttggcctagtaatactagtcacagagttggctgtcactttttgagtaccagctctgtactgagtacttttttgtgatgttgcccaggctagtcttcaactcctgagcttaagtgattggcctgccttggctttcttggcctctcaaaagtggtgggattataggcatgagccacctgtgcccagcctgtactgagtactttacataggctgtttcaaactctcacattaccctgctagtacctgagggaggtgggaatcaaatctgggtttgcctggcyccatagcccccacctccccactgccaccctgccttgctttggtattagtgatttagctgcaaagtgcaagtaaacggaagagaatctggttagcatttactttcttggtggaaacaaacacacatacagagacacaaacaagacatgcatctgccagtggaaaaggaaagcatttttccctcctgacttgtttctttcgagttgacggggaggcatttaaatctagataatttacatcatgcatctggggcagccagtcacaatatggtatgaaagggattaatgagagaattggtattttcaaaaagtattgacctctcagatttttctttatggatggtaagtagtgaatcatatgattttatgagcagttggtgccctgagtttactctccagcatttctgcgctctgttataatatattctcatttcgtccacacarcactttgttaggcaacaaagccactattttctcatttgacagatgaggaaacgggctcaaaaagttaaaaataatttctcaaaggtcatttgactgaaaaagcatgatgaggcttgagttcagttctgccaaccagtctcccccttcactttgaaagagacagacctatgctggagatgttttgtcaagtaatttgtaactaaaacaatacctttaggactaaaacatacgggttttattattggataatttcatgatactttgcattattagattctccttcctccccacctcccccataccttttatagtctgttttgcgctagtagctcagtcctccaagtggttttttactttgggcagtttttctttgttgttttttgtttgtttgtttgtttgtttttttaagagacgcaatctcaccctgctgcccaggctggaatgcagtgacataatcatgcttacttactgcaggttctatctcctgggctcaagtgatctcgcttcagcctcccaaaatgttgggattacaggcatgagcaactgtgcccagccagtttgcttgctgttaacttaaatttttgcacatgcaatagcagagcgacatgtaactatcattcagtttcaacaattgtctgcttttggccaatctttttttcatttctgcctccttcccctgattttttgaagcaatatcaggtatttcatttcatccgtaaatacttcagtatgtacttctaaaagataaggacttgaaaaaaataaacctgaaccataatatgttttctcgtctgaaaaaaacacttcctcggtgtcattaaatattcagtcgctgttcaaatttccctggttgtctctttaaaaaaaaatggtttatttaaacggatctgtatgagatctgtatgttgaaattcatggacatatttcaaatttcttttaatctgtggattcctccctctttttttcattgtaattcatttgccaaagaaagtggtggtktatcccgtagtttcccatagtatggatagtgttgactgcaaccctgcactgtcatttaacgtaagctacagtctactcttaacagacttttgttattaataatttcctcttactaaagaataagaagaacctattccctttgtagaaaatgaggacaagtataaaagaagaaaatttaaaagtcatccataagcccactaaccagaggtagccgctactgtcacttcaagtattttgctcagatacatctctgtcctgcttattttcatttaacacatcatgaacatttccacttcattaaaaagtcttcaataatatttaaaaaggcatgtcattgtattaaaygtttccctccctcccttaagttgctcccaattgtgtgttttgtacmgttggcttagcagtttcaccaaagggaggacctgttgttcaccttggagcrgtgaatatttgtgtatatctgtcatattctgctctagtgttgatagattcctagagttggagttagaggctcaaaggccaggcatattaataaatttcttatatatttgtcatattgccagcttgtttcaccagaatggtggtctttgccttgttccagccctgggcagcctaggaaagtgcttttctccacagagggacagctttgaggtctcgatttaagtttctccaaaagaaaaaactgggctctgaatgtgctgttgcccttgtgtgtgttggtgcattataagttacatcaagcgagtaggagtagtgaagggaaaaaggagtgagtgtgggtgttttcaaactctctgcttagcagactgaaagccagtgtcatctcagtgttagggggtggtgagtagctctgccttatcagcccgtatccgccttagtagtgacttctctatctgccccatacagcctcttgtctgaaattcctgcttaccatggaaataagtttgttaaggcctctctcttgggctcagaaataaataaatagcattcactatgaaaaggggaaatggttaaagaccagacatggccagcttctagcctgcctgttgcctgaccccaggtagtgcctccattcttccttgcctgaacattttaacctcccatgactaagtcacaggacatttctccagctgaaaacctttttggcttagtaagtatctttcacagacccaacctgtactgccccttcgttcacacatggttgtgaattagtttggttgcttcccacttaacacttggcagagaagtagggtgggaagtatcttggagagaggggtagaagttagatgtgcctggaggggtgtagggtggggggcaaccaggttcttggagcaacttgaggggaaggagaagaggaggaggagaaggtgccaaaagcaactttaacttgtcgtttctgagagttggcatcttttttaaaagtcaagttatatttcacattttgtccttgagctgtcctttggctagggaaccccatcactttgtcatgtgagtttgttacgttttgtgtttgtaacagccgcttttgtttttcttaggatggtgctttctcagttccagaagtttcagagaggccctcctcagtgtttggaaattgcttctgggtatattgggcctctgcttccctagggggccaaatagcagctatctggagcatctttccctgtggatttcagcttagaatggacatctgttaagtcaaggtccactcttggtagaatgtgctgggtttcatgctgagtactttacccacggtattttacagaaggcctctgttactggatgttctgaggagaaaatctggaaagtaaacaatattaacttcattttacagatgaraaaactgagggaaggagtgacttgacgaggatgtgcagtcaggggaagctggagtttgtgtctctgaggtctgtggtcttacatgatgagtgccacccttgccaatttgccttcttcatcctcctcaccccctaagacttcttgattgcccttggggtctcaggacattctcttttccacctcaccgtgaatgccctggctcaggaccgacactttcctttccaaagtctgctttcagctaactcttggaaggaaatctctcccatgtttcactcaaaggtataaatgcctgatgaggcattacagcaacttatgctgaagttagttttaggtgttgggcatggagatcctgtcacaccttacagggtagctggctgtctcttcccatctctcggtccagtgaacccttagaaaacaatgccaagagtctcctagtttgactctcgtttcttgctgctcttttayctcttatttgttaataaataattatataaataaatgcttttcctgtttctctttttggtgccaggacttccctaaagcctgttcgtgaaccattggtgactgaaccttggtcacttggtacgtgtccttcactgggctgggcagtcaagttgaagacacggaattatttaatctttgcaccagcctcatcaggtgatgctctggttcccattttatagattgtggaaacagagactacttaagaggtgccaggctgttgacacatattttatcctttgatcctcataacaaatctgtaatgttagtaatattttaattttcaagtaagggtcctgaggcttggcagtcagcagtttyctgtcccaggttttactgccgaagggaaagaaccgaggtttatacaaagatctgtctgaccctcaagtctccaagtctctgccattaactgctctgcttgcagttcttacccaagatcccacaactgatgcttggttaagtcaactcaagcgcttagacactgtgggtgcttcatggagcttactgaaaacaaagtgagtcatggataggagtttgacattgtaacacttgagccatacatccatttttgagaacagggtggccttcctggcgccctgcacccatccaggcaagctgtgggtggtaggtgtgtttcactctggagcagtcagttggaagttttgtgtcgactttaccttctgctgtaatgcatcttgtcactagacttagtgacttaatttgatctgtaagcaccctcacagccacgtggtgttactgtatcacatttaatgtcggttaaaaaacactctaaaaaaccacccctccaccactgccccccagcgacaaaacaaaaacaaaaacaaaaacaaaaacaaaaaaaaacctagtattttattcccttgaagactttggaaagattttgtcattcatcgcratgattggtcagcctcaagaagcatgcaggagccatcataagagtcacaaggtattaagcttcctctttggagcctggtagtgtgctaagttctttatgtaaattttatccttaaaatagctttgcagagtttctccatttcacaggaagtgaatgaatgcttagagaagatcaataaatgcccaaattgcacaactgttatatggtggagctaagtttcaaaccaagtttcttaactgttccatgtcacactgctttcttagacgttatagcctttttaaaaaggagatgtggaatgaacatttttaaattcaaagtttaagtatacacacacattttatgcattgggtacaagagtataaatgccatgaatacttactaatcagatatttaatatctgcttctgccctttctcctagaaaagtgatagtatgaagggagacagagtgatttgttccacacccaacataaattattgcccagggtgagttaatttgtgtttatttctgaagtggcagtggttgcttcctgagggtctaaccttgtttgactsttttgtaggctaaatttctgcaggccttctgcagagccctgtcttcttcctctcagagacaacccaggtgtttttcattccctagaaagttcccctttgccttgtagacacctttttcacacagatgtgtgggatccttggtaaacagtgacttatttggggttatttctccagccagtcctttcagccttttcttcacgtagaacccactgtgccgaaatgttggttttaagcctattgcattattgttttgaggacaggacttatttattcatctgtttatctccaaagcctgcgacccagtagaatgaaccccatttgaatgaacaaatgtacacacacggaagccttgaagaatttaggcaaggtgagcctggctctgtgtatggtggaagtgaggataaggagagtccagaagaagtactgtctgtaggactgaccaagagggaaaggggaggaatttcaggacttgcaggatttcaagggaaatagtgtaatcttagagttttagagccagaaggagccttagaaatcatggaggtcaaccatctcattttccacatcattgagatttctcatcagtcctgagtttacagccactgccaactgaccttcagggcacagaaccagacatacctctttaagttagtgcttttattggttaaaacacttcctgattatagcattgtgttttatgttttaagtaattgatttttttgtgtttgagccctaagatgattttgtcaggaaggaagctatttttaaacatctacaaaccaagcagatagagcactgccttcaagtggaggagacttaccccatgttgaatcttgtgatagctccttctttttgctgacttccgactctacttgctattaatatattcccctccctgaccgcatcgatgtactcaaggatacttgtaaatttgctgattcttaaaattttctctccataaagtcctaaactgtttgttcacctcttccacagcatggtctttaaacaggtgtgaaagtttccagcgtcttaaatttgttcttaccgagaatttttctttacgttattttaccttgagatattggtgaagaaacgatagcccagataagtcaccttgcttgaaactttagagagggtgggtggctactggttaagtgttgagtccaggtgagatgattcgtgtctatggcttttgccatgacaaagaccttttaaagtctctccaatgaagagtcrctgtatctgtatttaagtttccttaggattccttgagcttgagggttcattccccctctctcctcaggtgctgtcttcctgactgctgcacttcttaggtggggaataagctgctcattagtgcccaggtgcttttgttactctgcccccatcttgtgattttgattgtctgcccagcagcccaattctggaccaaccagtgtgcagaaagagcccagcaactgctgctctgggggaaatgcccaggaaacagtcctcagaaggattgtgatccactgaagcaacaaggcagccagagcagcagtaggaagtcagaatttctgctggctctctgtgtggagcattggtgtggcaggggagatgggattgtcctcagcattcagctgaggaaaccaggcccacagatgtcatgtagtttgaaggtgatggaaccggagccactgttagcccagtgtgtacattttccagcacaccccattgcctgctgttaataaaagaaatggaaaaaattccacacagatgcatgactagctagagtcattaaagatactgcagagtgtttgctgggatgactgtgggcagtaaagctattggggagtagtcaggataatgttcttttcttggaaggagagtcctgtctttatttacctgacacgtatcttctgttgttgctggctgttctttgttgaatacttcccctatgcagaatactttaattgtagcagctaatttttattgagtatttgctgtatgtcaggtagttaactacatccactgatgtaaacctcatgaccaccatttaggtaggtactgttaagcctgctgctgccacttaactgtgcagttttgggcaagttactttacttctctgttacttaggcatctgctgccagcatcacctataaatatatacctttttctgaactgtaatatttgtattgtactattgcatgggtctgttgtgagggtgaggtgaacgaatgcatgtaaagcatcacaggctccttaggtcgtcttatcccccagtgcccaaatatgtgatctagggcaagccacttcaccactctgagcctgttcttcctctgtaaaatgagtgtaatatgtatttcaacgattgttgtgaagcaaaaatgaagtaatggattaggcatcttacactccacattggtatgtagtaaatgcacaatagaaatagttgctataattgccatccccatggggaactggctgtcactattttatatgtaggttcgattttaggatcaagggagtttgctaccaagtctggccattgcctcttctctgttctgacttaagagaatgttttggtggatgggtgagatttcaagttgagaggagaggaaagtaaaagacttataaaaatggaaagaaatgcatgaaaacagatgtattacagaaggtctttgagaagttgtggatgaggtttggctagcctttagtacttcaattttcatgggaaggagagaaacctcttccttcacccccatctatacataaccaacttttatttcctgataggattatgtaacaatttttttctgttaattatcatggacatgttaggatttgattatttggagaggactagcatgcttaattagcgttcagaatttacartttataacagggctctctttgcagtgtactcatttttgttacactggagacttctaaaaaagcaaaaagttgccttgattatcaatgaggaatcaaatgcaggtggttggtggtacaggaaatcaacccaattactgattaatatgagtgatagagtgattttcctatgatcttatttgaagcatgcaccactcaattggagttaagatgatagttacaagtaagcagatcctaaatcaaacttaaatgtaatttaacatggaaaacatgaacatcttttaaaatatttttgaattaatctcacccttttaccaacctgtggcattattttcttgctgttgatgcccaagcctttccttatttcctcatacaaactctgatgtgagtcctgactggsttagctatttgtgattgtccctattgtaaagatatgtaaagtatggtctggggttccctgtgggaagtcccaggatccttccaggggttctgagagatcaaractatttttatactaaggtcaagacattttttgcccttttctctcttattctttcataaatttatagtttatgagactggagctgtttgggagaagtagtttcttsaaatgttctctggtggtttcattgggagtttagtatctttttagcttttctgctaggtctgacatctatctggcttaccgtcttttagagacaatgcaaataggtacttttttgtcactgttcggtgacttatgtcaaaatgaagactgtcaaaaagtatttttccccctggttggctttaccatgctcctctcagattgtaagagtatggcatcttttctgaatctctttgatgcatcacatgatagatgccgacaccattcatcctgccttagtctttatttcttttacccatgtaaagtgcctaataccaaaactggtacatagtagacattcatcacatattagttcctttggtttattgccttgtctttatccagcttgctttgaatgtgtttctcaaacttcaatgtgcatacaaatcacctggagagcttattatgtgctgattctaatttggtaggtttggggtaggacccaataatctgcatttcttttcaattctcaggtgatgccactgctgctggttcactgaccacactaggaatagcaaggatgattgatgtatatataaccttaaacatgctcccgcacacatgcccttttgtaactttgccttcttctcccccactgtgattattaagttcgaagcaggaatcattgccttgagttgattgatcactgaatttattcagcaaacatttatcttgggtgatatgattgttttcacagggctgtttcwgaaacttygttttgcattatcttaatcccaggtgtctatctctggtaggctgatgagacartttggagttgagtagtcttcattgcatgcagcctggtcttattctggggctctcttttcctgtctcacttggaaatttcatttcccagtaatcatacttcataaccattaagttgcttggagttcacacttttttcttttagtgtcctgaaacttatttttgactgactcagaagtactataagagaaataagtttccatatcatttttattaacctcttgtttagattcaagcctacagagtagctactcctgttgtgttcacaggattttytcctgagctacattttyttaacctcagactatctctccctgaccaaagagcccagtagtccttagtggggtggtgtgggagacacagcctcagcagggctgctgtactcttgatcaactgttgaaagggaaagtcaggcccagaatctgcctcccaactctttttttccatctctttttccactagggtggttgtatgctctttaggcactgttgatttctggctttgaatcrtgatctcttcatatttcagtatgcatgaataataggacaatttcatgcattcattttgctatttctgagtagaagttagtgtgaccaaccaagttttaatctgatggacctgcatctgaatcctggctatgttgctcactatttgtcagtttactacacctctctgtgggtcagtttctccaagccttggtttctcctctgtaaaataggggtcataaagtgaccttattgaatgacagtgaggattacatgaagcaatctatttaaatgcttggctgagggtctgttgcatgatcggcatccaattaatggtcatcctcatggtgataaagatgatcagtgtcatcaaatgaaaatgaaagggaatacagcctgagataatagtctggggaagtaagtgcttgtggtagggaaggaagtaataggcaaaaagtatgctttagctctctggatcccagtctgaactctgaagggaggagagaataaatcagtgatcgttaatccgtctcatacccagtgacagagcagtgtggccagagagaatttggggaagaagaacaggaagcacaggaaggcaatgaagacaaggagggatgcttgatattctgaaaggagggttggaggtctgatatgtatttggataatctaaagggagggtttatttatgacaaaggtactttgttagtgggatgatgatttttagtcacattgctgttttgtattattaaatggagagctgttggtatttgagagagatgcccagtttttccagagtctgaaaagagatttttgttgatgttgtagtataaaaagtactctgtgacatggcacatggctgccaaaagtgtgaaagaaacaggaaatcactacacacttgaaatataatagaccttttcattcatcttgtgtttttttccctctgaattgttaaataaaagtatattctgttacatgctacagctagaagcaagctttaagctatcagaatggttgtgaagaactgtagaataatatgaagataactgtatttgtttcatggcataaagttcttttcaaatttggttactcatcctgtggtttaaaagttaaaaagagaccatatatattgtctctgaactctagctgaatctatgtgaaacacaagtagaacttttgggaggctgtgaggtttgtagaagactttaatagaaatgaatgaagagctggcattttgtaataatatttcatcatgtgcttttctttttccgttacccaaggaacatatttgatgtgcttgatatttttgttgttgttgttacctgaaaatcaaagagtacctctttatatgtgtgcctcagcaactttttgtggtttataggataatgtccactctccttaacagctgcacctagagtcctctgccttctgctgctgccagaaggagcagaagcaaactggaagcctcttgcattttcacgtctccttgcctcctcctgtaccagatgaacacctactcatctttctggactgagctcagatgtcaccttctgaagagacccttcctaactactgcttttccctgttccccagtccccattagaagttggcagcccagtccttgcagctccagctgctctgtgcacactgtggcccaacacccatgaggcttcacggggttccctgatggctgtgagtctcttctgtaatctcagcttctgggggataggcatggtgttccattctgcatgctgctygtcacataataggccctccagaaatactactgaatgaataaatgcatctaatagtctgataattttatctgtatgattggcgaaaatattaatcttctggtgttgtgacttgtatatgaacctttctgtttcatgatggcaatatgccctgccatacttkaaaaaaattgttacagccatgccgtttgttttttgttttgttttgttttgtttttgagacggagtttcactctggttggccaggctggagtgcaatggcacgatcttggctcaccacaacctccgcctcctaggttcaagctactctccagcctcagcctcccaagtagctgggattacaggcatgtgccagcatgcctggctaatttttttatatttttagtagagacagggtttcaccatgttggtcaggctggtcccgaactcctgacctcaggtgatccatccacctcggcctcccaaagtgctgggatgacaggcgtgagccaccgcgcccagccagccatgcctttttactatagaaataaagatgaaaaatctcaagtaatcccatcaactaaagatgattagagttaaaacatgttggtttataattctttataaaatagccttttaaatccaactgatttggactagggttgggggtgcttaggaaataaggagtagataataaggtagtatggagtagatatataattgtaattcccccttgagttttgagagctacttacccaaaatagagcatgacacggtttcgcctccaaacagaatttccatatgaaagattgaaccgctttgtgcttgaatcactgtgaatgttgctgctgctagttctttctgtaatgtgaatagaatttccttagataagttgtcagtgtattattttccctttaaaaaaaaaaacttcttttttagctgttatagatttcttagatttttatatagaaatattttctaaaattttttttacaaaaataaaatgaaaattgtgcctgttgtgctgcatgtgctttcaagttagaatcagtcattgacatattaatggcttcttccaggttggaaaattaataaagattatccttttacttgaagaaagtgataagagaagtagaaagaaaatcaggctgagattaactaaggaagcagcctttttattctactttcagccattcagaaragggaaaaaatccagagtttctaataagaaaacgaaaagttgttttgcattctggaatatttccaaaagcattgctattgatgttgaattccactttggggttggagattaggaaatttttggaagtgttgaagtaaaattagwtgttctttgtattattttttatttgacagtgtacaaataatgaaactgtaaactaaagtacaatgacataatcacagaaatgatcataaaaatggttatttaacttgaagtgggattgaatattcaaaaagtgcaggtggtgtggatgggcttctgggtgaaattaggttttctctttcagcaggaaaaaagacagagttttcattatactccctgccattggtgatatggtgtagacctgtaatgataacaagcactcaacatcttcattgaaaagcaccagaaagatgcagagcagaagctgtaaacttcacaagtgccatcaaatcagactgtttcttcaaagttgaatggaaaatttcagatgttggtcatgaaatgtttactctgtgacccaaaaccaagttaacaggcctccaagagaggtgcttgctcttggatttgaaatagtagccatagtgataacttctcttctctgtgtaagccctgtaattttgtgtattccatcattctctctggatttagtggttctgagaaagcaaacctagaccttgggccgagacttcacacagaaatatttggggatctgctctatggttctctgggtttgggcctcagtttccccatttttcagcttttgtggattctgrtcattctccccacttgatgtgcattgtgtgtttgcatgtgtgtgtgtatgtgtttctagatatgtctgtgaattttggggtgtattttttaaatgctttgcttgtatttttaatrttgctaataaaatactagctacatgattttgagggcttggcacctcttgactaggtaacagtactgtgctaaactctttacatgtttatctaatacttttctcatgataacctgatgtgggtggacgtcctatttttttacaaatgagaaaaggctctaaaattaagtaacttcctccactataataaggaaggcaggaagtaaggctggatttcatgcctgccagattccatagtctgtggactaagcaactgtgtgacttgctttacttaacattctgggcccgttttcttcagctgatgcccagggaagtgaagtaaactgaccaagttgacacagttagtaaggaatgctcagagccagtgttcctttctctctccagactgcttccatggaattcttgctctgggcttggcagttccatcatggttcagaaggatggatctaagagcaagatgacattgtgatgtcaactaaccttccagagaatggtctaaggggtaatagggccctactcgctctttccactcraaatagccatgccccctttccttaactttggagcccacaacacttaagattagctgacatttaatatgtgtgcctgctaggttccaggctctttttatatcctatctattctttatgtccatctgcttgggaagtaatcttattccctttttgcagctgggggaactgagcattggaaaggctggtctggccaatggacagctaaggtctttctgatgccaaagcccatttttggtacaccatatcatctgctactgagaaaaaaaggctagaagtggaaggaggtttgtttgtactttcaggagcatcccagagaatcgtagaattgggttcagtatattcttcatggcttcacctaaaattttcagctcggggcatttttataggtttaagaatgattatatgtaaaaacaggcaaaatttccagaaggcaacaaaagataaatgatagaaccctgtcttctgtccctttccccatagagatacctacacacatttaaactgggaaaggaaacaatgatccatcgtaaagcttacccgtaagacaaattgcctttggcaatataaaccttaaaygctcatgaaggcctcacatgagttaagtacagtttaacatgattctgccatttgagcacctactatgtgcctggtttttggtagatgactgagggaagggtaacagaatgaattaracatgctttctgtcccaaaggtgttcacaggtgartggggtggtggttgtggggtgccaggttagctgcaatatagcatagaccggtcagagctgtgataattcagattgctctgagagcacacatgaggtcatgacaggttccaactggagaaatcttacagggtcctttcggacctggacctgaggaatagatgggtagaacatttcaggcagaggacaccttttgagcaaagacccagggtgagaaaatgcaaagtggaatggagactcccattagatgggtagtacggtttcatgcttactcagtttggtttgatgaagcaatctctctctctgtctttgtgggtttgtgtacagtacatgtgtgtctttctctgttaaatgccttttatgttttgttggggacgtgtgtgggagtgattcatttccagctgggtccagctgtaatgaaaatgtcctgtttgacaaattgaggaattagattacaactrtctctccctgaaagctgtgacactagctgtaacatcaaacatccctccctttgtggggcaggacaggagggaaatggtgattcagggctgctggatgtgttgactagaaaattatttgagtaaataagactgtgttgctccagttaattgataaacatggcttctcactgagccatgtggttttcctccaaggagaacttagaatggtgccatctgaggctgccctagtagagaagtgcaacacgtcataagtggtcaaaacatttttattggaagtaatgcatctgtgtgattttctgtttagtccctatttcagagctctttgttttttcttaaaatgtaaaatactctcaactttagcttgagaatacctgaagtgtttagttggacatttattatgagccagtaacatatttgcacaggagctctggaggagagcagtatcacttgtggaactctgagcgagttgtatagccacccacccatgccactttctacgtctgtaggactatagatttggaccagctgacctccaagatcctcttaatagctcttgggaaatggaatgaataaatccaagatcctggatctttgctctaccctttggcaatacttaggatgtagcaactgtgcaagttctcacagtcttaaatgaaaagagccaagccaaagctgaagctttgttgtatcttcatcaagggaggttcccacccaatgtctgttccacaactggatgccatgttttgagaggagcamcagagaccaggatggaaacagaactggaaaacttatttakttaagtggcttagtgaaccgctgtgtcactcagagatgaggcagcagcagtggttgagggttaaggctggattttgaacagttggagggctctcataccctaagtgttaaatccagtgtgaggaagagccacccaccatctggtcaggagtaaaatgaagtgcctctggggaacaaaggcttcagtggaaccattccagcagatatcatattctgaccattagaaatttgattaagggaagtgttaccctatatttcctgctagtctaagaggtctgacttttaacaaccataaaaatctatacagacccatgtctgtaatcccaacactttgggaggctgaggtaggaggcttgcttgaggccagaagtttgagaccaacctgagcgacatagggagaccaccatctctacaaaaaataaaaaaataaaaattaattgagcatggtggcatgtgcctgtactcctagctactcgggaggctgtgaggtgggaggattgcttgagcccaggagttcaaggctgcagtgagctatgatcacaccactgtactccagtgcactccaacctgtgtgacagaggagaccttgtctcttaaaaaaaaaaaaaaaaagaactactgagccataactaattaattgggtttttacagctttttgtcttaaaactgcccacatctctcatgaaaataatatggtgcagtattgtgtggccaaggtgttgtgtttgtgtggagggcctaccacagggggcagatgatcagaacttacttctactcagcaaaatttaattactttatttttcctccctcatcctgaaattaatacaggtttattgtaacaaaagtagtataaaggttgtcacctgcactttcactgcttttaagactattgactactgtattatttgtcacagtggttaagagcatagtctttggtctcttggccctggttttgaaactctgttgtggcactacatactaattatgtgaacttgctcaagcctttttttttgtccaccagtcgtggtcatttcctcatttagtaccagtttcacagaattgttatgatgataggcgagaaatgcatgtagaatacttacgacactggccaccagagttcaagtgctcagtaaatgttagacagctgcagtagtggtgctagaagtagaagataataaaactcagtgtgtatatatatatttttyttttgcaaaagtgggatcctgttaaatcacctgtcttaaaaactgccatttccttttatattgagcatttctccatgtcattagtctaccaaaccatcatttaaaaaatagctttattggtgcttaattcacgtagcatacttcatccatttgaagtatacaatgcagtgttttttaactatattcagagttgcacagtcaattttagaacatttttatcatgcaaaaggaagtcctgtaactgtcagagtcactcctcattttcctccaaatcctttactaakctactttctgtttctgtggatttgcttattctggacatttccaagccatgctttttaatggctgcacaatattctgttatgtggatataccttactttagcagctattccactgctgttggaaatttaatttattttcatgattataggaaatatttatattaatcttctttacccgtctcagtagagtcacctgagagtcttaatgaagattcttccatgttacttaattaagaagtaacataaaatcttcacctgtggtcttacatgcctgtgctgtgagatgttcctgaagagcttcaggctcctagagctgctatcacaccataacaaggtccctaacactggagccaagctttggtaacaccctacactgaggtccagttggagctgttcagggaataacagcagcagcttgcccaacaatkttggtacaacagtttggtgggagaggatgagtgacttatttgagcggagccattggaagacagacagggccatagtatcaccagctgttcacatagtgccacaacactcaaatccaaggacaactcttagaggaactggagtgmagggagaattattcattacatctgctcaraaagataragtgccctaccaacacctttgcaaattgaaattcccttgctcttggcatgtgatcatcctgccaactctgtgaaagctcccttagctactcagatgctgcctcctgggggcattcatccagttattcatatctaaatcatggtgctctgatgtggactgacctggggaggggaaggaataaccacagtgggtctggtgtgccagaatctgaaaggctaaattaagatgacttgcgaaataaagggatcctgaagaaataggccactgattgtctctgaatatattctataaggtcattttcagttctcagggctgggaaacacaatgtggagagaagcattaarttaatgctttgcttttaaatgttgggattctcatagaagaatccatttctgctcatttgctgtctggctgtcttaatgcattcaaagtgtagaacmcttgaacatttacatttatttgttgttgctggtgttttctctactctttgttggcctccggatggacaccctgttaatattctttgactagcgtggagcgagctgtttaagcttttttcaggggaaataaaaatgaaagttgttgcaacaggagttcagcagtgttgcaccaactaccattccagcacatccagtctgttcgtggtgtgtattgaaacctgtattttatttggggtggaaattgcttgaggcatttcaacttgtttgtgcttaaattggggatcctattgcagcactgatgttttataaaagttgtaggaaagtgtggcccttacattgcaggcaggtgaattcacaggctttgcaagtcggtgcatgagtactgtaatcatgatagtagacttgtaaaagcaaactcctgttcttttgtacgtgagcatgctgggacttctctcatttgtcggtctccagcagtaaggatatgcgctgggaagtcggcagtgaggcactgcattgagagtgaggcatatcacatgccacctcctccttaaagccttctctgatttccagcaaccctctactacttagaactatagacggtggttaaggacacatgctgtggagtcaaaaagacctaggttcctaagccagctccgccatggcagtttacttaaattttctccattttctcatttgtgaattggggataatgatrgtacttaaaacatcattgtgaagacaatagaaaatttcatgtaaggtgcataacttaccaccgtttctggcatatttagtactccctaaagcttgtgattactgttactaatcatatgttttgtggtctcttctcggagccttggttttgtcatccacaatataagaacaaaaacatctatctcaacagcagtttataagaagtaggagagacagtgctggaaaagcatttagccctgccctaacttagtcacttggcatttcagcatgtggtaattaatacagttataacacttcattctgttctatgtatggtaactagttgtttacgtattagtgtctcactaaactgtaaatagaggctatgctttcctctttgtatrtcccaaaacgccttcctcagcacaatagctgatcttcaactagtcattcagacaggtgtgtttgaacttttagatcacatagtttaagaacagatgtctcttactttgcttatagagtgaacaaaatatgataagtgctacagatgtctttttcttaacaaggatacttgtggtgtggttaccaaattcacacgaggcaagcatagtgtagcactggtcttttctcactgtgcactgtttgaagttggcctcagtgckagaaatctgtattacctgagcaaatgtttaggaattctctttgcttttgaatacgttgaaagaaaggaattctttctccaatttgttcagctctcctcctagttaaaaagaaactaccatatttgaccccaagaaagagttaaatgtgaactcatctgagttttcagaaaaggaaaggttgaaagctcacacattaattattactgctgctattctcttccgccccccagaatttgtcagtggaattttggtccctaaatgtataggcatgtttgggttagggtaggacataccccacctctggaagggcctgcaagcagggctgccggtgagcagccagtgttctgggttttgggggttccttgttctcagtcacctttgcttggcttttgcagagctcggggttacgaggcagactgtctagagcctctcctgcttcttgcaccagatgctcatgcactgtgccactagctgaggatgcaagggtgtgcttttgcttttcaaaagaggtgctgtaaaaaatgagtgcatggttaagatgygggccatgtgaatgttcattacaagaaccttaactgtctgggtaaaacagatgaagttgtaagtaccactgaaatttcccagccctattcttgtatccatagacttggaggcctcatattttaatggattttacgaattatgcttcctaaattgttgcatagttatattaggatataattaattcccttgaacacatctgagtcatccattgcatgtattgtcagttcttggttatttgatgtcctttttctaagtacttgcccaagtcagtttgcctcactgtgccttaatttccttttctgtagagcaaaggggtcagacttagatcatctttaaaccttttaaaaaattacttctttgcaagtggatacagctctccagttggttaatgataytcaaccttttcatccctacctgcttccaagacagccttagacagtttcggccatactcccagacctgctgtttccttacccatgatgtttaccttctcatttcattttgttaaaagagaagtgagcctaacatttctggaagctcagtaaaggttaacagccaaccagccagagaagtggggttgagtcatgatgcttctggcaggaccagggaggccctgccagaaccgtccagatcttcctgattagaaactcacaggccctttacagaaagttggcttctactgatttgatgattgactcagagggtttgggttagttggtttctaacagagctggcagggaaggagaggggtggcccaatacattttgagcccctggaggaatagggtgataactgagggagtagtattgttaggaagccctggcagctctgggagccatggggcaagaaaggacaattgctcctgcatctgcatctttttgtttctgggtatttatttacagataagtggttttttttaatgcctggtaatctattaggcagtaggataaaaagatgccctcaaggatgtctctcaaggctagaggggagatgcttattgtttatcaaagatctrctgagtgcctagcattgtgttatgggccttacatacatagtatgcctaattttaatatagtatgataaattctttgcaagtgatgtctgcaaaggactatgggaccatagaggagtggaggctgcattctggctggaaatgggaattagggggaacagacagtagagggaggtaggaggagtcaaaacggtttttcacatgagatagaactttcagctcttctgcagatggcactggaaatgtggtcactttcttatccaacatgacaggggactggcaggtggaaatctgtgccttgaaattacttatatttgtctgatagagctaggtcagtttaatgctgcctttcccttgtctgatagtgttggttacagttttaaaggcttatttgttcttttcagaaaagtggctaaagaaagtatgttccctcttgtttctttacactagtgtttaaaaacatcaagagtttctgtccctccttctcacatccctaaatgagtgtccagtccgtaatgttcaggcttgaatagaacggcatagcagtccatttgcctcagcattaggaatcttgtcctccccaggaacatggtgatgatccagaacggagtcttaatactaccatgccatcaacaggagcagttgcttttgtttaggaacaacagtttccttccatttctgtgcagtagttgtctgtaatgactggagcactgtcttcactccagcagatgcacgataatttcattgcattgcctattctgatctttttctcatccagtttgattccacaaatgcctagtgcttcacaaagcctggatagaactggtcctatgggtgttttgttagaaagttccatccgacacatggacttccttctcctcaaagccttctgcgtctccctggcctggaaatgatcttttcccactgctctccattgcaggtctttgtatatctctctttgctcttaccacattctgccctttgttagttatacgtatgtgcatcctgtctctcctaccaggttgtaaactcacttaggtaaggactgtgttctatacatgcttcacaatccctagcatgaggatttgccataataagcactaaatgaatatttgttgaatcgaactgaatccagatagcattatattgaactgagtcctcatcattaagtacaaaggaattgttagaaggtcagtaatgtttacttcccctatctgattcctagtccccagttctgtatttaattacttaagatatatgtgccatctgcagcctgaaggatttggcagccagtgattcaaatacaaggtaaaatgaggcagtttgggataagatcaatgtaatacctctctgtaggagacagcggggactcaagacacctgatttcagcagattgcagtaactccataatttatttgcatctaagagaaggaatcatgtttagttacagcattttcatttttttttttttttaaccacagatggcataaaattcatctccagagagacttctaactaaacctgagtatgaatttttatctctcagtttcttatgcartttttcactgcatacctacatagccttcttttggaagttgttttattgacttttaaattttgcttttgtgtgttttacttgctgcttctcttgtcttctccccagctgatttttcttaacaaaaaatctctagagatgaagaaccgtggcagcacagtagcatcttcattacatttatgatttgcattcccagctcagcactttgcaatgcatattttgcaaagcaagtttaatttgctagaagtcagattgagatttagcatctatctttttaccatctgttatatgccaggtataatgctggacacttgcacacttatttcattttatcatagaaaattaaaagagaaaattatatgattattaagagccttgaatctcatactaggggaagtagtcctctgggttttatgtgatggtgggatgagataactgatgttaaaagacaaacgtggtatctttctggcatattagttttactcagagattttgagtgggaggagtggaagaacttagacaatttaagtgactagtaatcattttatatttaarcaaccatggaaatacaaaggagtgcaaactatgcacaagtgttggtgataaaacagagtctttattasgtttatgtagttagagtagtgagtgctttaggatgcaccccctgacttctaagggatactttgtggaaaagctggagatttccatctagtaagtacatctctctccttttttgtaaatgtagaaattgaggtcccagagttcacattcctattgactgaggagggattttaactcccaactcactgattgaccctcacatgcctgcttcttcttgccctttggaatctttggtgctgaaccagaccctcatgtgtaagcccacatggtcaaatggagccgaatttgaaatcagttgtacttgcagaggtggcagagtaccataaatgaggctatagagtgggttgtaaatgccaggcctgcttctttgcagtcacctgtctctgtagccactggggcttattcactataatccatgtttttttgggggcaggagattgacagccttttggaagatttaattagctgctcttccaggaaagatagcttaatatgccaaagattaaacttattgtgtcttggaatcacaaaatttcaaaattgaaaggatccttaggtttcctcagccagcattcttgatttatatatttgggatgagataaaaaggttttctcaaatttctggttgtctctatttgaagttagataggtggctagcccgttagttgtttacttgttttattgttcctgatgtctttaaccgaagactgggcatgttgcactctttggcaaagtaaactagggcaatggtgttgatgtctactgatctgatcagtggtttgggatagataattttactcttttccattggtaaattctactttcagagtagcctgttagaaaggatgaaaagctctgaattttctccatttttttttaatgtgatactagagaggaatgatacttcttcctggtwgtgtggaaagctacatctaggttggttataattttcattttaactcttcctccttcatacagccctagacttctcagtgtttaaatctaggtgtcaggcctcattcatatgtatgtatgtattctttttcttttttttttagacaagatctgactctgtcacctaggctggagtgtagtggtgctcgctgcaacctccacctcccgggctcaagccatcctctcacctcagcctaccaagtagctgggactacagacaagtacyaccacaccagctaatttttgtattttttatagagatggggttttgtcatgtcgctcaggctggtctcaaacccgtgagctcaggcaatcctcccacctcggcctcccaaagtgctgggattacaggcgacagccactgttcctggccctctgtatttcttatgatcttaaatcctggaggcacatgacatatatgctcattgatattccattttggcagtgaatttgataggcatgataaatttggttttgcattaaaatatagtgacttttctgattatgaaagtaatttcccttttttattttattttttaaagaacattrtaagtaatttctcattataaaaatgtggaaaatacagaaaagtacaaagaagattgtgtgctaattttgtgaatactaatagcattaactagacaggaatatgttaaaatgtacttttctatgcattatatagtaatagtgaagactttatatagaacatgtaaataattgtatgaagtagttagtgtacaaaataatgtcatatatgcagctgcattttctgcctttttcacctaraaagttttttygtcatgtcattaaaaacttttgccctctgttttcatgactacataatattctgttgtgtgggtgtacctgtcttactgcttcacctactttattcatattcctgttactgatgttggtttttccatccctccgctattttaatacgtgcgttgctctgttcatctttttgatgattcccaggaagggatctcagtaagtagagttgctgggtctagggcttttgaacattgcccagttcctcccagaatgcttccaccagtggatgccagtgtgtcccatcttcacggataaggtaggctctgactccccattcacaggatttgtaaatacttgctctgttctgtgccactcagtgttcccatagccctgcaagaagggtaccacactacctcattcagggcctggagcaatccccaccaccccttgaactggctgctttctccccatttggtttttagtcttcattcactaatacgacagtctgtcagggaagtgccaggaatttttctcaacatacttttattcctttttttattttattttattttttaaagaacagaaatggctctcttaaaattagtagcagctgggggctggttctggctatgtgatccaatgcaacagtaacataaatgagggtgccattctatttctagctgcagaagcttccttgccatcttagtgttcttcaccaaggtgctcaactagctcccttgcaatttcttctccaaataaccacagtaattgctacagaggaagtgaaaattgtaaaaacgcttcagaagactgacagtggtgctgattataggagtgactgcttttaagttctaataaattgttttaattttcttataatttctactcagataaagcagactcctagcttttaattctgcttctaatgggttttttcccttcccacttctcctgtagtagggcagtgttgcagtgatgagaccatcagctgaaggccccattgctttgtcctgctgatctttttttccattggccactccatttgrcatttccactgacaatgtcttatttctgagatgaggggaaacgcttttttaagtgtctagkctatatttgaagttagatgaacatggactgaacyccaactctatcacgtagtagttttaaggccttgggaaagggacctaactgtaaaaggaggtgataataccacttcactggctatgagggggattaaccaggatggcctgttaaaaatgcagagagctggcagagtgaacagtaaatgttttaattcgctgtgtcatttgcccttagctaggctgtttcacctgccgactcattgtgttgctatgaaaatgaaaggagatgttcgtgaaaatgtctggtatggtatctggcacatagtagtgcttgccaatagtagttctcctccttgtagctctgtctaactccatggcacagctaatgcacctcatcataaaaacactgggctgggtatggtggctaatgcctgtaatcccaacactttgggaggccaaggcaggaggatcacttgaagccaggaatttgaaaccagcctgggcaacatagtgaaaccctgtctctacaaaagaataaaaaatgagctgggtatggtggtatgtgcctgtaaccccagccacttggggggctgaggtgggaggattacttgagcctgggcggtcaaggctacaatgagctgtgactgcatcactatgttacagtgagaccctctctcaggaaagaataaaaataaaaaacaacatctggtccatggattccatcaaacaagtgctattcctttttgtcttgtcataaaaactctctatcagtggatgctttctgcacgtccatttgctaatagtttcctgttccttgttttagctattttggtaaaagtgactaatggtgcagcaaccatttcttcaccagcccttcctcagctctcctctccactccctcctcctcaggattatagggtccttcttgctgctgtatcaggtctcagctcattagttgtttgaggaaagggcctgccatgccatgttcatcacttcagccacaaaggatggcttttactcagcaatcatgtgctgaacatctgctacattccactcttagcactagtgaaacaaacgcgtagcaacagagccccaggcctcaaagctcacaatggaggtaactggtttccaggttaagtgcactaaactgtgtggaaggtgttatgatagtacctctacaggttctgatggaagcatcartgatggatttggcttttccatttgggagaggaggctataaaaaaccttcctggaggacgtgggctcattctgattcacagacaggtccagccccttcacttcttactttgaactactccatctggaatcatagaaactcattagcagctaagtgagtcgtagaccctgttcctacagtttcaacaaaccctgatggtggcatttcagtttatcgtagaggtttcttttcccctacaagggtcattctctcttgcccaattttggctgaraagggaggaatatcatggccgttttggctgtatggtgttactgtataatgatatggggattggtgagtgaaaaataaaatgaaccctcacttgcttaggtaccagttttatgtaagaagaaactcacagcttttgcacattatttgagatttgcttcttctgtttaacatatttgtggtactttcctaaaaagttttgttatagacagctgtagagattaaaaaaaaaaaaaaagcatgatgtgaaactaaaagcaaaataggaatgagtctcaaggtgtataatgtaccaaatgatagtagggcctggaacattcaacagcatagcctgtactgacataaggttaagaaacattggccttcaagtcactttagactcttcttaatgagttgtcgtgttggagagcctgcaccgcattttgttatttgccattagttgatctttggccagtattaattatttacattgagctgcatattacagggggaaaatcccaaataaacagaagcttaaatgcgatagtttatttctctctcctctaaaaggaacttagacataggcctggaatgccaggtttgtggcgtcctttgggattcaggcctccttccttttgatctcaccttcctcagcacatgacttccatcctcaaggtcacctctcagcttaagattgctgccagagctccagctgtcatttctgagatggagaatctaaaatggaagggcaaaattgggctttcccagctgagccacttcttttccagaacccatataaataacactagtatttattgaccacatttgactgtaagagaggctaggaaatggaaacttgtattttcaaaatattctggtaaaaaccaggattctagtactaaggagatggggagaatggatgttggggcagcacatcagcagtgtctgtcacaaggccacatcaggaatacttggagtagaaaagagataaagcttagtgaagtgaggaggtggagaagttgatgtttaccaatatggataccaaaactgctgagagtgatgttgcagtagaaagaattgtgattagatggaaaagttattgaagtattagtgtcctggagctcagtagagaaagatggttggcatagccctcagaagaggagactggtatgaagatggcataatagtggtcacaggtgaacttgtggatgggaacagacagtagaaaagggacagcattctttgagaataggtcttgaggaaagggaataccttttaagctgaaaagacrgaagtgcttttctctcctagccatggaatagatgatgagttggtcctctgcagagaagggacccgaagggcacaggcgaagggagtggccaatgccagtgggaagatgagccatgaaaccaggtagagggagtagataagtgggatttatatctaggcctaggctagtagctgtattaccaagaaaaaaggaagctagcacttggaagttagggagaatgggaatgatggatgggcagaagtgttgtgaattggtttgggtgctcartgttgctttttttcttttgcattttccaatttcctctgtacgccatacactgtaatagtcattccatttaaaattgcagctgggtagaccagatattgctagggggcatatctgtcattgaacttgggaagcaggggaccctgctaatggaggcactccagacacctcatgggagcacagctgggaagcaacaagtggtctatttcttggctcagcctaattcagactcgcctcttctccttagagaaaggaagaggagcctcttccttatgctctgctcaatgtgtagggtttttcttcctatttgttgcaattctgaacattattagtggatagtcctggttttgagacttacccctgccttagaccccctgttcctagctcttatttcctgggacccagtttcatttttctctttctggatctcaactctcatccctgacagggcatgatcattatgttatatgatctctcttggttatatacaaagaatgtaccagtttgtggagtattcatagactttttttggttttgtttcttcttctttttgtaaatcctagaatgatcccctcccatgccaccaccatgatttgggactgcctactattttccttgtgaactctccctgcccaattgatatgtagtattttttgcttgtttttactttttgatatgtattattatttctgttgctgtagtgttttgtggtttaatagaggctcttgtcacattttctccactaattgtcatagtaaaattgtgacgggagcagacagtagttgttacttatttacaaatcggtaaccgaaattcagaaaggtcacccagctaacttgtggaagacctggggttggaacccactttttctctctctctcttaaagttcagaagttcagagtaagcaaatgaatgttaattattggcctgaacaagatctaattaaagtggtcagtctgctgtggctgaagtagttgtctgcacatcccgaccacatctaaaccagtcttggattgtttaatgtttagtatctgtggcttagctccctttcgtttgcaccagttagagcatgtagatgccacagcagttccatcctgaccctgtgaagcacgtttttgcaggtccccaccttgcaggtgccactgggaagcgcagcatgctgtggtttggaaagcctgcccaggcattggtactgaacaggcctggcaatctgtgtttcctagtgtgggtattaactctgttatccttgatacagcacttagtatttctgggccttcaactcctcattgtgaaattggggtagaaacaggtagtttttggacaatttgttacctctgcaaacctcagttccctctcatctgtaacatgggcatgatgatacccactttgtaatgtttcaagattaaataaactgctgtataaaaggagctcagtgccatgcctagcaatacagctggtgcttaacaaatgttccacccttttcttcctcctcctcatcatttcaatatgttttgagagcatcataaaaagtggtatgaaggttaaaaaataaagtcagggatgtcacagtatgaaagttgttgcccctccagtagaattaatatgtggggtgtaagtggggggaggaagcttacctttttgaccccaagtgagagccttgcatgattgttttcttaaaaatggccttttctgaccaaattgaaggtgacgcattctagactttcatttataatgtccatttacatgcagtacttctatattcagattgacttcctgtcacactgagtgattggtgggctgcttgccagcctaggggtggactgcagcaaattgtgtgtgagggaagccagcagtctgcagggctgagctgaagtggggagaggagaagagcatgggacgtggtgtcragtgcagtggcattgactgcagacaggctgctgctttacactgggggattcattccctttcccccagtaaagactgttaaaatatcagaactgatagtataaagtcatgagttttttagttcatgcagaatgtggatcatgtctgagataaaaattcataagatttttgaatatcctggggctgatggttttaggcagtgaagttaatttaattttattttttattttctgtagctgaaacgtctgcttttctgtgaggacgttgattatgtgttccactgccaaaagaagtttctcattttcaaactgcagctcccctagttgggcaatataactgtaatttgagaatcccacaagggtagtctgttactcggcagataaccctacagtaaatttgcatgaaggcattatttaaaacagttttcttctctgacctattattgcacagcaaaatagcagtttcctttctaaggtaagagatttggaaggaggactcaatttatacgtgatctcattgagagtgagagctgcaaagatgaggaaaagaagtggaccttttaaaagttttttttttttttaaacggttatgttattttattttgttgaaggcagaggatatgttttattttagggacccaccagaattgcttagaaattatctkcaggctttagggatttttgcttatcagtatatttcatttgccccattgttcagcccatccaccacctccttccatttgttctcagaaactaaactaggagaacataagcacttggttatgtgaaaatgtacttatgattcttccatgaaaacctaaagtattaaaaacccaacagttcacttgtgttctttcatgaacaggtatgtgcatgctatgatkgctttcatttgccaagtcattttttaatttaatgagctgtcactctgctgtcattggatcagttgtagatgaggggacaccttttggccttcatttgatgtctttctcacgtgcttattccctcatcttgtttggttgaaaatcacattggcaaaaccaaatccagaatgctagggtatgactaaatggtagaacaagctaagcaactatttctaggggggawaatttctgtgctaggctttgttactacagtggttgaacatgggctttagaatcagaaagatcagttcagatccccacattggaacataaaagttgtgctatcttgatttaatttcctttagccttgttttccttacctataaatagaaattataatagtacccacctgtaatggttggttcagtgagataatgcctgtgtatgccttgggcctggaaatgtccctaatgcagaggacattcactatcaaaagggagagaaggccccctggagttgctacgggttgcagtattttttttaaaaccagaattcctaatggrttttttttcccctccttttagtgatattgtattttgcttaagtgtgttagatttagctctcgtctggtttgtgttcaagctccctttcaaaggtgccatcagtgctcaaggccaggggttcagctgcagggatggtggatggtagccagctcttttaggcatggtactttttttttttttttttaaagacagggtcctactctgtcacccaggctggagggcagtggcgtgatcacagctcactacagcgtcgacctcccaggctcaagtgattctcccacctcagtttcttgatagatgagactacaggagcacaccaccacacccagctaatttttgtattttttttggagagactgggtcttgctatgttatccaggctggttttgaactcctgggctcaagtgatccacatatttacagtggttggtgttcatttagaatttaatgaggtgaacaagagtatatttgcacctacatgttctaggctgaattcggatcttctcatttagaaggagtacaattaataaatcattatggatcgtattcaaattactatttttttttgagttgtttttgtttacttaaaagtagatttttaaccatctagcttgacatactattattatttagcctaaaatctttgctttctataattataagtaacctatatcacttattttgccttttttttttttttgagacggagtttcgctcttgttgcccaggctggagtgcagtggcgcgatctcggttcactgcaacctccgcctcccgggttcaagcgattctcttgcctcagcctcccgagtagctgggattacaggcatgtgccaccatgcccagctaattttgtatttttagtagagacagggtttctccatgctggtcaggcttgtctcgaacttccaacctcaggtgatcctcccgccttggcctcccaaagtgctgggattacaggcgtgagccaccacactggaccctattttgccctttttaagtactggcttaacgagtgaaaaagatgcatgtgcactgaaaaaagactaggaaaagatagaatacaatgccagtagagattgtctctatgagacagcataggctattgttattttagacgtaaatttctctacttttcaaaattaccacctatttggataccttttcttagttttataaaatatggccattrgggaaaacttgaaaattgagcaaaatacagagaagagaattttaaaatgacccatgattccaccactcagataactacagatggcattttggtgcattgcacttgtcacttgtagtcagaacagcaaatgtgcttcattttccaggcctgcaatttgttccttttgcacacatttctgacaacctgccctggactgcgttctcatagaatggctgtcctccccactgtgggagcccttgctgagcctaacaaataaagcctccttcacaatagagctaaagaggagcttcatcagagaaacactgccgccttagtagatactggcccaggttggtcttgagtcccaaacttgtacagtgggttctcaaagtgtaacttaaacattatgttggcatcatgttaagcttgtttatttatagtaaagctcaaatatatagggaaatggaattgttcctgcattgagcccattcagaaaattttctgtcaagtttgggcagaatttaaagactatttcctttggtgggcatgaagtagtactgtttaacatgcttgctcaataaagttttcagactttttttttttttaactagagaatatgtgatttggtgattgactctataaatagtgtgacccatttttaactagattgctgatatgtttttcagcaggactttgtggtttagttaatgaaatcttttcagggatgatcctctgagccttctgtctagttactatcactgctgttgcttttatgacttaattgcctttgtggtttaattcacttcatgacacatctatcaccatgaagtttagactcttcacccctatctttccgagtatttgcttgatgactcctggggtcaaggagaggttgataggtggttttatgctgttaaaaataagtggtcttggctaacttatcacttagttaaaacagtccttttaattttaattaatgcattgaagctacttcttcctcataattttctacttcataattctgttgtctgagcccataacaatrgttatttctattatttgtagagaattataaagctctttcatatttgttctaccatttaatccctctatctttatctcctcccctcccctcacccccctccccccccmaaaaaaaactgtattagccccattttgtagatgaggaagctgagacaaagaaatcataggcaagtatgccaggtcggtatggttaatgtatggtagaactgggaatttctactatagaaactggacgattgggatattacgatttagaaaagagcctctgtttttttattgtctgctattactgaaattaccatagtgttaacatcataaaaatatgtctaaagactcatgctgagttctggattttgacagattttcaactaaacctaggaaatttgcttggtcagtctttgatttttgtggacatggttgggagttcacctggcagtacagcttgtgattaaaagtccagttttagaggaaccaaaatctgttcttcctttagagccaatctctgtttgcattgagttttctcattttcccctagccatgaatgaaatatcaggaaattccaaatgcatctcaatatcagaactgtcttctttgtgctaccctctgcatagcactcctcggtggctgccctttgcttctgtggtgagagccgcatgtggtggtgcagcccacaaggccgtcctggtcacgcctctgtcttgcctcactgcttatcttgcctcatctgcagcagcagttgcataccgtgcctcatcttatgatgtgtccattcatgtcagcccagctatctacttgttcatctcattgattctgcccattgttgaggacttagtctaagtgtcawagcacccaaagtcttctctgataccttgccacccatcacctctctgttagtcaggatgagttagtttttctcctctgttgttttataggaaattgtgtacctctgtcttagtacttattcattctgttgaaattaattgctcacctgtctctctgtgtccaccatttgactcccaagactgaatttcgtaaaaagggactatgccccaaagcaagcattgtgctttttaaaatagtaggcactccagatattatcaaatggataatccccctgcctagcccactctttgatggataggtgcttcaggacatgtttggtgaagtactgaaaatctaaggctaccctggtcaactctcacctcttttattatgcgtgtaagtcatttgtggtgtggagcatcaggcaaatttaaaataccaactggctccctttccctcaactgcccgtgatagttgtagactcttcattgtcattcttttttttgaggcgcacaccaccgtgcccagctaatttttgtatttttagtagagaccaggttttaccatgttggccaggctggtcttgaactcatgacctcaaatgacccacctgcctcggcctcccaaagtggtgggattacaggtgtaagccaccatgccttgcctcttcatcatcattctacaggcccatttcttattagttgataygtactgagggagttgaaattatgttttatgtctgtcaaaaatatagatgttgaaaaattaaatctattgttgaaaaaactttaaaaatgatttccggattctccatgtttgggattcccttcctgatgctaatgttaattgctttcttccttgatgctaatgttaatttgactataaactattgttttatcaaaagatcttagttacacttactcaatttttgcttaagatactacaattattttaaaaagaacatccgtatcttattctaaaggactgaattatttttgtatacagacatacatacagaataaaaaatgtacaacttgattttagtctgtttgatttaaattttatatattgagtagttcacccctgtctgcctgtattcaggtttcttattttgatcataacatggggttgggttattttcgagtttggagttgagaatcttatttttataatccagtgggagaaaacactcaagtatattttgaattggacaactgtgaaaatcttagcttatagaatctaagtttggagtagacttttgaagtcataacttataaaatttatcactaagatggatagttatgtgcatttaaaatatttctataataattgaaggagcttgtgataacattataaattcaagaatgttttgctagaagcaaattgactatgggttttaaaatgtaagcatttcctaaattaattctatgtcaggaaatggagacaacttttgaggaaggaagctgcttgctgaggctgtgcaaacattatttctctcaagtgtattttaacactaaagttaaaaatccattttatatattaggaaaggcaacttaaccatagtagaaggagtaagaaatttggagccagaaattcctgatttcaagctccgccatcaccggttactcctttgtgactttggactagtgttttgactttccgcaggcttttggttttctcattggcaaattagagcgtgggaattgggaaatggaggtgcttatcgctgttactcctacctcaccaagctgttagatgatcacttgagaggtggaagggaaacatttaaattgtccagcactatgcagatgatgtgtatctttctctcatagaaaggtggttacctgtkgggtgttggggagaaaaaagtaagagaaaaactagaggcaggtggcaggtaaaattttaccactttgctctggattgctagacccatttgaatcactggaggaggaacaaccatccctagtctacttggcgtggcttagacctaaatctgtgggccccttgccataggttgtacatattatagattaacagttcccattttgagtccctctttattttttgccacaggatcagataaaaatctgtgacttatagttaaatattatttcctgaatacttaattatattcacttattcaagaaatatcaaatggagcacttactgttttatagtaattgttctgggtgttggggattacagcaatggaaaaagcacagacagaattcccttcttcatagagggtacattgtagagggagacagataaagcaaaaaaatgtaaaattaagttcaggtactgataacttttatggagaacacaaatagggtgacttgatagagcgagggtggaaaaaacttagtaaggattgcccagaggtatctctttaaggaaattatatttgagctgcatcctgagatgtcagaaggagccagaatgagaagagttggccaggcacaagtgctccatactgagggagctagtacagacactcagacctgggtggagtgaaggaaacatgtttctagtttgttaggctctgaggtctctggcctgaaatacttaaatttttaattggaggagaaaagcaccatagagataagacagagagatggggaatacaaatacatgttaagttacatggtccgagcattgtgagtatagctgaagaatttatgtggtccattggtatttacttaaagtttaccctaaatatatgaatgaaatggcttcctagctcctttcatccttacatctgctaatttaaccttatgcagagagctgagtttgttccgyttgtgccctaaggttattaacatctgtcccttagtctctccagtaaaaagtttgagaggaaacaaagaaccagctctacttagacctttgaccaattgatcatgtggatccttgggggctttatgttaatgtcaatggataaggtattctctttgcctttgaattgattttgtggctttaaaaaaacatttatcaaagactaaaggggttgtcagtgtggggagagggacatttaaaaaggagctattaatccaagtgactggaaagaagtcacttatgtgcatttacagtgacttgctaaatagaagtcaggaaatatttgagtgagtgaatgacttgctaaatgataatacttgtagtgaaaggtaacaccttctaagtgcctactctgctagattgcctgcagtatcaaggtgtttctatacataattttccctgaatctctctaagaaacccgtgaggttagtattactatcaccattctttatatgaaaaatttatggcttaactagttaaccttcttgctgaaggtctcatagttggtggctgaataaatttggactgaggactttatgatcccagaatcctagttaatcataacaagtcatgacttgccctgatgatgttggaactgtaagtaagggacattgagtgaatattgtctgggggaagaagtgatgaataggagtaaggagatctaacctaagagcttaaatagtgatgtgaagttcttggcactaatccttaagatacctctcttagagccttgagggggtgccagtgaaacagctggtagtaaagtccatttgagtggtccagttttggagttgcttaagggtcagatcactttctatttctgacttaaggctagtgtaactgatctggtctttagttttctcgatttataaaatggagatggttaagtgatggatataaaaatgaatgaataggctgggagtggtagctcatgcctgtaatctcagcactttgggaggccgagggaggaggatcacctgagatcaggagttctgaccagaacctgaccagcctggccaacatggtgaaacaccccctctactaaaaatacaaaaattagccagacatggtggtgggcgcctgtaatcccagctacttaggaggctgaggcaagagaatcgcttgaacccgggaggcggaggttgtggtgagctgaagcttgcggtgagccgagatcgcaccactggactccagcctgggcaacagagcaagagtccgttccaaaaacagtgaacgaatctttcattaattgagtacctacaatgtggcaggaattgtctaagcactatggatagaacaatgagaaagagactaagaagtatgtgcattgaatttgttttttagtggggacaggcagtcaagaaataaacagtatgttaggtgtcagtaggtgctatgaagacaaaaagagaggagatacaagagagaatgattgttgggcagtgtggtagcaggaggggagacttcatgagcaaacttaagttgtgatggagtttagctgtgggggtccgacagcacgaaggtcctcaggtaggttcatgcctgacacattcacgaaacaacaaaaggaggtcatgtggccaaggtgtagagygtgtgaggaagaaraggttggaaaggtggcaggagccagattatgcatggcctgctgactgctgtcaagactttggcttttactctaaataatagggagtctttggagttttgttgttttgggttttccatttgtttgttttgttttgtaattttgagaaagacaagcagcactgaattaccatatttacacttaaaacggatccctctggctgctctggaaaatagattgtgagagtatgaggtggaaagagggtgcccagttaagaggctgttgaagtaagtagtttaggtgagatcatcatttagttggtgatgtacttcctgtgtaaaattgaaaacatcacacatttgaacaaggttgaaattaaacatgagattgtcacatacaaccactgtcactggggtgggcagatgcatagaagactattggttgtgtaaacgtaaattggacagcgtgtttcagggagtgcagatgcgtgaaggttggctttgagcctctgctagacttgaccaggttcataggttaaaactgtttttatctttattctttcaatatattagtattacaatagaagacttagagaacaattgaggggggaaatgatgttcctttttttagggtgaatgtgtcagactttcaaagatgactctttggatattaggtgttcatatctacttagaactggaacagaaacataaaatatacaaggcgttcttttccgggcagtataaaaaaataatatataatcagttctaacataagatctaggagccgtttctttttttaagccaaaaaggcaaaaaagactactccattaatccatgtttctcagtggagatggaatgattcaatttgtagagtttttttttaaagagcagttttaaatttacagaaaaatcgagccaaaagtccagagttcttatgtaccgtctcattttgctaccattgccactgtggttttccctattgttaacatcttccattagttaataattaggtaataacatcttacattagttaataataatgtattgatactgattcattaaccatgacaagggtgccacactaatgtaagttcatagtgtagttcactctatgttgtacattctagggatttgacaaatgtgcgatgatatgtatcctctgttactgtatcagagtagttttagcagcactaaaaatctcctgtggtccacctagtcrtctctccttccctcatcctaaacccctggcaaccactgatctttttgctgtctacatagttttgcctttttcagaatgtcatatagtcagagtcataaagtaaagtatgtagccttttcagattgacttttttcacttagcagtacgcatttaaggttcctccatgtcttttcccagcttgataggtcatttctttttatataataatataaaaataatattccattgtccagaagcactacagtttgtttatcctttcaggtaatgaaggacatcttgattacttctctggaaacattttttggtcaccaactaagtggtagaggggatactggcaattagttgacagagggcaaagatgctactaaacaccctgcagtacacaggagacccccgcaacaaagagtcatccagttcagaatatcagtaatgcttgaggttgagaaagccctagtctaaatatatcttaaatagtataaagaaagtattttaggcatacacttatagttttgctgtgctagaatagttggagaatctcagccttacagcaaccccaggagcaaggtgtaatacaaattccattttgtagctgaagaaacagtctaagatgttagcatgcttcctgtcattctgctagtaaatggccaaagccaggattcagacctggagcctctgtctccaggctcagcatacacaggcacctccaggtgtttgtggttttcccttctgccttargtatggattctttggtttttaaccaaacaaaaaccagagtactcttttttttcccgtggtgacttaaatttcttgtaattgtttttatttcagttctcttgagtacataccaggtcttacaatgttgtagaaacagcaaagaaggagaagacacgatctttccacaggaagaagaactttccatctgattgtcttctggagttcttatttcttcatagttttctccccttagaagtgattgcaccagaagataaaggtacattggtacatgtcctctggtgattcagctcctcctagccccagaaccaaaagcctcttttctccagagaaccgtttgtttaatgaagctaatgaaacttgagatgtccccaygtgcccctccccctcagctggtgtctctccagggcttggctgccacctttggccttctttctatggccattaatctagtgctcccagcagatggcagctgatctggataaagaacttggttgttcttttcagtgcccattagaggcctgccctctctatctgttcttcctgtttgccatgaagaacagctggccgtgttggtttaaaagccagaatttttatttgtttggagttttgcctcttcatttttagcatttctctctcatctctttctgcctttgagatagctgttcacagtgccacattttctgtrtctgtgaaaaaacgagccccttaacctccagtacacaccatagacatactcacccccttctaaaatatttattcttttagcagccctggctggtttccattgtgtttatttaatctttcaagaattttcttataaaagactggacaatcaatgcctttttactgattaaggtgaaaagttrtacatggtttttcaaatatttgtgcaaatgagagaatgtatgagtctttgcatgcatgcagatattatacctaatgttagactatagctgtaggcagattatctatttacctgtctttctctccttttggaatgctaactcttaaagcacagagaatattagtagttgagtacttaccaagtagcaggctctgggctctagattttggggacacccctgccatcgtggaggttacagtcttctcattacaactctgacccagtcattctacttctttgaagattatcctgtatgcaagctttacttagaattgcagaaagaatgagacatccttagtggtaaacattaatgaaatctacgaatagatactctcaacaacaaygcatatgcatatctgttgayatggaaagacagtcgtgttgtattaactggaaaacagcatgatataaaacaacacagaaaggatgatcccattttatgtacctataaggaaatattgtaggatatatttctggttacattagttatttctggttgctagagtttaaggacaattggggttttttgggtagtgaacatgtgatttatatttaatcaatatataaagaaatagagcaagaaaaaaacaccactgccatgattattcagataggcagacttttttcattcattcaaccactatatatggagtgcagctatatgccaagcacaaggcagagaacacaacatgctacagaagtccatgcctttagagcattctagaacacaatttacattaaaatgctactaggtaacagaaggagcagcagtgtatgtggattagagtcacctcaggatttccatcgtttctcagaacacactgttttgtttgtgggtggaataaaggaggctgccatgttcagtgtacataaagaaagcaggaggttttctcaaagagcaggcattggtacaacatgtcatttaatagttaagaggtgggggaaggtagcctaatgggttatgccagccacttatctttaggatagtctggataaaatataaagtactatttctcatgtcstctgcttatgctgggtccccatacaccatctgaactaatggactttttggcatcatctccttaaatgcatcatagggaatgaatttctccaccaagaagccccattatggctttgtcagcctaggttttgatttagcgatagcaatatgtgccttccagacataggatggcaatgagggagggcctctgctggtccttaagtgcagggagccccccttcttagagattaatcatcattgtgacagatgtgcttttgctgaaacttggtccagagagcagcagataaagatttggatgatgtctccttccttctttcttggccaaaggaagccagcccagtgctgggctttcaagaatccagttgtttagaaaggagggaggtaataaagcagaaaaagatgttttatttttagaaattaatgtgcagctttctgatctcccaatccagttcaggttctttcaacttcattatctgttgagaactattagcctaagaaatgatgtgactgtggttctctaccttggctgtgtgttagaatcatgctagaaactcttaaaaatctaggccacatcctagacaattaaatcagaaactctgggggaggggtctaggcagcagtgttttaaagctgccaggtgattccagtgtgctgctagaactgagaacttccacaatatggttataccagctacacaaggcagagagtttttaccttgaaaaaattaaaaaacagcagtagtgtaaaaatattatcctcttattaaaagaagaaacatgtgacagagtgaattcatttagatgtcttgtttggtttgattttaaattaccacacttaaggttgaaagccttatctgttgttccccattctcatggcctgatcactgtgaaattctgggaccttagaagccttttgtattgactgctcgctcgctckctctctctctctctctctctctctctctctctststgtgtgtgtgtgtgtgtgtgtgtgtgtgtgtgtgtgtgtatttttcttttacttcttgtttggccaagaaactgtatgtgttaatagcttgtttgtttttcgtcttttgttttggctaaattgcttttcaagaaactgcctgactccttgtttaattaacttccatatcctgcatatgtggctcatttcacagtccctccatcccttagtggttttccagtccaccacgaagatttgtatgaagaaaatagccacctcatctatttatactattttatcttgatgtttttcattgtttctctgaagcacattatttctgatcttgaaatgtaatgttttaaaatatatttttataggaatttatttttctcctctgaattgcctttgttgttattcctttggattttgaactcacttaactctgtgctggaaagtttctgctgatttttgtcttcttgatctctctgtttctttaaattctaaattattttgcatttttccttactgttgaattgcaacacttagtctctctatcttgtcacaatttatggagaatgatagcagaatccatctcaatagtatagcaactaaacatgtatatcatcgtttcctagctgacagcctgcatggagatgcatcctttaaaaaggggatgaggatgagaaaggtactgtgccatatagtgttgggcatacaaccaagacggcagtagacacaatttgttagtgatgtccagttactagtattgctgagtttatttgtgacctacttttttaccttttgtattccctgtgcatacgtgtagcattaaaacagtgttctgttgccaacatctccaaacattagaaacataagtaactgtttttttcagtttccctgggctccacagaatgtagagtgggcacatctgcacaaagcacagggcacagcttgcccttgaacgcttcacagcctctgtcgttgccactgttatccgcttgtgtactcatcctagcctctgggcagacctgcagaggcacggacacacgggcatccagcttattccttcccttttttcacctccccatttagcttgtcttctttacccactttccacagtcctcttaggtaagaggccattcatttcgttaataaggatgtttgtttatttgtgtttcgaaagtacatgctatgttccaagcactttgctagctgctaggatgcaattgactacaagacagatgtgttttctgccgccctaatacctgtaatctggtcgggcagacatatgaataaacaggagtttacagtggagtgtggtcagtgctgtgatggagttagtgcagaggttctgggagaccatggcagggcacccagccttgtctcccgagtcaaagaaggatgtccagaggaagtggcacctcaactgagatcagagggatagaggtgggagagaacctgccacttttgaggaagtaaaagatgtatgttatagctaaaggataatggggaacaagamcggtaatgagcctggaaagatggggggcttatcttggaaaggcatggaaagcctttagggtttgaagcaaaggattggcatgctctgatttgctttttagaaggaccattgtgactgcagtgtggagaatggattggagagggaaagcataaatgaaaggtaacagtgtttgtagacatgacccagtgagagctattggtggcctggcctcgaagaggagatgggatggagctagcaaagatagggattcaggaaatatttaacccatgccttctgtctcagggcaggagtgattttcaacccttgaaaatgagggcttgtcctgcctgtctgccatttggagtcttcatctatgttgtacatcatgttgaaaagatgtgtattagcttcctactaatcaaagcatgtttgtggatatggacaccattacaggtttctcatgcttcccttggctcccagacactgggctaaagtgttggattggttgtgcagtatccatacttgtcaactagctatttgtcatttattttgcaccctagaggccaaaaatgttagagcagaatgattccttaagttttatcccatccaacacccatgtttagcaatgaagacatggggattcaaagaagggaagtgatttgcctggactcccacagagaattgggactggaacccaratgtttcagctcccagttatgtgattctttgggccagacaatggcctctctggccaatttagctacaagagcatgtcactttgccagttttacttttcccactccttttcagcagcagtgagttagtctaaaatgtggcagttaaataaatcaaggctgattttgggtgcacccttcctttaaggcaatgggcctctccagaaggaacagtgtgaacattgtcttccagctctacctctgctccccgcccccccgctttgttttctttgtctctgacagcagtggactcagaacctaaattcccccttcttaagccacttggtgagtggcagggagcagtaggactctgagaggttctgggggttttattgtgatgggagatagtcgtcctgcacttctgtagattacaggccagcaggtggaagcctgggctgtggaatcagattgggtttgagtcccaggtctgcttcttggccactgggcatgcaaggccttcattttctcatcagtgaaataggagcagtcatacttagttgacccttgaacagccacaggtgtgaactgtgctggtccacttatatgtggattttcttcagccaaacgtggattgaaaatgcagtatttgcaggatgcaaaacctacttataaggaaggttgactttctgtaccctcaggttctgcagggccgactacgggacttgagtatacacagattttgatgcatggggggagacgaactaatctcccacaggcagtgggacaaccacaattagacttcagattttaaaagataatatattttttaaaaaccagtgcagcgcctggcccatagttgatggtaactatgcttaaattagattattattcgctgtccttttactacagtttcccaaaccatagatttaaccccccacacagctgtctaccatcagttgccctggtatcagttttttaatgaaatttcaggagtgtgggattctttgtctctgcccttctaataggtgggaactcttacctctctcatccacttagccccccaaaaaagacagttaaacttgaaagctaccagactgtgaaaaagtaaataagaaccmctggccagggagagggcttcagccttagatgtttacaagggcctgaagcagagaaagagatagaaaatatgtaaaagcaaattttacctgcttggaaagtagcttaattttttttttttcttttaaactaattctgtagtcggccttgtgctctgtagagctggatgaatggttaaaaagaaagggggaaaagccagaagaaattaattctgtggcacagagctgtgaattcttccttgatgcaggatytgaggttgaaggaggttaaatatgtgagggccagaaggaagtatcatgtaatgaatgataaatctctagctgctcctcagcagggcaaaacatgggcttagcaaatgggaaaaaaaaaaaaaaaaagggaagtagcaggtggagataatttaaatagcacagggacccctgcttaccaatccctccacagagttttgccctggagtaagcatgacatcagggtgcttgctgcttcctccagtggcccgagctctgtgtgcctttgttgaacaaggttttcgtggagctgaggtgactctcatgaacagagaatacctgtccttcatacagagaagcacccaaatgcaaacatctactttttctggtgttcaaccaggtaaacctctgtttagcaagaaacatcatccccagagtggggactgtcttgtcctttcagaagctagtaccctaagcaagactcataaggaaggtcgggcctccctaggtctctgtttcttctgaacagtgatgagctaggtgcagagagagttaaaggtcactatgcagctgacaagtgtgaccagttcccagtaaattccacttggctggggtttcagaggtgagcaaggcaggctttttactcattacacaagaatctagacatccctttaattgggtggcattctgggtgctaaaaggaaggggctttgagaggcaaagatgatgggatatcataaatttttttgtttcctttttaatatagcgcagctcctatacttaagatttaactttgaaatgtagcatagctaagatctggtccaaaaagatttctgatatctccatgaatcctagttagggattgataggaaaaaaaaaatcttgtgccacagcttcatgctatttttaggaacctttctgaaaccagtggcagcccaagttagagcccagcattaagtccacctcatgcacatcatacagttgcagcttatggtaaaagctttctgcaaagcttttctgctcctgggttaaggccttccagcatcagtcacatgtaattaacagctacattgtgtgcttactttttgctagatgtttcataaacattatctcatataaacctcacaataactaggtattattrtcccgtatccctgttttacagctgtggaaagtgaagtgaaggatttttgtcatacagccagtaagtgccagaactgacttgaacctagctctctgtcttgattcaggaactactgctctttccattggtggctcctggctaatcaatgtgatagtctttgaagaaaaaaaaaaaagagttactatcttcagagttttaaacttatctgggagagaatttaggacttttctttgtgagacagtcttgctctgttgcctaggctggagtgcagtggtgtgatcatggctcactgtagccttgaacttctgagctcaagtgattctcctttctcagcctcccaagtagctaggactccaggtgcatgccaccacacctggctaaatttttaatgtttattcatttatttattattttgtagagactgggttgcgctatattgcccaggctggtcttgaactcctggcctcaagcaatcctcccacctcagcctcccaaagcactgggattacagatgtgaaccactgctcccagcctaggacatttttattattcctctcgctgttaatccaacaaccctgtccacattcctgtaaattggctttgttcatcttttttacttccagacatgttaattttaaaaagaaggcatcttactatctttttaatggcttctgttttcttccaagttaaaccaaagagtcatttgtaatttgcctcagtaattggactgtgactttaaatggctgctagaattggccttttgttgactttactggagttaaaataattctctgttttcattagccaagagaaagacttgtgactcttgatgcttttcccactgcaggagcaaagcagtaaccccagtaagggagaagagaacttagatttgtgtaagtccactgtgtgttggacacttaaacatactttagatgtattatctcattcatctttctgactgcatgaaggtgctattgctgtccccattgtgtaggtgcagagagagttaaaggtcactgtgcagctggacatgtagtcgatctgggattcaaacccaggtctgtccagctcatgttatttctactgtatcacacttctcacctgtatatgttgaatggccagagtgaaggctgggctttatgggatacagaggaggtgactgtacaccaggggaaatcagtgtcacctttctgacgctccgtggcattaccctcattcagaactcattaccaaatacttcatgtaagtaacctcgaaagtcttatgagtacatcgagaactagttccaagtcacagaactgttcttgtggtgaaagtggttgaaaggctatagttcattttggttattggatggaaatgccctctctctctggttgattaacggagaagacttagtataccagccattgtttcttcgtatggaacgttgcttgttttgtcccattttctcatctgcaaaatgtgggtataatacctattacgtaagattattgtgagaattgagaagtgtgataatgtaggtaaaacattagcagagtatttggctcttacatagaggctcaaattgcattagtggcaggaggaaagtctgttttattcattgttgctccctcagcagccaggccattgcaaggcacatggtgcacattcagtaaatgttggtgagtcattgatttcttttctccctttgtacttattttttacagatatttgagcacctagccttgtgctggacaataggggacatggggtccttcacacaagaaacatttgtagcctcatgagatagatggtcatttgtgaaaataatctaaagaaaatgacccattgttgagtggtagatggtgacccttgaggctatagtgtgcaaagctgatttggaaatccctccagccagctctggggctgattgtggtgggggtgggggaatccttacttactacttttggccctgctgtcagaattggaccttgtactgtcattctaagctgggttgagcctgagcacgtcttgtcacctctgtgactgaaggctgatttaatatgtcatgaggcagtttggtttcaggaagtggtttgctggggcatgagcgatggatgttggaagttagaaaagagccagaaattaaaatgctgcctcagttgggtgattgaatccagtcttacctggtggggcaaccacttattgatttggaaagccttggtgaatccattttttgctactcacactggggaatggggaccagcagcatcagtatgacctgggagcatcttcagaatgctgaatctgagcctcctcgtcagacctgctgaatcagaatctgtattttaaagagatccccagatatttatgtgcagtgtgaaaagcaagctttggaaaagaaagggcaattctgtagactttaagcttaggaacaagagtatttttctggagtcatttgaatgtcagtcgttaagcagggctgccaattagggctgattttctcactgtttaatacttgccaagtatcttgagcagtggcttcccagactgagctgctaactgaataaaggtggcatgattgccgatgaaaataatagtacattcgagttttaaaatgtttttatatagatccttttctctgttcacagaacagtcttgtgagatcatctcatctctgctttacaggtaataaaactgaagcacagagaggttatgtgacatgcctagagtcacacagtaaaatcagtagcagttttgaactgaggtcttaaaattccaagaagttgggagcttgctttttttttccttttcaccatctaaattttccacattgagatatgagagaaatcctccatttctgccattgcatttgtgtaggtgcacaacagggaacgtgagacaattatagtagagaataatctggaccaggaatggcgttctgcaataatcacctcttgaacaataaacttggaaagtttcgtggttgtttctgattcagagcctggaagagcaagccatttccctcctcctacccttggtttactaatcattcacttcctcttctgtaaagcccaactcaaaggacccctgctttgtaaagccttccctctgggatgggattggggggcaggcagataattggttcctcattcatattttattcatacttctgttaacaaagctgatcacaccatcttaactgcacatcttattacccacatgcgcagacaaggctgtaagattcctgaggatctagaaagagtcttcttcaccattgtagccccattgtctggcatgtgttggtccttcatacatgttaagtgaatgaatgcgtgtatgcatgattcagactttgttttttgcctttcttttctttttccctatagtctkctctttatagatttttaatagcatccaaaagggtagtaggggcaggaagctaaagggtaggaaataaaactcaaattcttcagtttcgagttcagttctcagttcagctcctctccagcagcttttaggaaagcattttaaagaaagggaggctcacttggggcttgaggatggtctggtccctcacagtgaatagacaagcatcaggcgcagctgcagtttttacggaatacgtgcacattacctttcctcagtgtcccctcgtaagcagtgaaatgtaataaatggcgttttagggagccgaagagttgtcaagtttccacagtttggagaactttaacatatggcatcttgggatctaatgaaataaataattcatgcctggaaatataagcaagagtgaatctctctccttgctatgtgaatggggactttggttgcctttttcaaggtatgtatgaaacatatttattcagtccactcatttatgtccctttactttctcactcactcgtcaaacttatcagcctcctcttccccttccttttcccctcttcttttccctcctcccctcatctctcttctcaccgaaaccctgagggagataggaaggtaataagtattattgttttgtcagtgtctccatcacacaccttctgtttttctttcttgaggcatctcagagggaagtggcaggagatgactttcagcagacctttccccttagtgaggacagtaagtcccaaggacatgtggaggcaaggatgaggggcagatgaacaagcagctgtctggcctaggtcttacagaattatttttcctggaattaatatgcttagaatgtatactttagcaagtgtctatttctggctccagcatttttctttgggtgtcaaacctggttttatctctgagatttttcgacactaggagaatttgacattcacattctaagagtgttctgtaatgtttccatttacataccagttttcttcattttttggctggaggggtatgtgaatatatacaagaatctgagcagattcatttttagctgcagcagaggcaagcctcaggggaaaagtcaagataactggattcctgaaatggtataacttggcaactcgtcttttctgttccttagcctgtaaagcattatttggttttagaagaggagtagctcctacttgtgaaggtcttcattggaatggcacattgaatgcatgaacccttaaaatccttactccctttaacccaagccacatctcagtggctttaaagcatatcaaagcaaggaggggaaagtctgtgtgatacggtactaaaattgatcctgtagtaccaggcatgaggagaggaaggaggagtatcatcattatcctgttaaggatttgtcatgcctcagagcatctgcaaggaaatagtccacagataaagttcagcaagtgatttgcaattggtagaggtggtttggcattttgaaaagctttataaatgtgactgcagcctgagaagaatgaccaccactggaatgagggaaggctggaaggatttaaggggttctttatgaaatcaggcacacatccccatgtcgactaggctagactcaggcaccataatagccctggttcagggtcactcctctttccaggaaggtttggatcctacagttagaaaagaggaatcttggatctctaggtaagggttagagaaagtattctgggcatcccaagttagaatctggtgtctttgcttaacgagttctgaacatttcatgtgagggaatatgggctactgttgtaggccttgctgtttcacctgaaccatccctgcccttgaaggacttaaagttggaaggaatgtgaggaggcggagtagcacagttatatgacatctaatccaaagtagaatatgcgagccttaagagaagtgcagagggctgtgaggagtatgaagtggctggcaaatagattcagtattatatttcatttattcattctgcagatatttatggaccacccttttatgttgctattgctgtgctagtattggagatacaaagatgaatatgacacctctcgggccgttgccaactgtcgagtaccaggaagagcgcttagataaatgaccatgtacaatggggtacgtgcaattataggtccactgttatttgctgttctgaattccaaatgttaagagttttgacatgaaattttgtttcatgaggcttttagaagctaaactagaaacgtactggatatttaaaaactgtgttaccagaatctgataatggagttctacactagtccctgtggggtatgttgtataataaacaataagtatactgtaatttctttctgaaatctacaaaagtatgaattctaaaacagccagccccagctaaaggattgtggatacaagtaagatacttcaggtgatttgagagtttacctggctgtatgggctaccctgggaatataaccactctttataacatcctttcttcgagaatggtatgtgctaagttataaacagctgacttagggccatcattttaaagtatgaagccttccagtcttcgcctccccagtcttttccattcttaaagtttggacyagtctgcaaggtagctgcctccctaaggatttggggtattctctaaaatttgaatatatgatattcttgtgccctttgaatacgctgtttaaaaataaattttaaagaatattctcatgtaaaagtaacacacatactttggaaaatacaaaacataggaagaaggaaaaaatggccacattcttactgtgaacacactgatgctttttctgtgcatgtttttgtttaatagtgttagtctgacgccttcttattcattataacatacccattttcccatgttatttacatagtcttggtaagtatagtttttttktttgtttgtttttgttttttgttttgagatggagtcttgctctgtcgcccaggctggagtgccgtggcaccaacttggctcactgcaacctatgcctcccgggttcaagtgattctcctgcctcagcttcccgagtacctgggactacaggcgtgtgccaccacgcccagctaattttttgtatttttagtagagacaaggtttcactgtgttagccagggtggtctcggtctcccgacctcgtgatccacctgccttggcctcccaaagtgctgggattacaagcatgagccaccgcgcccagccttggtaagtataatttttaatggttatacacagtttcattctgtgaatttatcataatttgcttaaccatctcccatcattggacattgttatttgtccttccctcccttctttccttctwtaagtaatgctgctgtgaacatcttgcattgaccagattactggggcagattacctgtgcttccacagtggttttaccatagtacagatgccatcttcttcccatagtgcccttgcctagtacattttaaattcttggaggacagagtctccttcacatttgtctctgggtcctctacactgccctgcttagggtcttgaaggtgattaacacatttgtttaatggatatgcagtccagacttctgaatgcccttttccctcttagagttaatgtgtaagagctggcagtgctctgtaaatgcacagctgcaggtaggacactgcgcctccaaataaaacatgtcctgataagcatttgcagggaggtttatattctcaaagatatcctctttattaacagttgtttcaacaaggaattttttttttttttaatatcagctcttgtaaaagaatggaattaccctaaggagtgagttctggggacccaaattgaggaatggtgccctcgaagtcaaatactggaaccagaaaggttagaaatagattaaaagcctcagctttatcagaaaaaagccacagatgaaaagcctcaagcagcttccagcatggctgaggagataagcttcccatatttgcattaattagcaggagcacctagcactgattgcttgatgcgtgtagctggagctcctgccaggggagaagagttccacgcagcatggatgcaggagtcggactagagcacagtttgaaagcgctttgggatggcctcaccctgcatgggtgcttggttgactgtgcgtggaggtgactagaaaggacaagcctggggaagagataggctggggtagggacctaacagggcaagagggtatgtgtttgaaatgttaagtcagtttaccaaaccttcccagggtctctgctatatgctagactgagtgggaagggctaggggtatagaggtgacaaaacccaaacacagccctctgagcrttccctatgttaaagggcacaaatagttgctataataatgttctattaaatatgtaattatggcctttgacataatctgtgtctgatagtttgcacccaaacttgtgagatagggcttacgcattttgcagaggagaaattcaaatgcagagggtttgaggcatttgcccacagaactcgccttccttggctgttaggctttgtgggttaggctttatgtccccatcatcgcattgaactgtgtttcccatggtctgagaaatttagcctaactaggcctccccccaaaaatcagtttacttctcaaaaatggatggatgagggggtcagtgggtgaatgggtggatggatgggtagaacaaagacaatattcataaaggagggtgtgactgatgagtaagtgcatggtgccatcatctatactgcattgtccctttgttcaagctcttcctaatctgaagtaaccttacctaccctatcttatcttttattatcccccaacatccatccatcaagctgtcctgtcatccttctatactttcatccatctaactattatttgctwgttccaggcactgtgctttggacaggcaatatacaaaaatgtgtaaagttcagtccttgaactcttggtgatatgtagtcagctttgttcaattagagtcagataattctgcttaacagtcaatttccctgtgttccttctggccccattactaaaaatgctctaactgctcctctctgagcagtactcttcaaggtctccctccttggccaccaagaagtcttccctcaaattgtgctcattcgcctttttgaccccctacgggccttcttcatctgaatcgctccctgctatgaggtgtttccttataccattagcatatcttaccttgtttataaactgatgtctagataaatgttccctgtgggtgtgaacttttgcttctcatcatttcataatgataagcacaaaggtgttaaagttgtttgctcatttgtgcattcgtttgggcagttgcacactttttaaagctcagtaaacatgtcggatgctgtgaatcttgatcattttccccagtcctggtgtgatgagcatgaagatgatgatgggtaacccttattgggtacttcctgtgcaccaggcactgttcttagtgctttacatggtttaactcattaaaccctcaccgcaaagctcactgtatagaggaaggaaccagagcatacaagtattaagtaagttgctcaagcaggattagaaactcaggaattctggccttcagacaccctctgtaactacaactccatcagtacatgaaggagttctctagctgctgtgactcccgattttgtgaagtgtttttattttatatcaaagtaagtgatggacttaaactgtgaatggaagtagaatgtcatatacgcagtgagataaacatcagtgaaataaatgctagctttgtttttagttaattgagaataactttgtaagttcattttgcagcaggtttttgttatggcccagttttcgccaaagcctatttctagtgttttataagaaacagtgcaatgtacttcaggtggtcctggtgtctaaaacctactctgccatttgatactgtgagaacttgagcagattactgtgccctgagccttcttttcttcatttrgaaaatagcaaataattctgcctggcaaatttgttgtgaggattgagggagataacacctgttattttctagtaccatacctggcacatagtaggttttcagtaagtggctaaaaataatagatatatcagaaacttgttagcaggcagtgattttctaagttaagacaggtascaaattatttatgatatctgttccagtaaagccttggctcattattttgcttttatttatttttaatcagtattggaacattgttggtactcgctcagcaggaacagaacgtgataaagttacatcagaaaccagaggcggaaaactttccacggtgatatgcataaacaaatatttcatattttttacagaaagtctggctattgcctatagaagacaaaaactggtaacagccttattccagctaaatttgaatgccaggttgacactaatcatggatgctttcccagagctttcagaaaaacaaaaccaacctgttgtgtttaactttccaaagatgtcagagttacaattggctgaatatttttgaagctacatatatgacgactctcttcatttcagtaattaaaacaaattttttaaaaagatacctcctgaatagataaatatgatcataattatgtttttccttggttttatttagaccataaaattttttctagtgataagatcattttgttttggccgacatacataaaattctcttcattcatgaaattctgtgttcactagtacctgtaggctggcaccaagtcagttttgttttttgtttttttttctttccaacttggtggtttacaactccttgagtattccatttttatttgtgtatgtttctgaaagttctgcaaggaaggtcaactatttaaagtcattactggtatatcttaatatttattttactaatacttttttttcatgcttgctgtaggaaaatgaatgtgggttgccaagtcttccttttctcttaggtctggtgttctctgaactaattcactccaaagtgttgctgtcaaggaagactcaaattataaggaaccactaggaccatctttattagagactggcctttactttcttaggtcttaaatagggtgtggatgggagaggttttccagttcctgtttcacaggcattaggaccaatctttgtgggcagccacccactcatgagtgtatgtctctctgtctctctctctctttctctctctctctcagtatggtgtgtgtgtgtgtgtgtgtgtgtgtgtgtgtgtgtgtagagtgtaaaaggaatgattggttttactaccccatgaggagatccagtattcttatggggggagggaatattaggaaagatgtttttttcttctgtgcaaagctgtcatgctttgtcagtgattacagagataaacttaacagctgcattgctaaattacccctccctcccagtggctgcatcctacatcacagtctgcatgtggtctctgtggttcattgtcactggttcccaaaycaaaggaagccattggtcttgttgagtggtgacgcttatcttcataaatcctggctgtactgggcgcatcccttttagtttatkttcagcccagccctcatagctcactttcccctgcttaaaaattttcatgggttttccctcacctttagagaaaagttgagttactacaatttgactcccgtttttgcctttatgggggttcatttgaacctcatactttgtggctaaattacactatagtcacttgaatccatttatatatacaatttatcgttttgactactgtctagaatggttgtttgtccagttttcattttcctacttttattgctccaatgttttgagatcttggatcattattactaaatttccaggttttatggatagaattttgtttttaaaagggatttgttctttagggcccccaaattttcaagacrccctacacattcggttggccattttaatctcttctcagggatgggttttgtccattaraacctctgtcctccgtgccagtgaactggaaatttaaggcggatgtsatgatgatgagtctaacaaaaagctgtcctcatcacatacccagtccyccacaaggtttttgtggatacagtcagtgmaatacccactcttaggccatctagattagttcctcacagattctggggatttcctacatctgatgagtttctgattgcatgtcctgaaatggcaccatttttttaggcccttacccttcattggacattatcatggcttttcaatttagacatctactgacagtgattctactttgcccatcaaccaaatctgattttctakacctggttttaaggcatcctattatctgacccttcctcatgtatccagtctcaactacaactttctgttcttatcaagttagtctctttccattctgaaacactgttccccacacatccctgcctttgtttggccttctttagctgtctgcatcctgccttctttttttttttttttttttttttttttytttctgtgatggagtcttgttctgtcaccaggctggagtggtgcagtgacgtgatctcctctcactgcagcctctgcctcctgggttcaagtgattctcctgcctcagcctcctgagtagctgggactacaggcgcgcatgccaccatgcgcagctactttttgtatttttagtagagacgaggtttcaccatgttgccaggatggtctcgatctcttgacctcgtgatccacccgcctcagcctcccaaagtgctgggattacaggcgtgaaccactgtacccagtgtttttttggtttttgtttgtttgtttgtttgtttgtttcctggcatcctgccttcttttaaggctaagtccagatgccatgctctctacaaagagggccttacttttccagctggtgtggatatatttttcctctctccaacagtagttactgcagagctcacaacgtagtggcccacttgccaaatccatcccatgaaggttttgtttgctccaccaaatttgcctagttgctgttatttgtatttcaggaaatttcacataaatattggatttctggcttgtttgaagaacatagaccatttaataatagtgcatcccctttcccaattggcaaaagccagctaaagctattcaattagtggctgttttacttaaatgatgaaggttgttgtaactttgccgcagcgaaacccactccttgttataataggccaaccttgcttctctcattaatattatcttcctgaccccagtaactatttcagtttatgatcctttgggttcttgttcatttagttgtctacccccaccacactctatttcaaattatttgtgtaatttttatgagagtagggataacagctttctaaaaatatattttccccaataatgtggatactttgttgggtaattgccaaatcagtgattggttttgatattgtggcttgaatgccatggttgatgtacacatgccagagctgaaaggcctttcagtttgccaaaaggggatcttattaagtgcttgcagttacattcacacatcatgattaataatgagtatccacgtggagtgcagatggtaacagtcgtattgcaattggtgaaccttaagcagtttcagatgaaatttcaaaaatattttgatttrtttttaccaatagactaataattaagccatttctaaaaggaggaattaatatacaaatgcaaaagcgatttgtagttttgactaaaacatctgcaagtgtggagtcacaatatattttatgtttctttattttttcctatttggcaaaataagtagggaaatagtggtttcccagatatagattattagatccctaaaacatggtatacttgcaggattttagacacttctgctttgacagtgtgattaaatcaaattggattctaattaaaagatactgcaaaatgtagaacatatatatttggttggtgcaagagtaattgcgatttttgccatgccattcctttttttttttttttcgaggcagagtcttgcactgtcgcctggactggagtgtaatcggtcatgatcttggctcactgcaacctccacctcccgggttcaagttattctcctgcctcaagtctcccgagtagctgggattacaggcacccgccaccttgccccgctaactttttgtatttttagtagagatggggtttcactatgttggccaggtgggtctcgaactcctgacctcgtgatctgcctgccttgttttctcgaagtgctgggattacaggcgtgagccaccgcgcccagcctccattacttttaaatggcaaaagccacaattacttttgcaccaatgtaatataagatgcagagtttcttagaggaaaatgagttcacatgccatgattgtgtatgttgattcctgggttccccacatatcaccatatagatatgttgcaaaacagaataaattaagttgtttgtttttttaacccccccaaaaaaactattttttacactttggataagttttttagcctgaaaatctggaccagtacttagttgtagatttacagtacctagacttggagatataaacccctgttcttagaaggtagaaagccctgtcatgattaaaaaaatcaaggaccaaggagggtattccctctctcccagtagtaagttttcaaattagttaataagcatatgtcagtctttatggacaaaatcaagaaatgatgtcattgaccatagagagatttgtaaaaacttaaaagcaatggagaaagctataagtgatagggaaacattgtttatgttgatccacggatctctaatactaattttattgagttgtaggtttatttatttctcccagcatcctttgtgagggggtacatatcatttccagttttacagataaggtaattgagtttatctagatgaaataaccttgttcagtgtcatacagccccaggttatctgcccccaaacctctgctatcttctaccacacaacacagccaccaagtataatgttttttgagtacatatacatatgtactctaaacctatttgttatttggaaaaacagcatgttggttgttacatgttatttggaaaaagtgaatctgtaaacatatttactcacccatttttagacagatcagtgactgttagacaaatcactgacatggattcttggttatggttaaatgaaatggtgctattaatgaccaagcagaagaatgaaccaataaaattatcatttccttgtttatttttaaatttcaataaaaactgaagtgttaaattctaacatagaaaattaaattcacttttggcactcttcccagccccaataactgattgttctgaattttaagtaactggataattctgactattttattacaaattttcactctctaatagaatcgctgatgagcatgtattgctctccctcttttctattgccttttgttgatttggataatgctacagctcaaagctggaagagtccagtaggattattaaattatatgaatcatgctctaagaaagttctagtctggattctgaaaatgctgacatggttgactgctctctactgtggcagactgtgtgtcaaggatgcctcccaggagttgtgctgatttgtgaggactagttgtcaaaagattccataaccattatcacaagtagactttatccacaaaatgcccagtttcttgggacatataatcacaattgaatatatcacacaccacttttaaaaacttgtattctaggccagaggtcagctaccattttatcctgctagattctcctgaaatccatactccatatgagaagtaaaggtagaaaagggacagcgaggaatatgagcaagcactggtctggtaaaatcatctttgttcagttccagctgggctacttactggccttgtgatgtgttttaaaggccccttgatccctctgaaccatggtttccttgtcagcaaaatagtcaagaacactacctctgcctatctctttttgatgaccaaataaaataaggaacatgtaagtgccagtttgaggtattcttaaacagtacaaagttgctgaatgagacacagactcaggtttctaacctggcacatagttgatgtttataaaagttagttcccatctcctctttttagttgtaggttttatattgattattkgttcaagagaggcaaaaggttgtaaatagctcagggtcgctttagttatggacgcccctaactattttagtggaccggtttcctgcttaacgctctatgttctttcctccctgccttcacttctcttttttctccttctctgtcaactactacattgctaactctttctcatctgtagtatagaaattatacaatatttttacaatagagaaagatctagaaattatctagtcaagtctatttgttttatagatgaaggaactaaagctgaaagaggttagtttcttgtttgagatcacacagctgataagcacccaagctggaatttgaaccctgcgcttgtttcaaaagcaaatttattttcactgcactatgctgcttttatgatttgcattccccccactccatttaaaaatatgcttaactatctctgcagaagtggatttctaacatctgccattaacatccactgcggtttgtgagccagtcctcacattccctcgttgccatattcaagactccatgtgggacagccatggatctggcagagaagcagatttcagcagaaggtgtgggtgacttcagaacccctagtgctgggtgtatgattcagaccttacatgaggaaagagtaatttcctgtgcctcccccgtgtacttttaggctatagcaaccacaaagttcagaggaaggtgtaggattcgtgtacttctgttcattttttttcccctctctgtctcattgtgaatcaagggcttgattttggagattttgcttttacctgccaagcagagggaccaggatttgttctgtcccgtggtagacatggctttcgataccttattagggtatcactttcaataacactttctacttcagcttcctcatctgtgaaatgggtttgagggttcctgccttgcttgtctgtaaggattgttttgartgaactaatggatgaggaagggctttgtaaacatgcctaacactctctaattgtgagggcctttatgaaaagacttaaaagtaagaggtaaaagccatggatttgaattctggttctgcccccagagtggttactgggtacggtgagtagatgttgggtggcccagaaacaacagctccccctctcttctgtttcacccatgcgtatttatatttagaaaggatatttaatgcatatggataaaatatcccaggaattaattagagtttttttcgtccaatgtctctcgactgttttatcgtatgtcccagtccaatatttgcactcttagctgcaaaacttgatgatgcatcaaggaaaaaaagagaaaggcttatttgcatggaagacttttgcaaagaatgttttcttattggcatatattgtcttcatgtgtttctaatgaaacagaagccagtgagtctctgggtaatttctttgtttccaccctgacgctgttgatgtcaacaaaaagtgcagttcmtttttaggtagggtcatattttctttttcttttttttttcatttagcacaggagtggtggacttaacctgccacacccttttaatttaataaaatatgtctagattatgggatgtgactacagctttctgtggttggtcgtgtccatcctaaagatctggactcaataccttgaaatgctcatgttactacaatgaaaagcgtgtgtaacacagcagtaagtgtttacattgctcattccctttatgctgtctaacatcatagagagttaaagaactcatggtttgagggatattggtactaatttacataacttttataaggccctttgatttttttttttttttctggttttcaacacacttattaggtctcttgtcatggcacagggaaataaatcttcagcctcgctgagaaccatactactttggatttcttcctttcatggctaagaatttatttgctcccttgagctctacccagatgaggtcctcccgagaggctccctgccactctctacatctctgtgaactccactggcagtctgaaaactgtcctgctacgtccatgtgatgggcccacaaacgcctacagcccttcgtcaacagacacaatatgagtggcaaagacatttatgtaatctggggacaaatttgtaaactcttttgagaaatcttacagaaatcatttcccaattggagctaatggctgcttgctggtggtgtttcctaaggcatttgaaagccatttctatatctgtacttcctttattcccactctttagacttcttggtgccctgttagatttagactattatgacacttattttttgtttctgtcatgagaactctgtgtcactttgtgcttgtctttaggagttttcaatgtttgtttttgcttacatttttaaagatgggattgtctaaacatttttcatgtggtaaaaatggaattcatattttgaatttgtattttttctactgaactttctggttctttcctctcaacttcatctgcttcatcttttgttgtcttaaattcactggatatgaagaactagtatggcttatagttattggtgtttttctcytgttgcctatagccgttgtcctcgttaccaagtggctgctacaggaaaccatcttttaggtgaatggccagactggatggggcagactggttcccctttctcgctgacgctgtttggcagctgctttctctccagtctcactcaggttaccgtggcctgtggtcctcagctagagcatgcatcgtaatcaactaggagattctgatctggagagtctgggatggggggccctcggtgcctgcattgaaaagcacacacatgtgattctgatgtggacgggtgagggtggggttacgctgtcaaagccgtacctattgtgagtcagctaggctgcacatggacaagggaccccagggactgacctccctcagcagcaggcagagtccttccatcgtctgccattgagttcacttagttttctgtgtctgccaagaccgctcctggcactgtgagtgcactgctctccttgtccctttatttctgttccttaatttctgttgactcacactttccaccttctcatagtttagggtctctcatgctgccatggagcttttttgttagaggagagagagagagagagagagagagagagagwgtgtgtgtgtgtgtgtgtgtgtgtgtgtgtgtgtgtgtgtgtttgcagtcttggctctcagttcacgtttggcctgcaaatcccaatcacaaatccatttggtcagaattcgggctaagtatttactccagattgtctcagctgtggctgaggtactgtcacagaagaccctgggatcagcctacaggacacaaatgccagcttttttgtctgaggatacctgtcagtagcatagaccatcacatggcttagcaagctggttcttcgtagtccatgattggctacagtagaagaaaagcctaaattttgaattcatagttaagagttacagtccttgttagcacttgtttacagtgtgatctggggtaaatcatttatcctttataaaatggagactaatgtagcttttgtcacagtagcagaatgtatatggaatcactttgtgaacttagaggaaatggaagagattgttacagctggagcggcccagtgccccccagccttcttttttaaacaaatgaggaacgaagctctaggagtttgctgtgcccaggaacatcataatttattagcagcaatgccagacctagaggtcaggcccgcagggttctttttgtgacatcttttgtcagggcaaagcatccattcatggaactgggctgaatctttctcatactcttcccttaaagaggcttgcctttttgaaacttggttctttccttgatcactctgtcatagaatctgttcttggagccgctgatgaagtccggtcattatcagtacctttacttctgcaaaaaaatgtgactggtattatcttctacttggttgtaacggtttacgttctcctccagttctgttgttctcygtgaggaatgtagttttttacatgccttttccattggagagttacaacaaaaaagcaaaataaatctatcttttctctgatatggcctccttatttgttttaaaagcatttttatgtttatttgrataatatttagaaaatataatagatttaaacataattttaaaagcatcraaatgcttacgtttctctaattgtgcaagaatctttatatacatagtttttttttttaactgaagttgcatcctgccagtaaaatttgaacgaattgctttataagttgataaggcccctttaaaacccttttcacttcttagctcctgtgtgtacctctgtttagaaggtgttttctccttcctaggctagccaggaggagagcttttgtgtgcaggcgctgggacgcctcaggggactggtaattgagagaggggtattgacctgggtcatccatctgaaagtacgtaagtgctgctgcccaaagccattattactgccttccaggaatctttgataagtgaattagtggctttctttagctctctttgacctgtggaaagcccaattacaggcttctttgttcacccatttgtaacttctttctgttagggccaggaatataacttcatctgaagacttctcccagttgtgggtttcaaagcatttggaagaagaaaaggagctaccatttgttgagtgccttcggagtgctcagagctttgtatatgctctcatttcattcttgtctaagatctagagatggttaggattattcattcctgtttcacagatgaagactctaaaaaagttggagaagtagctcaaggtcatccagctacaaaataacacagctaggagttgaatatggagctacagtctcaagagtctatgcttattatgtctcactaaatggtttctgttccaagttaagggtagtggactatgaggaaaagcgaagagaggtttatcctccatttccacccacaggtatacagaaataagaactacagtaggtgtagctaagagccaatccaatcctgtactggtggtattcaggaaggctttatgtggatcaagattctatgccagagaacacagattccttcagttcacttcagcatacatctgctctgtgcctggtactctgctaaggaaaagaagtccgtgcttccaaggaagtgaacttctgttgatcactcggacttgaatgaaatattatgtcatccagtattaattctcaaagatacatcctcaacaatgaatgcgatagtgagaagagaggcagaggttgctatgtcaagttgatattgtgtggcggggttaagtatccccttacctgttttccatttaggatttaaggtagatcgagtggtctggtgcaagggttcagaccataaaccacagctgtttgattcttcagcctggttctttaccagctattatctcctctctaccaaagaacatagtaacctccccatttctgcacctcctccaaaacaaaacttccccgtaatggtaagtgaaaacttggacttactgaaaaatgccagcaaggcccagttgaacctccatctttcatgccttattgatatgcatgccacttcttccatcttcatagtatcagtcatttgtcatcctctaataatttcaaggcttgctgtcattttgagttggtacttccccaagggaaagcaatgcaggcagggaggtatacattagtatgagaagaatgaaaaatgattatataaggtattgtgagtcatagacttttacattctaaaggaatttattgcaaacattacctttttggagatggggaaactgagaatcaagatctcaaagccagttagtagctgagccaaggctagaactcaggtctctttacttttctcgtggaccccagctcctccgccccccttcatcctatggaggatgctgggactaatgggattttgaacaagtcttgggagtaggaagtgatgagctttttaaatgagaacaggcaaggttttatctatgtggcggatgttaccagacagggcagtgttaaccctggctgcccattggaatcacctggggagtgttacatgtgggctaatgtctgggtcgcaccacagaccagttgaaactactactttgttctcctcgaagtgtgacctatctcaccagctctgtcatctttaggaatgacattataagccaggttttctggaagtgaggtttgtagacaacctccatcaggatgcccagagatacccagagaagcagataccaagatcctgtgagctcctccttaatacaagctcctgggttcagaagcctggctgctgtgtttatagcaagtttcccaagtaattctgatgcacagccagtgtattggatgtggtttatttttcttctagtccacatgtcccccgcagttccttgctgatgcctcctgctactttgcttccttactttccccttctgcagaccttgagtggaagcaggcgtgaccctgccttgggagggaccgctgaacttcaaggttttcaattgattttgatgcttttctccttcctcagaaaggaaagagatttagcatatgggctttcttcatattagatttaagataagaaatgataattacaacactaaaactagcctttaaaaaaatctgttgatttgtttggtaaatgagtgataggattttatctttctccattagattagcccctctgttcttattgatacactgtatttatacatgtttatggggtacatgtgaaattttcttacatgcataggatgtgtaattatgaggtcagggtatttagggtatccatcacctcgagtatttgtcatttctgtgtgttgggaagatttctagtcctctcttcaagctattttgaaatacacgatatattgtcattaactgtagtcaccctactctgccactgaacagtagagcttattccctctaattgtatgtttgtactcgttaaccagccattctttattctctctctctcccacctacatactcttcccagtctctagtatctgtcattccactttctacctcaacatttttagctcccacatatgagtgagaacataagatattgttctttctatgcctgctttatttcagttaacatagtgacatccagttctatccatgtcattgcaaatgacttgattttattgtttgttatggtcaaatagtattccatttgtatatatactacatcttctttatccatttatctgttgatggacacataggttaactgcatatctttgctattgggaatagtgctgcagtaaacatgggggtgcaggcatcccttttatatactgatttcctttcgtttggagaaatacccagtagtgggatagtggaattgctggattgtatgatgaatctattttagttttttgagagatctccatactctttttcacagcgactgtactaatttagattcctaccaacgatgtgtagagttaccttttttccacgtcctcgccaacataggggttttgtttgtttgttttggtgtttttaatggccattctaactgggataagatgatatgtcattatggttttaaattgcattttcctgaaggttagtgatgttgaatttttttttatatacctgctggtcatttttatgtctattcatgtcctttgcccattttttgtttttgttttttgagacagagtcttgctctgtcccctaggctgtagtgcagtggtgtgatcacacctcactgcagcctgatctcccaagctcaagcaatcctcytgtctcagcctccccagtatttgggactggagcttaccgcagccttttagtgacagtaagtctttttttaaatttatttttattttttatttcttcatcattcaacttgagacagcaagtcttgcttcctccccttccattataaaacatgactttttttatttccataaagattttatacattataaaaataacaaaatgggaggaaagctcagagtggcacacaatcttcataaacaggatactagagaatagaatgataatctaaatttagtgatttttgaagcagggatgactatgtgaaaatgtatagtttcattgggaaccatttcctaatgatacgaaatcctggtaatgaaagcaagtttagttcagtgggtgatcagcccatcgtttatagtttaacatttagtttcatttaaaaaaccttggggcttgtatcatactcctaaaagatgcaaaaacaaaagaccaagaaatagggagatgcaggttggtaggtgttggaagctaatttgcaaagttagctgaatagcccacgcatctgagcggtacatgtagaaatggaagaaatgattttgacttcctactctccttttccttgagggtggtaaataatcttcttatcaaaactatgtaaaaggtatatataatttcttggtaaagaaaaacaaattccttggaactgtgtggcctacaagcagtgcagtgtcttaatagcacatcagaataatttgtacttgatttttttaaaaagggtagagtgaggttgaaggtacatataggataaactgcccctttaacatgacacgtgctgaagcatcatcctttcctctgggtctaaggcacttgttagtatagctcttctggtcgagttcagttttaggagcgagcagcccctctgctgattggaagaataaagacttgggaatgagaaggatttgttgcttgcagggcaagtgagaccaaatcagagcagcccggcagcaggctctcctgatcagtgggccatccttggggaccaggagcagccattcttgtttcaggacggtgtgatcctcagattgcccccagtgtgatttgtttggccaagtggattgttcagcacttgttctgtgtgctggtgactcatcttacactgtagggtgaactacttctcaggtaatacttacaggaaagatttctgtttcaaaaaaggaggattaactcaattcattaggaaaaattaatttgagcagatgagggaaatggcttttaaaggtagagagaaacagtggactaaaatctgtaactcttttctaaggactgttttttcccagcagcttctacctgttggacagaattaccttctttaggtacctctgtttaggatagattttgtttgttttttattaaactcaaatattagaaccaaattgccttcttgcaaagaaacatacaggatgaagatttagcctagttggtttagtttttgtgttcttatgcatgttttagttgaaagacagtttctatgaacatagagcaaaatatgagcaaaatgaaaagctttgaatttataagttacttgtctctacactggttatccaattaaccttttaaatgagggaagttatttctttrtacttttacatacagagctgattccttgagatcacacagatcagacagaaagaatgttagaattaggaatcatcagaattataagggtctgcagaagtattcaaactgcaggtcacaatgtatgttaatgggtaatgaagtgaatttagtgtgatctttaccaaaagaaaaagtttcatcttattggagggggaaacatgggcccaaagtgacttagcttggtactttattgtaaatgtttgataactttttatttgatttggtttgattttttattttttgagacaagattctcgctctgtcacgcaggctggagtgcagtggcacgatctcagctcactacagcatctgcctcccaagttcaagcgattcttgtgcctcggcctccagaatagctgggattacaggtgtgggccaccacgcctggctaatttttctatttttagtagagatgaggtttcgccatgttagccaggctggtcttgaactcctgacctcaggtgatctaactgccttcgcctcccaaagtgcggggataataggtgtgagccaccatgcctggcctgatatttaacttggaacgaatgcctcaaaattttgtgatcctggatgcttggaacacacacttagcacatttatctaatgcaggtaccagagaccagataagacaaaaattaaaagtaattctacccttgcatgaatccagaggcctgttcatataaccagagaccctgacctttacgtacctttcaactttcccaggacagtgcctcatctaatagtgacccccttaggggtgaaagagacagtcacacatagttatcaaaacctagaaaacctaggtttgctacactaagctgagatgaccactmtgtcagtatgaaacttggagagggactttggtaggtggcatgtattactgggaggcagtttaatctgttgggacataagtttaacattcttgtttctttcctgctgttgaccctgtgagcatgtgtagacagccacttgaactgtcactatctgtattctcaggacatcctgctaacaatttttttgtttgcttccttcgagctagaggtacagtcaggtcacagaatggctattttacttggaaaytgtatcacagaaatctgcattggccttctctctctgggtgtgtgggtaattctgcaaacctcggattttactttcaaatttatccacagctaaaccagactctgcctttttcttaagtctaaagaatgcatcctagacaaaaggccaatttcagttggccttaattctcccactgcagcattcctttagttgtatgtatttgaaattcaaggcctgttctggtttcaagtacacttctttaaaagtctaaaacagaaatgtattattggactgataatgccttatggaggccaataatggttttatgtacaagccacagtactttttttgttagtagtttaagtgcctttgactgttccttctccaccctccctcctcctccctcagatttcactaatcatgttaagtaacttgatattgctcttgtcctgcataatgtaagctaacattggcaaaattgatgggggaatgcttcaaggaaagaatttcgtttaacaaacagtagtataattttrtggagactgcaaatgattcttaaactggagtgctatcaaggagcctgaatgcctcccctctaaatgtagtatatcatgcaacaatataattttttaaatatttggagagaaaagatcacctaccatcccactactctaacccaactatttttagttattattttttagtttttgttgcttgtatacattgttttaaccgttaccatcttcaaatacatgccatgttgaattttgcgtttttttctttaaaatagtacaaatattgctctatagttacacagttgtgtgtgtgtgtgtgtgtgtgtgtgtgtgtgtgtgtgtgtgtgttttaagacgggatcttactctgtcacccaggctrgagtataatggcatgatcccagctcactacaaacttctgcctcctgggctcaagtgattctcccacctcagtctcccaagtagctgggactacaggtgcacactatcacacctggctaattttttaatatttttgtagaggcaaagtcttgctgtgtttcccaggctggtctcgagctcctgggctcaagtgctctacctgcctcagtctccctaagtgctgggattacaggcatgagctaccgtgccaggcctatacagtcttattttgagggccacataataatatcatcatatagagatgttccttaatttactaaatcatttctgtgttactggatctgcagagattgtgtctgtattttggctgataccatcagatctgtaatcaactttgagttattagccacttttctcctagtgaccaatttccttggggtgtatggaagtgagatgcttggacagagggaatggagcaccacctttatggaacttgtgctgccatgttgctttgtgtaacaccactagccacaaagaaggttcatggttttaggaaagactactttttcagctgctcctaccagttctgggctggacacttcctgagtttctctctagagagagggcctcacccaacatccccttgtatagactacttacgggaagattttytcaaggagaaaatatatcagtcacaactaagttccctactcttgtgaaggaaaatattctacccaatgggcaaaggatattccaccctgaccacaatgcttttataagcatagggtagaggagttccttcaacacgtaatttatttattaattacaaagtagatttttatcaagggagaggggttctgctgagataccagaatggttaagagcctagctgtagagatgacttccagcccctccatttacctgctgtgtgactgcaggcaaggtacttaacattccttatctgtaaaatcatcatcatattcttattcccatctcattgggtttttgggaggatctaatgtgattcttcatctaaagagcttactacagtgtttgcacaggctaagtactcagtaagtcttagctgtcagtattatatcacaacataccatttattcccctattcttcaaggtccatgaattgcttgactactatagctcttgttactcttgttttccttgaacttcattagatctaggagctgtcgctagggttaactgtaggcttgagttgagcaatagattcttttttacaaggatttccccaactggagtgtatgaaaaggggctgtactagtttttttttgttttgttttttgttttgttttttktttgtttgtttgtttgtttgttttgagacagagtctcactctgggctgtactacttctttgtcctcttaatgactactttttttttgagggggtgggtggcggcggtacctgtaggtttaggttaatattaagctttctcattctatcttctrtgtctcttatcctcacttattatcctactttttctttctctgtgcttcattttaaggataatttcatcagatatatcttccagttaactaattctctcatcagctattttaatggttcctttgatacatattttttatattttagacctgcttaatgtgtatttatatctgtctatcgttcatagtgtcttgttcttttctcatttttattctcattttattttactatttaggtctttatttttacaaattgtgtcatgtattcagtaactgtattaaatcaaattattggggaaattagttctgttttttataactgttggttctctcccatggtagattgtattctttcatgtttttatatttttggaaggtaatctcgttatcaggagggctttctctgtgggaaatttatatggcctgatgtgagtcattaccttccagagtggttttgcatttgattctcctggggtgcttccagctccaaactgcttatttaattcatttaaaaatattttttaaaagattttaaactttctgaaaaatggcaagtacagtacacagaaccctcccccctacaaccacttatttgagattaagtmactgatatgattcccctcatccctgaatgtctagacccctgttgtatacaatcactttgcagcttgagagtggattccactcaggtggaatcactgaccactagttatgtaatctcaggtcagactcctccagccgcaccttcactcctacccccaccttagagacagaccagctttcttgcatctctctgtgctggtgggtggatttttctcttccctagttcacctttcattgagattgtagtccctcaagaggtccaactttgggagggaatctaagtttcaaccccgcacctgtgggtcattttttgctgtctctgcaagagtgttgaaacctaagctcccttaggttaccaaaacaatggaaaagggctgtggcaaaatcacctcacatgcttactgcttactcactatggatgttagccatactttatccagaacttctgtgtgctttatgctgtaacactggaagtccttctttgcttttttcgggggagacagtttcactttcgcccaggcttgagacttgagtacagtggcgcagtcttggctcttcagcctcgacctcccaggcccagatgatatccccacctcagtctcctaagtacttgggaccacaggcttgtgccacctcacctggctactttttgtttagcgagacagggttttgccatgatgcccaagctggtcgctggtcttgaactcctgggctctagcagtctgcccacctcaatcttccaaagtgctgggattacaagtgtgagctgccaaacctgacctttttttttttttttttttaaagacagggtttcactctgttacccaggctggagtgcagtggcaccatcatagctcactgcagccttgaactcctagactcaaacaaacctcctgcttcagcctcatgagtcactgggactgtaggtgtgtaccaccacaccctgttacttttttaaaaattttagttgagatgaggtcttgctatgttacccagactggtctcaagctcctgggctcaagcagtcctcccatctcagcttcccaaagtgccaggattacaggggtgagccaccacacccggccaatctttgcttctttatcttgttttggggaaagtatgatgggacaccctcccaaatcctgattgcttatttaatcattcacttctagaaacatttatgagcatctcctgttattctgcctgctctaggtgctctggggaactgaagggaacaagctcccccatcacagttcctatttaaagctgccagcagccctttgttgccatgagwaaagggccacatccttggctcagttcacaatattctttgaaagatctttttcttttttaccacttccttgtacmccagtaattttagtcttcatagcttctcctcccatactttgcctgtgttcctccctctttcttaagatgtttttcttttcctttgattcttgggggtcatttactcttcaaagatggtgaaatgccaccttctccaggacattctccctgactcacccaagtagggcttctggaacccctttgcgtacatartgatcatcgtgtgttgacattgtggtttacttgtgatgcaccagcactgtcacccggcatgtttctagaagggaaggattcaccctttctcatgttcatattcatgggttgaggatgaggagcaaacacattatttattagcacatagtgaagtgaattgaaacaaaatgaaatatgttgtgcgtgaatatctggtaacatttcaagaatacagttatagttccaaaaaaagcttagataaccattgcttgctagtattgatcaagaaaggagagacaaagtaggcttccacagtcagaggtgttgcttgggccacttttccttccaagcactattggtatctaagcaggcagaggaaagggaggataagtcctgctagccaagtcagctgcctggcacgcacgactgcctttgctgactgagaggacttggctggcctgagagtcgtgtccatctggacagagtgctggtgaccacaggatcctatatagatcccagcagcgttttctgacaggtcaaccatggaaggaccaggtgaaatgaaacatcagcacttttctctctccatttccaatcctatttaggagcctccgttgtttagctagcattcttgatttgatttgcctttaggttaagcccatctctgatgttctgaaatttcattctcttctccttatctggaggtagcactcaagaaagacatgtgtgttgtgtctctctgttgacctccacaccatgtcctgtccatcatatttaggaatcctctgccttttccagttgtggttttttcctcctcactagttttaacaggggctaraacctaagttgtcagtgtgtgcaccacagaggtctgtggcaagaagaatgtgtgtgagtcattggcctgtcattattgtctaygttactttagacacactgaactgctctgaacctcggtttcctcatctgtgaaatatgcccacttttcaaggcaaatttgttgtaaaacagatgtaaagtgtccctctgtgcatagttggtagaaggcrctggaagttgttattgtggaatgcatatagcatggtgaataagccctaggatgtagagcaagacattgctgagcttgattccctgatcttgctacttaatagctctgtggcctgcagaggttaataatactcacttcatagggtttttaggcttaaataaaataacagagagaaccatttcagttaggctccctaagtgagcaaaggctcatttaaacttactcaaaagtggtggttggtgggggattaattccagccacctcctggtgtctctcaaggatgtcttcttttttgtatttatgttttgttctcttcacactcatgctgtacccagacttgcctttgcttgttgcatcttttttctacacctagttgtagtttgtgttccttcagtaaaatttgtgcatggcccatcatggtctcttctctgtcaaattctcttctctagttcaaattcctgasagggtgggatctgactggcccagctcatctttttttcctccagccacatcttgggttgctgggaagcctttgggtcatgctaccttccctggttcagttagctatagctaggagaaaagtgtggccctttggtccagaacctggccacctgatctctgaatttgggcattttgaaggtaagttttgtgatcaacacacgtaatcagacactatatgccaagtcaaagggagctattcatattagtaaattcataytcgtattagtaaaaatcaggtatttctggggatggatctttttctgtttccatgttgtacaaaagcagaaatattctcaacgtaaggggttaagggtaacttttgatttgaggagtgatttctctcttggtccagggcagatctttggttggaatgttgcagaccctggtgcaatgagtcaaaacttccactggtttgcatttttcattagcgcgtcattcaaggaaatcctgtctttagggtcatggaacaggcttttgtgtttatgcttctgctgaagtaaaaaatgtgaagcatttaataatgcatctgaaaataaacttgtatttgaggtctgctctcttagagcttttggggggaattttcaatggagcctattttataaatattttcaaaattctgttataccctttatcccaacatggatcatggaaagtaaggggttyttttagtctaaatattagttaaagacatttgaggagctaggaattccagttwacattcaaaggctactttcttcatacttgataattattttctacctcaagcattcacttgaggagagagtagtgaataaaccttctgtytaacctatctgaaattccacaggttctctctctctctctctctctctctctctctctctctctctytttttttttttttttttttttttgagatggagtctcactgttgcccaggctggagtgcagtggcacaatctcggctcactgcaacctccatcccccgagttcaagctattgtcctgcctcagcctcccaagtagctgggattacaggctcctgccaccgtgcccggctagtttttgtatttttagtagagacagggtttcatgatcttggccaggctggtcttgaactcctgacctcgtgatccacccactttggcctcctaaagtgctgggattacaggtgtgagccaccgcgcccagccggtactcccttttttaatagcactggaaacatgaagacaatgtataaaatacattttttccctcatatgctggttgttagcaagtgaaaaaagtattcatagtttgtattctccatatatttatatattgtctagcagttaagttttatacctgtttaccatattccttttgttcattctgtttattatatatatatgatatgtaggaattgtgaagtagcttggggagaggttcaactgtcagtagtcatagaactaagaacaaaaactaacatagggagggagggagatcccttgactataatcctaactccttcagaatctctccgccccaggtcccttgcccccctccacacaggcttccatgtaggcactcacactatttgcatgaactctcaagattgtattgtgtatcagagttcttactctctgttgactatatgattgcctcagggtacttccacctgaggagttatcagcctctaatttagatgggccagagtgtgtgttaggtatctcttgtatgaggtcttcctggtcatctttactcacaatcaaagatgccctgggtttccctaagcctaccccaagccacttgctcactcatcaccccattcccgtattttccgagcctcccaccaccctacatctcccttctagtccttttcaaacctaccccctggaagtagagttggaatttattgggtggttaagtcatcacattaggtgcaagtagcatataggcagaaatgcccttgaaagttgcttaggaagattccatgatggaggcttacatatctgggtgcttttcccttcagaacattatttattcatttgagcaccaaagtaactggcctgtgtttaggggctatgatgtcatgtgtacacatacatcgccatacacacatatatttaaactggaatcactttcagagtagtgggatccttggaatatgagagagcatgcaggagctgaggggccagcagattccttaatcatctttcacagtctcactggcatggcttcctcacagtggggtctgtgactagtaattgacctctccccacagacgttttttgagaatatataattgaataaatgtggactgcatctctgcgtaaagttgattgaggaatgaaagaccctgggagactttgaaatttcctggaaatacagtgttttatcttgagggggggaaaagcaaatttggttttatgcaccacaatatagtttatgtctgttttaatataaaacttctttctcccaaaaatcttcagtgcctgtgttcatcccgtggctggatgtgccctggtattcctttgtttatactgtagtgtactggctggagagcgcaagtggttcggcacatagagacagaccctggggatcccttcagaggccaaattgatccatgcttttgaggctcatccaccaagtatctgagctgagggacttacttgctagcctgggccagtgctccccacagtctgaaattccagttacatctcaatagagggagaagccacaggagtgggagccacacccagatttagtcctggtgctaacccgtccaagttatgtgaacttaggcaagtcattgaacctctcaggatttcaggttttgcttttttattatttttaatatggcaattagaatatgttacctctaaggtcttaccagctctgttagtcagtaagatgggatgagcttttggctgttaagagaaaagtggctaaaacattgttagcatggaggctgaactgcagtgagtataagagaagagaatggcacagagctcatttatggtctagtagcccaacaatcagagtgcacagtgatttgattggaagagactgtgatggtatagaatacacccctgttgtgaatactctctcaggttttactcagatctattagttcattattatacaccttacattgtaaagatcttatactgtcacagaaataacaagaaacattgggaataactactgaatggaaagaaaaacatagattcttaatgggttttttcccataactggacaatgtataaatgaacaacattgtccttttttgttcttttcaaaaagaataggaagttaacatattctttatccattttccctaaagtttttggaagagagaagagtcacttggcaaggaattttaaaataattttcggtgctgcctatgactgatagataaatgcacttaatttgaaagccttagtatttatttatcctcatgagcattatccacaaaggtacagtttgcttgtcttagaactcttggcctgtatgtgtgaagttcattgaattaaaatctaaccttttatactttctttctcaagtgaagacattgtagaattgcacacactgtcgccccttcctgtccattataagcaactaaaatgtttggaagtcatgtgaggcagtggggcatagctaattagtcagctagcatgacaagataatgatggttcattaggttgggttttaaagaacagcatttctaatttatgccaattttacttgaaatttttgtacagtcataaccagcccacaaagggcacttgttggatcagagccctgctttttttgttgttttgttttgtccatctacaaacttcaaagtcagcaggagagaccttgcatccagggtgatttcagtgtagtctcacaaaagaggcctggcaagggtttaaagtgaattttaagcattttagcatccactttgaggttttcttttcatagaaggaactcgtgagaaataacttgttattagctaaaataaaagrggacagatttaaaaggagtagaaaatagaagattgtttaaagcttgttgggagcaaataaagattttggggaaaatcccaagggaaattctctgatatttagaaatcccaaagcacagaggaagaaaattcagcccatcttagtgagtgagtcatcactttattttctgaaatagaggcagattgttatttctcaaatcagctcaggtcatgaattttgtgaaccgtactctgtggggagattttttttttctttaaagagttctcttcttacccccagccatcaaaaaattaaaataccataagcaaatggacacatgctcctctggaatttatttttggaatcratggggcaaatagggaaaaggccttcctaccacttgccccaaaattggggaggagaggagtagggaaggcataagaaacatgggaatcgaaacaaggacatttccagttttgcagggaagaaatcagcaaatcagtcaaccaccacgtatgttatctatttactgtaagaacccaaaaccattccatttggagtataagagatgtgtgagagacagtcataatttcatggagatacagtctcagaactgataagtactatttgttgagcacctactatgtaccaagcacttgctccatctttgaacctcccattcaccctgtaaaatagtgggatgaagatcctcaatcccaaagggagtaggagacatacccaactcacagagcccttccgaggtagagcctgaatgcagaccaagttatctgggctctcgtctctgttgtttccactacacttacatgaaacaactggaaagtaatgaaggatacactcagtgttttaaaacatccgtgggacttaagggtggaggaagtttagtgaattatcagggtggtctgtgacagcttcacagctagagtgtacatttaacttcttcaaaagaaggcaagggtgaaggtggctgtgttaaatatgccagggcaatgggtgtaaacagggactgtccttgacaaaccatcctgggtcacgtgcagaattcttggaggaggtagactgcaggggatgggctggttgacgattgacttttctcctcaagcatctaaaygtgccctaacgtcttccattatggagctggggccaggtgtcagcaaactggttcagtggcagctggagaacctaaaaaggcattgtgggcctctgtaggcccactgactgttgttgctggaaaaaggtgagttcagatcaaccagggccttctataggaaaagctgatcttttaaatttttattttaaatatcccaagttttgaaatgtttgtacactaatacacaaatttacaaaagatattatacaggccatgtaaaacacccatggcaggttgaatttggatttggggccccacatttgcaatctcttctttaacagatttgctagaatattgtggttcaagtgcatataactaacatgttacatggagaactacttctgagattagtaggcacttctaaaaaataatggggggggggtgctcttgagtccaaatcagtttagaaaatattgtgttaaagaaacattttttaaaaaacagaaatgtaatgaattttagtatattaatgctttttgaattttcgaaaggagatacagcttggagtatttcccaaatttaccgactrtagatccctttttttcgcaacagcattaattgggctagttgggcacagattttgagaaatactgatctcaatgaatattactcaaatttaagtattttctaaatatgtcaaaatttctaaatcctgttttttttaaccagacctataaaacagaagcttatgaagtgaaatattctttatgaagtactgtgcctaataccagatcctccagagtagtgctttgtgaaacattagccaaactatgtaaataaatgtagttggattgtgactggttttgaactacttgtttgttcttagtggaccttgtcattggatattggggraactgcttgctcatttttgagaagtagagtaatttggtgaatctctgggttgtgtagatagtaaaatgttgcttgacattctattaagtagtaccataatgactggattgtatttttaaagaaataaaagatttacttgggggtgtatattatagttactgctctgggcccacacaggctccaaagacataccctctaaatatgtgactttactgtattatcagcgtggacatttggaaaacagttayattagtttttataaaattatgggttataagaaggtacattgatatagtgtgggaaattttaaaaaagggaagaaatgatgcttctttaccacctttagcactccagctccattttttaaatgttgggattggaaatggaaacacacttcttaaatcatcgatatccctttaattttactcccagcggtatattaaataaaactttcaaaggaaatttgtcccctccctttatagtataactcaatccacaaaatgtaatttaataaaagcttatatatatataaggatatatatatatatatatatatatatatatatatatatatatawgaatgtgtatattcaggaagaagattttgaattttctttatccttcctgacttcaagctatatttttctttaaatatgttctaaaatttactacatacttagcttctaagtgaatacatttttgccctggaaattttatctccaaggcaaaaatactagagggaagcattcgtgttttaaaatattttgtatctagccacctaataagtgggattgaggtaacctatcacagtccccaaggtcaagattatctctgtatttctcaactcttgaatattgtgccaaatgaatgaattcagagtggtgatggaagttcccccaccgccccccaccccccagatcctctgcagatgtattccccgttcaagtaagcttggtataccagaagtctgaatgtatgagctagggacaagggagactgaccatttgctttacaaaagtactcattctcctaaaacaaaaaacctgaggaaaacatctctgaagtgttagtgtgcatcttcaaggaaaaaggtttaatttatagaaaacttcatcaactcttgcgaacaggaagatttatgtttacggaaacaatacctagtggaacataatgttcattagtgcttcagggcaaaggttggtacctcatccctgtcttcctcaagttaatattgaatcgttaggtccctgggtctgtgaacattctctcactctcttcctaataagatattctgtctgaattggccgtcctgagggagctttgtttgaaagggtgcatgttaagaaccagctgttctgtgtgtgtgggaggagtgggtgttgggagcaggggtccatattagccattggacccttttaagataccttcactttgagttaaccatatcctaaattgcactcacatgtaatttgcaagaggattagttagatttttgtgacatttctggtatgtgaccatctttttagaagtcaaaaacttaagcaagactttttgtcagtgttgcgacttagggacataaattattagtatctgaaaaaatactattcgtgtttgctgataattcataatcatatttttaaacacacacaacttaaaattatttttcataaaagcaactttttgttatttgacattcatcctgaaaattaggcttttataatcagtaccattaatgaaagtggaaaaactgaccattaagctaatttttgacaggagtgaataggagacagatgatctatcagagtgatacaatgctatgcaactgctgaagtagccatgcacatgcaggaaaaaaaatatgcaaaggttatttgcagtttaatattaagtgaaaaaagcagaatacaggttgcacataaaacatttattaggtacrtagagaaaatgtacatgaacaagttaggaagccaacaaaaaagaaaatagcgttttagagtggtagagttctggctaaagtttaagctttttgtctttagtttgctgggtattgtgttcaaaacaaaaaggaacttgtcttggagtttttctttttgccagtaccaggtgtcctaagtgccttgtgataagtaggaaacagacttaggggtgaaatatatatatttttatttgcttttagcaatataaatatctttaagattatgggagatctgtgaacagaataattttttaaaaactgaattttgatttgggagatgactttcgagacatttattacttatgtggaaagtcacttagtctctctagagagccttaattttcccagaaagggaagatggggataatattttggcagttggggaaatcagaagcacagtggtaaaaatggcaagatataaggtattattttgtttttgaataatggtaatatcatttgatgccatcctgtgttctaagtttaaagttgttagattggttkttgctacttaagaaaaactcattcagagagttaggaaggaaaaaccaatagcttgaaaacctgtgtaccattttaagagttacttgatgtttggtaacttctctttacaaattgaagccttagataaaagtactgatttagctaaaaagtccttgatttagcactgtttacataagggtcataatttacagactatttgctgaaaggggaccttttgagttgaattttattatttttattttgtttaatgtctggtgctttttatcttctaatcttttaatgtatttgtttgcaattttggggtaaaacttttttatcagtactttttctttgaagttttaactataaatttgcctttttaatgaatgtgtgaagttatactgtggttcatgccgcagctatcatttatgcaagtcttactttgaattagtaccataacagaccactgtatgattacttctcaccatttgagtttcccttcttgttttatactagtcacattcttgttttaagtgccgtgaattttaacaatgcactttttacaatgctctttcctgaatttattaattaaataaaagcatctaaaatatatttaaaaagaaaaacccactggaatccttggcagtggcctttaaacatcaggcagtgttgttgctgtctctttgtacagacaatagatagctcctgcgctgcatttttgtcacattttactccacctttcctgtaatgcttataagcatggatggcagtcagtaaatacatgttgaattattctgtatgtataggaccaagacgttttattgtcataggttttttttggagatgaagtttcactcttgttgcccaaactggagtgcaatggtgtgacctcagctcaccgaaagctccacctcctgggttcaagcgattctcatggctcagcctcctgagtagctgggattacaggctcccaccgccacggctggctaatttttatatttttagtagagacggggtttcaccatgttggccaggctcgtcattgtcataattttttaccagaaatatttaagaaaaagtaaaatcttaacttccttaatagcagtggtgcccaaacttttgtacatctcatttgtaaagctttttgagcgtgcatttcgtcttcatctatatacatgtacatacatacctattttctgttctaatgccatataattatacaaaataaaaatggcagacggaagttacagtatttttcttcccacaccacagtagaccgacttgtgtgctgtcttctaggagatcactaatctaaagagcttgttcaatggaaggctttgtatctacatctcccttttcttttccttctatagtagcaccaccattcacataaaatttgttcttgctaactatgtatctgttgggaactttggggaaaaaaatcaaagcgtatgcatctgcaaattctagctaacatttattgagggtttgctctcttccaagtaccattctaaggcactttatatggatttcttcacttaatccttataactctatgagattaattactataaatttccctgttttatagagggaggaaactgaggcacagccsggttaagtttctggcccaggtcatgtaagtagtggagctaggatttgaccacaggcggtttggctctagattttgtgttccaaaccatgttatttaaattccagcatctrgttggtagctatgtgattctccatctcagacaaaaattgtgtaactaagcctgaatgactgtgagccatgcatagcatattttgaatcatttaggtcaagacccagacaaataggtttattaggacattataggatcttagaactggtgggaagctaaaaggctyggtggtttccaaactgttccaatctgttgtcttttgaagtaggatcctgtaagttcttactgtcctgaaaagatgtgactcaggaaacttctttccagtctgggttttaattcttttaaggaactctcactgtgttgtaacatggaagtggtgttttcatgagtatttttttggtctttaaataccttgttgtacctrtaattattattttcccaagaatgggactgaaattgcatcaagatgaacaagccatggtgcttgtgggtgggtgtgctaactccgaactttaaaactacaacagaaattagaggttcacaaggtaattgctgtgattacagttttcttttgggccccagacaggagctcttgaaacacaatattctactaattttttaaatgtacagttcacaaggcaacatggagattactgagagtatgtaccatttctgccttgttttctatgaaagttaacatattgttgggtcctttgaaattgctcaggaaaaagcaggcattgcatgtattataagacactgttaagaggattaaaaatattttaagtactgaatcaatcttttaatattgtataaggaaattattttaaaagaaaaaattttcttaattacaacatagcacagctgttaaacatctgtaggtacctctctgcactttacagttctagataatttacattattataatacatgtaacttgatgttctaaattatgatattttatgatatctgcacatatgtattagacaataaatgatagacctttgtccattctaatttgttccatacataatttttagtaaccatagagtccttcctatttctattttattttagtttaccattttactgttgttggatttaggttacttctaactttctataaaacactgctaatgatgatttagaacatttgataatacacatcctttattattgaggaaatggcaacagttgttttgaaaggaattatcaggactggatttactatgtcaaatgtaagggtggttttgtgacttgaaatataatttgtcttctgtatggtttgtggccatttctccaaagcctctccattcaccaaatttcttttttctatttcttacagctttagaaggataaaaaatgcattttattattgttccatgtggaattttaaacttatcagtgcaaytgaaattacttgcatatgtttgctattttcggtttcttgtgttaatgttttttgtccctctgttcttctgggtctttatagcagcaacataagaattctacatcctaagtatgtattagagatgtcaacttcgatatgtctaatgcatgatttttgttgtatttttccctcttagttcttttgtcttggttttgtttgttctataaaaattgattacaattatttatctttttgctgatagtatctgttgttgacatcagaaaattgtcagacctctttagctgatgtacatagtatatttttttgaggcctaactttgttcagttttttaaaattaatttattatttatgtatttatttatttattttaagacagagtctcactctatcgcccaggcttgagagcagtggctctacctcatctcacttcagcctcctccccccaggttcaagcacttctcctgcctcagcctcccgactagctgggattacaagtgcccatcaccacatcgggctaatttttgtatttttagtagaaatgcggtttcgctatgttggccaggctggtcttgaactcctgacctcaagtgatccacctacctcagcctcccagagagctgagattataggcgtgagccatcacgcctggcccattttaaaaaatttagtgttctatattggtgttccaaaaaacattgttctgcaggtgtgcaaaaataaaaacaaaactaggtattctgattgtaattagttatttaattatttactttatctttgttgggaattgttggagtatagagttaaacatgtttctttaaaacattccagtctttgatagcctgacgtgcattcagtatctccaggaaaaagatatcgttagaatgtagtattttccaaatttaccattttacaaatggtaaacagattaattgttttctccagaatactttccagcatctctcagaaacagttttctacaaatcacagggtaggaactgctggtttaattcatttggatttttttttaactccatcagttttttttatgagaagcaattcttcagttttagtaatcatctttatgcaaatgtatagcccgggcttcttggtctcctctgccaaattaggtctttctctccttattaaaaaataaaacaaaacaaaacccacaatgaccagatctgtggttggcagctctgaggtttgttttgatgaataaacaattgggtctaaactcataattgaagtggagaagtcaccaatggcttaccacttgtattcccttcaaacttctgttctcagaaactaggaacatgaagcaactatagtaagcttagcatgcgccatacttggacgtgacaaaaagtagaataaaacatgttttttagttggagaagcagtcagacatggcagaaagcacagactttggagttaagctttccagggttaaaatcctgatttttccrtttactagttttttggccctggatccctactttctgacttaatttcttcatctccaaaaaggcattattaatgcatgtcttcttagattgatgaagtctttgagtagtaaattcaaggtagacttttcagaatatctcttggaggtcagaggatgcaaaatagggacaccgaaatggctggaattagaatctgagcctgacactatggcctatctttttaattgcatggaaatcttgaatatcagatactttcccaaatatatttccatgttgatgctatttgtgttacttttttttaaattaaaatttctttcatttaaaaggaaatctagcatgctaagagagaagaataatgttcctaggatttgaaaatacgtgattttcagaaatcagagccagaagagactgcagattggtgtagtcttgcacatttgcaggtcaggaagctgagaaccagagacatctgaggggcagtcaaatttagatggtaggttccagtttctgtacactgggcacatctagatcttctcctacaccctggggtgcagggccagcaagatggctctacaactgggaggaartaatatataaataaacacatacatatgtgtgtctggtatcttaaaagattaataactgttctttgtcaagataaaaatgtgaggaaaatgtcattataacctggcaggtgctctcatagcactagtgaatgaagagagattatttcttaattggggaaggggggcagtgaaactttcttattgggtgataaaacccaatctgaaaggttgaacaagagtttgtaaaattgttaagaagatgatggaraaaatggtgagaggcagaagtattgttcagaaaagagaaaattttagctactagaattagcatctccagagtcataaaggccagaaaggagcctggcrtgttaggacatcatgaacttggagaaccaggaatataaagtggacagtcacagtgacaagggtgggttggctgcaaaggcgagtctgtgaaagtagattgaggtgaggcagagaagggctttatgagccatggttgggggttccacttgattctgttttaaagtcagagrgtggcatgactagacatatttaraaacactctgcaatggtgcggaagatggatgggtggaggatgaactgctagaggctgtggaagtacctggctggggcatgattaagtcctaaagtaagacaggagcccttggaatgggtttcagtaatgctgcagaataacctgacatagaggcacacacttgtagtcccagctgctctggaagctgaggcaggaggatcccttgagcccaagggttcgaatctagcctattaacatagtgagacccctgtttctaaaaaatagaaagcaacaaaaaagaaatgctgctgagattgaattggcagaattttgtggcctcttgggaaaagggttaaacaagaggaatgtgactttggtgtccgggtgaacatctttgtgccatcactgtggtactaaatagacatggaggaggaagagaagatttggaggaagccttgagtttggggtgtggtcccagaggaggaagtggattgaaccacaacagaaatacttcagataagtgttgtgatgtaatacccagcttgtctcctccctttccagtcttgcccctttaccttccatttccaccacaacagccagagtcatttttctcaaggtcagagctaatcacgtctttgttctaaaaccctagaggctccatcttggccaaactacggcctccagaatacaatccagtctccttaccatggccctttcctccctgtgtgatgggtcccagtgtatctcttcatccctcctgtggccacttgtttcaggcatctgatctccctgatgcttcttaacaacaagggcctgttttctcagaatgttggcatgcacgtggttgttctctgtctactccaccttgaagaagagaacattcttgtcttcaccaggtatccccacacctagaacagacttgatgcctggaggtacaggtctttgtagatgtaggagccgtatctgcctgttcattccgcactcccccctccaacccccccggcacccgccacattcctcagcacagactgaatgcttgagtgacctctcaatgggccagagttaggattagaaataccaggtagataaactattcctctttgataagtaagctcctattttctttcctgatgccacagataggcccactaattcttttcaaggatttttctaccaatcagtcactctcagtggtgtttttcagtaagtcaccagtattttaaagggcacctggaagctttcacaagcctgtgcatctccacgtggtgttgtggttggttatttatattaagcctattttctgtrtgcaggtacacatgccagcgatcagttttagtgaaaatgatgctcattgtcaagactagttttcaatttgtgaagtccacaaaagctgtggttcccagggtgtgcctgaagctaagtggaaagcccctctgtggttttaactgacactcactatgctgagcaaagtatttagcagatagacctatgtgaaatggctgatgtgcagctcacgtctgacctgcttgggtggcacaaccccagtgacctgcaagttgactccttcccactttgctttttatctcaactactctttagctgttttacatagagcctsctggaatgggaagaaaaaggtctttgaaactgattgtctagtggcctgatgactgaatccttgttgttgtttttttttaagggtcctccatcttttgaaccccattgtgtcaggttgaagggttggagwgcaacatggttatgaatatagaccttgagatcaggaagacctgctttggaatcctggctctcttattagctgcatatcttagggccatkctgatgttcaattttcttatctgtcaaacataggtaatagaaaccttcttataagttactgtgttgattatataagatgatataagattaatggcaatgtcacattgtcattttatcatcatcaatactggggagaaaagagacaagaatgaaccaaaatcagactctgaggmccattggggaaaggaggaaaagaagcaaacacatgtctgtgccaggtattatatgagaaaggtgttaacagtacctttagtatcagagagagtgactaacttgaccagggtcacacagtcagtgtgtggtagccaagcagtgacacaggtctctatgacctcaaagcttgtgtttgtagccgtggctttacacctctcaagatggtagcttgccgcgtgataggctatgtttcttccaagaggcaaaggttggacctcttaacaaatggtagttgatttctggaacattaatggtcacttagaactgtgggtactcataktaacttagtgccagatggtgtgggaccatcaaggattctactgattaggtgcagagaatgagcatcccagagaaaagcaaaacttagcttagccctcagaggtgggttgagttctctttacagaatgtatggaatggctgtagttgtttaggatgacaggtttgattttaagggttgtattagtttgttttcacactggtataaagaactacctgatattgggtaatttataaagaaaagacgtttaattgactcacagttccgcgtggctggggaagcctcaggaaacttactgtcatggcagaaggcaaagacgaagcaagcaccttcttcacaaggccgctggagagagagagagtggaagcaccgtactttttaaccatcagatcttgtgagaactcactcactattatgataacagaatgggggaaaccacccccatgatccagtcacctcccaccaggccccttccctgacatgtggggattacagttcaacatgagatttgagtggggacacagagccaaaccatatcaagggttttgaaggggatctgttttcctttctctgtacacattgctgaattctgccattggtacaaaagrcagagtggtttaatgaaaaggttgttgatatgataggaggcccatacttcactcatctcccttcactcatctagtctctctcggagtctgcttttcccatgggggggcgaaggggagggaggtaggcaggcccttcaccgcaaatggcttccttttgcccgtgttacatgtaggactttgtaagacttcctttacaactckcagtgattaattgagaggagtgtgcttcatccaggtcgtaagccctcataaatgattataaaatgatttcattattgatacgtgatgtgactgacttttgaaaggcaagatgaggcttgggaaccactgtarcctccaagagtcccggggcgattagatagtgaatatttttacgtgtgctacccaaacaaaaaatatgtgttgcaatatttaccttagttaagatggtgcttcctttaagtgattgtaataaacactaaggcattaaaacaaatagtacatgagaaatagcagcattattgagttccagttttcttctgtacagctttaattcttgatgcttttaatatagaggcagatttatttgacagatatttattgagccctactctgggcctaacataggccctgccctcaaaacgtatacacacctaacagataatttatgcctacgtaggagagcagacttttgcgagctagttttatgcagtaccttttctttggcttgggaagttgatagcttggtggtgttttcttgsatggactaaatccttagaattgtttaggagatattggtcgaaggtgstatgttaaatttttgccaaggatctgaactgtgaagtaacttgtcaagtggggcccaaacctttcaaagtttaggatttacagatctttcctgttctttggtcaaattccagctgagaaccatgcagccattaagctgtaggcaccgtagaagacgttaaatgtttctgacagaaatctttataagcacaggagaatcttaaggacactttttatagtctaaaacagcacagataaacatcttaaaacctttatttgcagataacataccaactttcaattttggggctgtgttatgcaaatcaaattttattttaggttggtcatttccccttcatggcagcctcaatcaactcatattaatcttgaaactaacatgataacatctttacctcttcctttcatataagctgcggctgccaggtccctcttcctctgttggcaagtattctgcactgctgcttcctggttgaaccccactaactgtgggtgttgttacacaggatgattcttagcactccacacctcaactcctcaaactgctgtaattggagttcctatttctgttctgcttctctctgcctcaacttgtctttcctgtctgcacccttactcccattccttcctggcttgttccaagaggagtgtcagatagaatgccatgggcgtcttctcctccaggattgcagggrttaaagatggagatgacctaggacagcacctggcccacaggggacactcttagttagctcccttcttctctgcttaattactttccaaccttctttttgttatccctggaaccccgtgaaacttaactttgctcttccaaaggtgtgccatacagacaggctatgtttcactcgcttctgtatctttatagcctaacccctagccattgcttagtaaatgtttgctgggtggatgagtgcatagaaagataattctagtgaggggaaatgatgagacatattttcagactagttaggttttaatttcatttgtggccactccacttaccctttcagatgaggagatagagctgctttggaagggtttattgtacccacrtggtcattttggattcttgcacagtctccaggaatgggcattcttgttttaatttcaagtaatcaggagattccgggaccatctgttcactagtataggagagggcaaggcaacaaggagttcatattcacatagtactcaggccagtttaactgaaaccaccaacaggtcctcaaatgtcagacacagacataagagagatattcattctttcaccttccatttgtttgcttgttcattcagtcagcttccactgagtgctctaataggtctgataccrtgctacctgttggggccttttagtctggatctgaagattacaacagggtgatctatacacccttgattcggccctccagccagatcagtgactaacacaagtctttaaaatgaatttaataggtcatcacctgtgaaaagaagggaaagtaaaaaaaataatagatatttactgcacatctcctattgttttcagtgctggtgacattgccatgaacaggatagcaccaccttctttgagagattacattctattgggacagatcataaacgcaggagcataacaataagatcatttcagagagtgttagttcttcctaggaagtaagagagggtaatgaatggacagtgactgggagttggaccatcagaatgtccttgtgagatggcatttgacctgaatggcagaaaaaaagagagaaggtacaagctaggcccgtttagatttaggcgaagagagttttaagaaaaagatttcaggagagaggtcagcaattctaaaagctttaaggcaggactagctcattggggttagaaagactgtaggtgtggctggaacataatragtagtggagggtgtgggaacagaggggagagggcagaaggctgggtcacgtagggccttgcaggcagtagcgaggacttagttttattggaagaacagtgaattctttcatctttcctttcttcctccaaagagagagagagtgtgtatgtgttcattcctttcattcatgtcagtgaatccttacaaagcatcttctatgtgaagaaataaacatgaatattatcctggtattattcttacggagtttttagttgatggagtacagggagagacgcaggtacttaaacatctaaaaaataaggtagagtggaatgatgtgagaagtatggataaagcaagccccaggttagcaataatgaatgttttatgaacaacttactttatcaatcttatcagaagccttaccaggcttcccatttcttctagcaaagggttttgctgctgctgctttgctgtggcaagaagtgaggaggcctgcagctggttaaggagaggtagatgcacaatttggttttcacactttggctggtgcctgttgaagcgtctagcacactgagtggatgaataagtgcctaaatgatgtaaaaacccaagtttgatgatcrtcagaaaaaatctcagagaaattggttccaggatccccacagataccaaaatctatgcacatgcaagtcccacagttggcctgtggaacccacaggtatggaaggtcaacagcacacatttgcgtggtttgcctatatctttcccctttttgaggaggagacagtgacaattcttcattgtcaattctttcttctggcacctttatccacaactctactcatgatcacattggacagtgtgaatgaatgcatagaaagagcttatgccttcacattatgattattcacgtatatgttctagcatatggagatttacaatgggtaaataatttactgatttggctgtgaggctgcatgagaacttatgtcactttttcatcctcttatgcaagtgttaattaggcatccctaaacacattgctcttcaatcctcactcctcccatcaaggtagcatgattgcccaacaagctcaaggctgaagtaatcagagtctaaaccaaaattaggccaaagtagcattcccttgcttcccctattaaaggaataacacatataagaacatttgccttgtggcgattatgggacaaatgcatccattaaaaagcattttttaaatgacctctctgaatatactataaagcaatacaatggaagccctttttttttccaagtgagttaaaaaaaaaaaaaagttgttttttttttttttttttttttaaggaaatcactttggtataggagtatttgtttcagaggtgttttgctgtcactgctccaagtgtttcactggcaactgccttctgaggtgagagtaatgatagctggtcatttttgagcacctgctccattcaagactttgtgctagccacttctaggcacattaatgtattgaatgctcagagcactcctagatggtaggtataattccctgctaccttggcatatctctaggaagttctatgctaatattttattgttatgtactatttcctgcctctgtaaacataaaatttagctccaaagagttgtggttattgtctaaaatctaatctacccaaaataaaagcaattttcccacttgagtatatagaaagtgccatagatttagaaagtaattctaaaatagaaagtcttaatgaatagtggcaacagtattgccattgctcagttagcataaatatatttcaataaaatatttttaaagaaagttcacagaataactatttgaaggcaatgtcctgttaagacattattctcatgactgtatagtcatatctcttctacatatatggctatacatattagatatgtatacctttaaactttattcaaaaccattaggggaagaattacagaggaccatgttttctgaatctagaactattttgtcaaccattttcaaagcaagtcttatgttgcctacttctctgttttgtggagatgattatactgatgagtttatgtattcagtcatttgtcgcttcatttcataagcatttttgagcatctactgtgtgctagacactaggactaggaactcagccatgaacaggttatacaagcccctgctttcatagaacttccattcttctagtagagagaaaaataccgtaaaagcaaacaaatcatgaacaggatcatttcaggatgtggtaacactatggaaaaactggcatgacgtgcatttgagagtaacccttgggtgggccgagggtatacactgctgtagggtatccttagaaggcttttgtggggaaaggactcttaatccgaggcttgtgtaagaagaaagagccagtcatccagagagctttggggaagagttctaggcagagcaatcaactagttcaaatgtcctgagcaggcatggtcagattcatacgcgtctctgagaacatctgctcttacactctgctgtgactgagggataccactcggcctggagaggtatgctaccctccttgtcctcaaagtctcaaggacttttctgtccttatggtctggtttgtataatttttctacatccttttggctgtcagctctcatgtagtgcctctgtcagtatggcttcctagcagcctctctctgatttgcagcagcctgcatcttctctgggcctagattcaaatgacaaaacttgttaggactatgtgtgaaataaaagtaaaaagtcttcgtatcaaggttggaagtgctctcctagactaccatccctgatccttagttatgtaatgttaaagagaatgtaataatgccgtatggcacaactttacattctcctgtattcatttatttgttaattcattctttccccctcaccccactcttttgagttgtccaactgcggatacatacttagaaatgcccgcacacgttttatcatacttctaatgatttgggaaagataatcttatagcctatattatctaccatttttctcttagcccttatttaattttacatataygacatttcagaggatgtcactgcagttgttgtttggcatttatgggaataaaactttgtagcacayttagacttgtattatttctagagggagccttgtttgattgaaggacagtatcccctgtctctctaaaacatgaggctcttaaaagtgcattttatttagcttatttttgccagtggccaaacactcaagcttaaaaaaaaagaagtgtcacctagacttacctgactgtagctgtcaaatgaggatgctttcaataaactttaaaagtaagtagatgaactttacaccctaccagttcataggcaagttggtaaacattgaacagaaattctgagactgtacccgctcccccccacaaaaggaagtaggtagatggtctcaaaaaatgttatggctgaaatctttcacattcatttgctcatttggagttaactgtaaagtccacttagtaatttctgttagactacagccatccttttttagtcattattcccccaaagataaccgataggttattctcctccagaagcagatctttgtttctttcttgaaaataattaagaaatgttgattcaggggaaacttggacttgccttccacaacagattagatggcatggttgaaaaagcataggctggctcttctcttacttagtatgtgacacttggcaagctaactaatttctctaaggcccaaggtttttcatcagggaaaaagggcaatcataagtatggaaaaaaattaatgactatttttagcattttaaaacaatgacatcacaaaaacagttcatctaagaataaacccattggattcagtcttttaagtaaatgcttatttgcatcatgttctttccctcctgctcttagcaatctaaatgtcttatatatttttaaaactcaggtttatctcaaaactggtatatagtcgtcacctcccccatatgatgagactgtttttagtttcagcctatcgcggatatcattagaatgcagaattaggtagtggttagaagataaggctctgtgttgtcaaagacctgggttcaaattccagctcagccaccctggacaagttaacctttctaagccaagcctctgtttcctcatccataaaatggatataataagaatatttatttcacaggacttttgtgagaattaagtgagataatctctgtaaacctcttagcatgctttctggtttataccaagtatatgttaaatattagttatcttccctctttcctctacaatgcaaatcttaaatcttttcagtaatacaaaatttatctcttccctgaaatgtctcataaaacattcccttaagcatgacatgcagcatgacaggtatgtgagatgacttgagatcctaagcggaggagcattttgtataggtagaggtacattgtaattttcaaagtgtcttctatcaatggtaagtgatcctggtttttcatttattgtaactctttacaatacagttatttaaatttttttaaaaagatacaagagtatttaaaggaagatattgaacagaagtacaggtaggcagtggatgtgataagatatggagttagaatgtaggtgatgggtatggtggaaatcgtgttagacttgcagtctggaaaccctgttttttgtctcagcatcccagtaaagaaagcatacactttgggatttggtagatataagtgtagaatgtgacattagcattttctggctctgtgaccttgggaaagttacttaacctttctcaccttgcctttctataaatatttattgaaggtctactacatttccttatctgaaaaatgaagatgatccttaacaggtttctgtaaagatgcaatgcaaagagataaaatatttgaaagtgtatatatcttatataattgatatgttttataaatataataagttttatacctgatgtctagtaagtgctcagtaaatgttagttctagtgttacttaggacctgtggttgcaagtgacagaattccaagctcaactggcttgggacagaaggaatttgttgtctcgtgtactcagactgtaggaaggttaacagtgacatatgccttgggaacagctggaagcaaaaactcagatgccagaggagtgtctctacctcttttctctgttactgtgtctctgttaatgtcattttgtctggccagatttttcctcacatcaagaaacagaaccactggcagtcttaagctgatgtgaccagaaagcgactgagcattgtggtccttgtttccaagcccagaaatccgaggaatgacgttgagtccagtatgagtctggtgctcacctggccagacactggggtctagagaacaagaggtgaaggaaggtggtaggaaagaccattttccataaggggaattgtaggtgcctgctaccattgcatttatccctttcggcttcttcagggaagtacttagcctctgtgggcttcagttttctggtctgaagttctgaggtttagatgatgtaatggatgtgagtgtacatttaatgttttaaatttttatttatgcagtttattactgttattgctcatgccttccaaatcttgacatatcatctaggggttcccaagcagaccagaggcccttgaagtagcagaaaggggcctaaaattgttttaacaagttagtccagtgtgccaagtatattgactatgccccattttaaacttgtttttggagtgtgatacacatacagaaaggagtacatagcctaaacgcacaatttgctgaattttaacaaactaaacacaatggtatatcctgtacctggattaagaatcaacaacaatagactcctagaagcccccctgcttataccacaggtagattaatgtgttgattcatcatccaagaaatcatttaaaagcattaccagcatcatgatggcattttccaacctgtttttttaaattaaaagattgccaaaattcaactgccrtatgtcataactaatttttttttttaacactaaaagaaatckcaaaacttaaaagcactgtgaaaagctcttcaggtcattcctactcattataccccttgaaatgtttttctggctaaaattaccatttaggtgataaagtgtgtcctgttgcctgggtattgtgccattcatgtctatgcttgccttttctccttaccagattgtaartgcatgaaagaatccaagccttaagatttcttcagtgtcttgtactgtctttcttgtgcatagcttagcatgataattgactgactaaaatgctatccatttcacacactgagctttgtggaatgactgcacttctccggaaaatataactactcagatcccagggacttccagtctgatatgattcattgttaatgaatatgtcagtttgctgttgctttggtactcaggaaaacaaatgcaattacaaatgaatttttcttattatttttttaatttaccaaatcttctaatatcttttcccccttttttctcttttaggctctagaccaagatagaacagcccttcagaaagtgaagaagtctgtaaaagcaatatataattctggtcaaggtaagcacttactaaaaatgaggtaacatgaattataaataatgtctacagagttttgttagttatttaaaagatgttaagtttataggaaacttgacacaaatggaaaagtaagtaggtaaaagaaatttctctttttttctcttatctcgactgtcagcccaaacctattagtgtttccaaaacagaaagaagaaaagcattagtcacagtggattttactgtacacttaagtgcttaatagagttatgagtaaatttgtcacaagtaacatgagatagataaaatctctgtgtgaatttggtcaacctgtaactcagtggcttcagttaaacacatcagaatcttttcccttcttcagtgtacctgtacacatttgaaaatcaatattggcgatggttgtggaaaaagttagagaggagggggcaaagttaaattcagacctcaacagacctgtgaactatcatcttttcttttgttggaaggtgtgccagataacctgtgtaactaaatgttttaactgtctagtgactttgtcaccttggaggcaaaagtatgtcatcagtgaataagaggaaacaaactaaattaaaaaaaaaaaaatgagtaaccacaaaaaatggtaggctccagcactgtagaagagaagcttggaaacataaaatggatttcagagtttctcactcacatcttttgttactattgcagtaccagctcacctaccaataggttacttctctaggaaatcagtggtctgtaacttaacagaaaacctggaagggaaggcagcagactataatagaaagagcrcaggccgtgaagttggacagatrtgggctttcgtccttgctaatccacttcttattagcaaggtgaccttgagctggttatttctccttcttgagcctccatttttcttctgtaacgtgaggatagtggtattwaaaaaagttgttgaagggatttaatgatctcatatctgtaaagggtctgccaggttatgggagttcagtaaatgcatgttcctcttaattttatcatcatgaaattattgagctgaatggaacctgaacaagccaaaaccctcaggtactttatggccttcccgtctcatcagagctgggaatccctagccaaatgaaactggaaacctaatattctcttgttttttaaacccccctaggccttgagacattctgtaatattaattgttaacacattttgcaccctggtgccttcattttgctccctaatttctttatatccactaacttctcattaaggtagataactaatagtcatgtagttatgaccaaatgttgttttaggtcttggcctaagttatatacctaatttataactcctgccctttcgcttttatttcaatgaactcccacactgtggtaggcccttatgtttgatactagctctttggggaggtgagtgaaataaataactaggagatgccacaaagtgggcttctaaggtgctgatattgttgtttcttgatgttagtggtggttacatggtaaagttcactttttgataattcatcagatgctgaacttaggatttatgtacttttctgtaggtatgtatattatataccaataaaaatatatttaaagtattatatacaaggaggttcactgaagccttgattgygatttggaagagcagaaaataaaagggatttattaaataaaccatagtatacatataatagactactacacacccctttgaaaaagagagaaactcaagtagtctaggtctgagtttgaatcctagctttgttatacttgttcaagtcaagtatattatttaacttccaggagtcttacatttccttaccataaatttaaaaaataatatctaatgtgcaggggattgtatggacaaaaggagagaccatctaaggcccctaatacactgcctgccacatagtaggtgcytaacaaatggtagatgggggaaaaggacagctagatgaattcttgagtgccttctctattttaattcagtgattccacatacaacatttgaccagcctgattttataaagagcttaatgagaaccattgtttgtctcaggaagaatggtcagttctctgtaatgtgatgatggtttgtacctgaggctctrtgcttgtgagctgcaaaagggagacccttgctttacagccacgaggtgctgctgtatttaccgtgctgagggctccctccatgtgactcttttccaaatgttccccctcaagatgcatttcatcccttggccacaatgaccacatcactcagcagctcatacaaaggctcctctactgggggatatgcttcttcctgttctttaaaggatttccttgatcacagctgccatgggtatgacagaagggagagattgttcctgtatggatgtaaagaggtgagagttcaagggctgtatgcagagtttgggtgcagcctcctccagtagactgcaccctctttgtggatgggggtggtacagcttattgaacattgaatctctccagtctggattaggggttctgtgtgccctcctcctaggtttgtactattagagtagcctctggtgagatatggttttaaattttaaatgaattaaaataaaatttaaaattcagttcctcagttttagccacatttcaagaacttaacagccgtatatgactagtgggtgccatattggatagtgcagaaatagaaacttctccatcatcacaggaagtcctgttagactgatactgtaggagaacatgtatcccattgtattgcaattactaaccatctctcttggagtagataatgattcttacctttgttgattaggatcacctgaagaactcttaaaaacaaaaacaggaatctctcagacccttaccctcgaattgttccagagtagagcctagctattgagattaaaaaaatattattccccagctgattctaacttgcagccaaaattaagaactgttgcactggcctatgagttttttgataagactagtactatgtttttcgtttttgtagtttatgcatttgtcaatgtaatttgtttgtttgaaaagatatttattgagcacctattatattctcctgttctgggtgttaggtgtttggcacatcaaagtctctgccttcatgaattttacaatccagtaggggagagataaatgttaatcagatcatcaaactgggaagtatttataactagaaactaggaagcgctataaaagaaagcttacaaagtgcaaagggtgaaataggaagaaggatctgaggtagcgtgaggaaggtgctaagggagtaccacttggaggaaatgatattcattttgtatttatactgtactaggctaagccaaacaagccaataaggtaagtaccattgttctcattttatagatgatgaaactgaagcttagagagacagaataacttgttcagggtaccatacctagcaaataatggaaagagagcccagctgaccccagctttgctctttacaggtactctgtatttgtcttctacctaacacatggtaggggctcaacaagggttgartgaatcgctacatgttggctggatgtgttactacctgggaagctctctgagaccagctattaatattcactaatcatgaatattcatgaatggatccatcaaatggaaaatcccagcattrtaacctgtgggatgactttggtgtttcccagatgagaccaccaatagtagtttccatggtcatgtctcabaaatatagggacaaactcagatccctctgggttcctcacagactattgaggcctgatagggtttctgcagtcacgaacaagtatagtatagctgggtttgtgggcagcactatgacatttaattctttaaaaatgactaaatgagtaaaacagtggtgttgcatagctttccatgatacatgctcagtggaatccaagctgttcccctccaagggcttttggcctcatccagagaaaccacaagaagctgaaccctgctatctgtttcccaatgcattttcataattttcttgttttctcacaawgcttaagtgatacaaaacccatgtgatattttttaaacatttaaaaaggatttctatatttctggttggagattaccaatcactcagcttcccaaagtgatttgaaaaatggctaaacattgtgaagcttcttactcttaaaatgtattatttttacacataaacttttatcagtactagtaaacattataaaaatgagggttttttggttttttttttttaaacaaattgtctccatgcaagccctttggtttcaagattgttctaggaatttgtgtctcacttttccttgttgtgtatgaggacattttaaaaaacaacacaaaactcaattctgtgaactacttagaccaatggaaaattctccaagccattcagttttcctgtgttgttctctaagttttgaagttttaacattattaatctgtgaaacacattgtcgttaaggaagtctgccttagtggtccctctccctttcccattttctccctccttcgcccttttgctaatatatgattaaaatgactagtagtttcttgggcactgtggaggttttaatttattgtaattcttgggcaattttctttagaaagatagagcctaatcccctttccccttgaatgtacaccagagttactaactcccttctaatgaatagaatgtagtagaggtgatgccatgtgatttccaaggccagtccatagacaagatagcttcaacctcgtccttctgttctttttctgatcattttctttggaggaagccagctaccatattgaggatactcaagcagtcctatggagaactaccactcacttactagccatgcaagtgagacgtagaagcaaatctaaccccagtcaaactttcaggtgactgcagccctggcagacatcttgatcttgatctttgtgagagaccctgggtcagtacagtaggagtggggctggctttcccttggaagcatgggcatgtgaatgcacgtaagtcaggtgtggcttgagaaaagagcttactgcttgcttctcagtattgtttaaaaaacacagtgagacatactgcacttttagaaatggaagcatgtggttcataataagcgtgggtatactgagttggctattctaccaaatgaattaggttgraaatgttaatctttttgagcagatacattctcacacaacacaggtacaggtatacacttctttctgggactaggaactcaggatattcctgctactaggtctttttctgtgttaaagtgttggctttttttttctttgctcaaattaaatgaacatattattatatggctggttccttagaatttatgccaggatatattcagaataaatgttagcttattggtaacacatggtgccccttagaatctataacattgttggtctgaaagttgaggcttgtaaatcctttaatatttctgggcargaaaaaaatgacagtggtatataattttattaccagcatatgatgtggaagtcatattttcaaaacacagctaaattgttataaacagttttgcagctttttcattacaaggaagacagccattgattttctcatttcsttacatttttgtctcccattccttttcagttagaattaagtagtagatagttttataacacagggtttgtgttttttaaggcaaaaaatgtgtggtgttctctccactttttcattttgttaaattatctattttaagaaaaagctcatagtgcacaaggaaatctaggattttaaaggtaaagtactaaatttatcagtggataggaagcaaatgtttttgtaaccaaacaacttcatttgagctattttttagttaagtatttcctcaaacttgaaggtatagtgtgaattcagttgtaactagagttggtaattaggttcggtgtcttaccatggtgtcatgtaatgcttattttaatcctgcggttttcagtggggagaaaagttttcttaacaagcatatgtaagagayataatagattagaataaaatgtcacaaggtgtacaaaagcagcttgtctctaggaaattttacctttttttgctgtttttcaagtttgtggatagccagattttttaaaaaatctttttgaattacagtaaattgattagtaaaaataataacaattcttaagctctcaaaaggctttagatagaaatactgggattgagcaaaatctaaacagatttctttgggccttcaaggcattttgcattcttgtgggtccacctccttgggaggtgaaaacaaattaaaataatgagttccttcattattttaataatgaagggtcaaggaagggrtttttttcccccaaagggaatatacttacccaggagagcattactccttaaattatgtggggataaactagagggattcaaaagaatgctgtttaaaaatcagtgtctctttccagaataatattaaaacccgaggcttcttaggaagtttcaatttttggatcctagttattggctcacatattcttttacttgaaattagaagctattcactgtgtgtatgagcctgtgtatgcacttcctccgttttgctggttgtagaatgagtgctctcattttacttaaaatgagttaattttttaatgatgtgtgcttcttctatctttggggaatgtacatcatgataaattaagtagtttaaaataaatttgtgagtactcatcccacgaccgctagtttggggttggtgtttgtttgtttgtttgtttgtttgtttgttttggagacaggatctcactgtgttgcccaggctggagagcagtaacgcagtctcactcacggcatccttgacctcccaggctcaggtgatcctccctcctcagcctcccgagtagcagctgggaccacagttgcatgccaccatgcccagctaatttttgttttgtgtgtgggagggaggtggtgtttggtagagatggggcttcaccatgttgcccaggctagtcttgaactcctgggcccaagccatccacccacctctgcctactaaagcgttgggatttacaggtgtgagccagcacgcccagcctattttggggttttttaaagccttaggatgaacaacaaatttgctctgttaaaggtgaatataaaaatgtatttctctgctttaatgatttattttggtaaaaataaatatagctgccatttgttgaatacctactctgtgccaggtagagtccattgtgcttttcagtcttcaattagttattttcactgtttacataaagattcagattaatractgttaaggaccacctttgagccttaaacagacccttcttgacaactacagtcaaaagattctatggctttacctatatcttgctgcctcctatttcaaaatgcattttcctcattcttaaatggtttatgtctcatcaaagtaggattgtattttcctgtataaagctgttgcacttaaactgtagcaaagaatctgccctctgaaaacaaccatgccatgacaacytctaacaagcagtcatatgtgtgtgtttagttttatttctagttcacatgtcaatgtgaatttttaagtgtatttttatgactggagaggtttctccaattaagcgtttagcaagaaagaataactatttactgattctgtgatgcctcatttgggtatgcaagtcaagcagattgttgctrattctgaactggttttcattgataatcagtgccataagacagaacatttagaggttgatagaggatgactttgctcggctartttgtctgttgcattcacagacaacagaaggatattctcagatcttccatgtcttgggtaattgatcagacatgtacttgtttcattgtggagagctgtatgggtgctggggggactggaacaccccgtgctgatttttctcactggtgttttctggtttctttccccattgtgaaagtgcagtgatattaatgtgtttactatagaaaattcagatgagctaaaagaaaaaaaaataatagccactggtctttttaaaggttttttcccattgtttatatatttttcmagttaaaggtttttttgktttttttcattatttagattctttttctttttttttttttttaagacagggtctcactctgttgcccaggctggagtgcgatggcatgatcttggctcacttcagcctcgccatcctggactcaggtggtcctcccacctcagccttctgagtagctaggaccacaggcacttgctaccatgcctggctaatttttgtggtttttgtagggacgtggttttgccgtgtttcccaggctggtcttgaccgcctgggctcaagctattcacccaccttcgcttcccaaagctctgattaccagcgtaagccactgctcctggcccattgtgtatattctgaatcacaaacacacatacttttggagcacccagcacatctgtgttctctgtggccctcattatcttgtccacatttgagggtgatgctttttcccagagttctgaagtggagaagcctagttgaggtcatgttttggggggtgttctatgccacctgtacagtgaggagctaggatgctcctaggtagagagctgggatgtgatctctactctgacaggaagtaactgagtatttcttaacaagtccttcgtttctcaggaccttggtttttctaccagtgaaacagagatgattttttttcttgtctgtttatgaaatgagatgaagatacttttgtagcctctaaaatgcactgtttatacccaaaggggagttgatagtgtctaacaatactgcatttccctagcaactgatccaaagagacctgccccttttgatctcacatgtgctgttgcccttccctcagactcgccaactgtgcacccagaaagggcaagaagctttgtcttcagatacagctaacatttcttctaattctgaacattttggggtcatagaccccttagtaagcctcagaacgacgacacacgttatctgaacttaaaacaaaaaatcttacaaagcagaatatttcagtcaatttcaggggtttttggaacccctgacattgagatcagaaccattgatttatataaacaatatgttatctatactatatactgtgttatatatagtataatatatataataatttataattgattaaataaacatataagcattgattggaaatgctttgaaatgttttactgacacggattgatgattaaaaatagtttggagagtccaggtgcagtgtggctcatgcctgtagttccagcactttgggaggccaagggaggcgaatcacttgagcccaggaattcgagaccagcctgggcaacatggcaaaaccccatctctgcaaaaaatacaaaaaaaaaattagctgggcatggtggcatgcacctgtggttccagctactcaggagtctgaggtgggagaattgccagaaccagtgaggtcaagtgtgcagtgagctgtaattgcgccagtgtgctccaacctgcgcaacagagtgagatcctgtctcaaaaaaaaaccacaaaaaaatagtgttcagagggtagctgctcaggctgagtcctatcgtaggctaccacctcattagcagaacaagaacccaatgaggttttattatctcgattttacatataatttataagccaagaagctaaagctcagaaggacttaaaggtggtacccaaggccataattctaaacactaaataacctttgtatcccattgtaggtgcttgatgaaagtttgtgaattagtagttaaatatggggtcctatttttaaacacctatttatttagaagggttgactccattgggtagtcatactgtggaggctgaagtaggggaggaattggttgtgtctttgctacctattttaggaccacatctcaaagcattgcaattacctacagagccatcagtaaaccaaagtgtattgtgtatttcttctggcaggtaggaaggctgtatgatgaagccagaagagagaacatttctgcttctgctataggagagtgatgttcaggtgctgtttaaatgctgagtaatagccctgtggaactctttgagtatcttttcttggggctctgttatttaatggatttgtcagtgctgcagaaatgagaatatgcatgctgagtttccagataacaccccagaggctggggccagactcttgctgaggcttggttaggactttgaaagaacaactccaaagtcaaaatgaccttgagaaattatagaaatgaatcatccaaagtggcatggaggaaagcagttttaaaaaatgtccacagggctttctgcctccaaggattttgtctttaatcttaacaatagactaatacagttagtggtgggaaaatgtaaggaaactgaggctcagggaagtgaaataatttgctcataatcagcagttgtttccaaattagtgttatagataagaaaataaagagtttagaccccaaatccagccctcattccccaataatatggtgtctgtaaagttaaaacaaattattttccgggtcacaggacaggtggcactaagtttttggattggtggcaaaaaggatctgagccactatctgatgatgaacaggaacagagggcagtgcttttaaaacgttaatcacagcactttgggaggctgaggcgagagaattgcctgagggctggattttgagactagcctgggcagcatagtagggccccatctcttaaaaaaaaaaaaaaaagccaagcatggtagtgcattcctatagtcccagctactagggagagactgaagtgggaatatcacttgagccaggagatcgaggctacagcaagctatgaccatgccgcggcattacagcctgggcaacagagcaagaccctgtctcaaaacaaaacaaaatcttaatctacctagctctagattgaaggtggtaagctctggagcaaccaaaggctccatattagtttctgtgtatctcagcccacctaagcaaacactgacttccttattgctgagtactttatggtgcctgtatggtatgctgctacctcttgccttgaatgtccacaccccaagtctacttgttaaacaactattcatttttcaagtttctgctcaattatcttctcttatgaaacctaacccactccatccaagtgttgtctgtgtgttctttttttatcaaatattaaatagttgccttctataggccatctgaaatagcagtatgttttcatacagaagaaagaaaaaaaagttagaactcctcctcatgccatatagataatttcattgcagatgtattacgtatttaaatattgaagtgaataaaactttaaaaagtttaataacttactttaacgaaccctttcctgtgctatataaacaaatacattgttttgggttaaaggttaagggtttttaaaaatactaaatattagaaggcttaggaacataaggccggaaacccaaaaaagtcttttgcatacagattgatatatatgactacatgacatttttaaatttctccatggcaaaggacaccactaacaagttacaagacaagtggaagaaatatttgcaacacatattataaaagtttctatcccttgtacaagacattcttacaaactgataggaaaaatactagcattggaaaacagggctaaatatgtaaacaggcagaaaaggaaatgttaatggacaataaaatgcaaaaagataggcttactataggcagttttttatacacatgtggccagaattaaaaaagaacagtaacatctatgtgctgatatggttgaagagaattagccccttttatatgtgcattgctgttgggaatgtgaattgctttaaccagcttctctggaaagaatgtggcaatattaactaaaacttgaaatgtacacactatcccccagcagtcctgcttttgtgaagatayttttccagagataaagtaacagcgtgtaagagcttgtgtataagagtatttattgtagcrttgtgttttgatggcaaaagctgcagaaaacctagtatcctttcagcaggcgtatttattatggaacatatcccagttaaaataattagatttacttatattaaatttcatgatttttattccataggaaaaaagcaagccatggtggtcgtatgtaatatcccatttattttttttaaaagggagaaaggggtgaaaacacctatatttgtgtgtctgtatgtgtgtgtatatcttttttaatcctaaggtttcactgagatacactccagattattaactttgcttatcttaaggaggtgggattggaaaaagggaaaggaaattataattttatctttatatttctctgtaatagcatatgaattacttatataattttaaaaacaaatagaattaaatattttataagtgtgattartgctacaaagtatgcataggataatataaaaagaatttgtcacttccccttttatggcagtgctatgatttatgtcacatattacatggctttattattacattatagctcactgtattttatatggctggcacatggctgctggtaagtattttttgaaagaaggaaaaagacttgttctaggagaatccactacatgcagtgagcattttactgagcattcactatgtgccaggctcagcactgggaactgggcgtataacaaagtatgtaaagctgggacccccaccttggcaagaggctaagaagagagtgaaaaacaggatgcttggtaggttacacttacattgaaagagtcagggtgaatcctgaaattgtgatggaacttacagacaggagaactttggataggttttatgactggagtgtaataatgcgtgtatcccagctatcctctggaagatttttcttcgttcatgaagataagatgataaacaaatgtttatcatgtgttcctctggactcttgacacagaaggagaacttgcataaagaccttggaagagaggctaggctcccaggaaagagtatgggaaattaaggaagtgagactctggagtgtgggatggtacttagcattttataaacacccactgtataccagatactagatgaggcacttcatagtctttctcatctatttccyttaataaccccatcaagtaggtattactatggctaagaagacaagagtctgagatgatgtataaattgccctagatcacagtttataaacagaaaacctggaatttgatccacagtcatcttatatatcctggaatcctccaaaaaataccatgtttaaattagcatccattagcatcagaacttcagctctgaattttggagtaaatgaaattaatagaagtaaaggtatttttagactcattccatgttccttataggcattgtcccatttcacgtatgaagttgaggcccacataagttaagtgccatttccaaggttatatatgcccagttagaaccagagtggggattcagacccaagtctctgtgtcactgaggcctgtgttctgtgtgatctttcaccaaatgttgtctaggttgtgcttggttgtggtttggaatgctcctcaggatggatttatgagagtgttctcaaggccttattatacccattaagtagaaataatcctttgtggttttataatttttttgcatttttccaaaagagcttttatattaattatgacacctttacctcttagtggccaatcagcagggcagatgttattagacctgttttatatatgaagaaattaaggcccctaggagcttcagtctcctgacatggtagagtctggagctaagacctggattttcaggtttctcaatcacttggcatctggctaaagttaaaagacttctagaggctcctgcacttwaccaagtacactagttaggagcacaggctttggggtcagtgcctgtcactactgcttcttagctgtatgacattgagcaacttgcttaactactctaaaccagtttctaaattgtgaacactgaacgagataatgcaggagaaatacttagcacagttcttggcacattaatcaaaacttgtgattgcaaattattattattattactttgtcaatattattacaggacaggaagtcttgtcttattcacctttttgttcctggtatttgtcatcaagtctttcacatagtggattctgaatagatattgtggcacacaatattctagtatccacgatagtctttcctgagtgtrtcagtggagaaggataggatttggaatcaaatgaagtgggatctaatcctttcttcaccactgagtttcatttttcttatctataaagcaactgccttgagggagtatcrcatgagtttcaggatattcactgtgattgaatccctctacttagtcagtgcttaataagthgcagccataattagagtcgctgagaatcaaaggttaggttggcaggcagtccagtccagaggttttgtgaatattgcccagtttggtaaggtataacacatagtgtcagttagataaacccctcagggagagacctatttaataattgctgtggttctgaaagttttgaggaaggcctcattggatgaatatacaaagtatgtttaaagagtattgaattttaatgtattcctaaggtacttgttattgccaacgcctagggatataaactcttcagcgttgtctgaagcttctgcttcctgtccacggggtaaaaggctggctccaatgcagtggccaaggatggatagttggtatggttgtcatcattgtgtcattgccattataaatatttattgagctcatcgtgtacgaggcacttggcatgcagtatcttgcttaaatttaataacatctctgtgaggtaaatgccattataatttccattttccabatggggaggatgaggtttagaaagataaagctgcttgaccaaggtaccacacagacagtaaatgatagacttgagatttgaacctaggcctgtcctactttaggatatggagtatagaggagggtaccctgtaaggttcagtggctgacatctgcaaattatatggacaaaagacaaattaacaggagaaaaggcttatttagtatggacataaggggcctcacggaaaagaaatgaaaaaccccaaagaagcagctaggcctaggagcttatataccattttagcaaagagcagaaaattgtggagaagtgacaagacagagaaaaggagacttctaggaattatagggcagtaaattatagggaagataaatataagggggaaacaaatagatgatagggattattttaacaaggkttatttatgcagactcatcttggtactgacatttcatctcttgtgacaacagtttttctcctcttcctagaaaggaggtaggggaaacactttcacaaagggagatttatgccttgcttttaggcagaaaatgttcttcctttcctttacttccatcctcctctcccttcttccttccttctctttctttcttttctttcctttcttcctcttttctttgttcaaggtctcactctgtcacccaggctggagagtagcggcactatcaccactcactgcagcctcaacttcccaggctccagcaagcctcctgcctcagcctcacaagtagctgggaccacaggctcataccacagtgcctggctaattttcgtatttttggtagagaccggtgatatggtctggctctgtgttcccacccaaatctcatcttgaattgtaatctgaattgtaatccccacatgttgggggagggacctcataggaagttattgaatcatgggggtggttcccccatgctgttctcatcatagtgactgagttctcacaagatctgatggttttgtggggagtttttccttccttcactctgcactttactcatacttctccttgccgttaccatgtgaagaaggatgtgtttgcttccccttccaccatgactctaagtttcctgaggccctcctcagccatggctgaactgagtcaattaaacctcttttttaaataaattacccagcctcaggtatgtcttttattagcagtgtgagaacggactaatacagtggggttttaccatgttgcccacgctggtctcaaactcctaggctcaagccatctgcccacctcagcctcccaaagtactgggattacaggtatgaaccactgcacccagccaccttgctgtttcttaattgctttaagctcaaaataattgttatgccgaagtggcttgttttggggtggcatattctaatttaaatttccttatttatgagttgtatgatcaagggtaagtgtttatatctacacagtgaggatggtaatagtacttatctcatggactgttagtaagagtgaatgaagtaatgtactgtatgtaaagtgcttaatacaataacatttagtcaatacccaacaaactagctattgtaacgattattactggaatagtaatactagagtagtaaatcagtgattagtttatattagtcatttccccacagaaatgctggcagttgaaatcgtgatgaagtggccttttctggtctagtttttaaaactagaccagatttcattctcatattatttcattcttgtttgaactgaaaggattcacctagctgttagaattatcttgcaggccaggcgtggtggcttacacctgtaaatcctagcactttgggtggccaatgtgggaggaacacatgagcccaggagttggagacgagcctgggcaacatggcaagaccccatctctacaaaaaattaaaaattagccggtcatgatggcatgtgcctgtagtcccagctacttcagaggctgagttgggaggattacttgagcccagtaggttgaggctgcagtgagccatgttcatgccactgcactccacgcaggtctacaatagcaagaccttgtctcaacatcagcaacaaaacaattatcttgccttctgcaacaatgtcgtggatgccagaagtttcttaggaatattgggaaagaatgtgtcttcttaacggatggatcacatttctctgttcttttcttttatccagtcttcttttctcacctacttaccctaactcccactgtactatgtgcccaaaagtcttctagcactcgcatgtagtaaagatcttaaaacagagctgcatcctgctctctgaaacctcttgaagtgagtgggccattttctgccttatcagtccgtctccttcagaaacactcattcctgtggcagtgtcccaccaccgcagccttctttccctcctcttccctatacctctgaactgacattcccctcagatggcttactgtactctgcagtgtgttcctcccttctgccgttgcccttgctatttcctccaccagaatcatggttctttgctgtctcactctctgtgcctgttgaaagtctgctgggtaaacccttaattttgtacacaagtgtgtgtgtgttaggggacatgtgtgtgatctttctagtattgactttactaactttataatacagtatgttaaaaaaaaaaaagacatgtgagacctgtgtttttattctgtttgatattacagacatcgctctgtattgtaagtagtcatggatatatagcggtaacagtagctgacattttggggcacatgccacatgccagacactattttaagcaccttacatttaattttctatcattctattttcataggattatgattattattgttattattaccccaagatatatcttactaaactgttatatttttatgctaggaaattatatatatacacatatatatgtgagacatgtatatatatgtgagacatatatgccagtatatacacacatacatacatacatatgcatatatatatatatatggaaagagactacatggttattcagctgtggaattagcaaaacatacaggacccatgacctagcctatacttatctagtcttctgcctcactcacgtcacatttcatgtttcatctacctaataagcataattcttcccttgcagaactagtgggggtgaaatatgagattgtagaaagcataaggatttgggtcacagaaggttctgagcttctcccaacaccttcttcctatggcctgtctctgccttagcctttagccaactccatcttattctttaatgagtctgtcatcacagatagatggagagcttcttgtaattctttctaacctttgcatgaaatttcaattcaggataatggctgtgtctagggagggaaggaaggagatcggaattgggtagagggacaggagtaggggaatagggaatcattctttaatattttatttattaagctgggtggcgcatacatgtatattcgattaactaattatatttttcacttgaaatatttgatagtctcaagaaagcagcctatatacctatttttactactgaggtgcttcccttgggagcaggtaaaatgaacacacagctgaattcttttttcataggtctccaaaatcagaaaaggatatcagatgaggtaggagtcttggtggtaaggtgggacctctttggcctcagacagaaggtmtcaggagtagctccagcacatgagggagatgaaacctgtgtgtcttctcggttgagctcgtgtggcctttcttttctgtttttctgagccgctcctctgagtgaacttggatagtaaccagagctgcattttttaatatctcagcctgagatgctgacaaccactgcaggcaccatgaatttttaatgtggtggtgattagaaggctggctagggcctcatttcgtttcattggactgctgtgacacttgtttccttcatggtatttagacttcctgggttatttcccartccagactcatgttctgtttcatgagtgcccattgcacccatgcacttattgaggtgtgtttgaaagcagaatttaaaaatttgatctcagttattgaacatcctacgctatttcagaaagggatgcttcttaaattcctgaaaaggaattcaataaatccaggtcaacaaatattaaccaagccgcagctttgaaagtccagctcactgaaagaactacagcagtgtccattgggtagggatgcagaagtgaaccataggtaatccctgcctyttgcggtctggtggtaggaaaagatctgtgtgtgtgtgtgtgtgtgtgtgtgtgtgtacatatatacacacatatatacacatatatacacatataatatacatatatacgtgtgtatatatacgtgtatatatacatatatacacatataggatgtggtagaaaatactgcagtagaggtacagagaattgtgggcaaggaaggattgtttccaactaaaggaagactttataaagaaaagtaatttattgtaaagcctttaaaaatatgaccaaaaaaaaccaaaaaaaaagatatgactttgataaatatctatttattcatttattcattatgtaaatactatgcatctactgtgggcctccctacaaattcatgcttctctgtgcgccacaacagaggagggaggtggagagttgagtacaggcatctgaaatgcttccaagagaacgtggtatgcatcacttccactcacatggccttggatggtgcatgccatatttcctgccttactttgagagtatggggaaatgcagtactcctttctgtaaccctgcaaggattgggaacttggatatccatggcaagtggtaatgtctgccacaagagtcacaagatctgatgcacagtataacagtgttgcattggatgctgtgttgrtaccagactgctgggaggcaaaagtagcaacagagagaccatttcagaagcagagtgtatttgccattgccacagataggggactgtgagaaaaagaatgggaagaagatcaagagtttggttttagacatgttaagattcaacatagttagtggagatactgaataggtagttgaatatatgtctgtattacagagggtgggtttttctgggctggggatatcaatttaggagttatcagctgatagaaagtatttaaagccgtaagactgagatcccaagagagtaagcaaaaatagagaagaaaggtccaagactgaggggcctcaacatgatgaggtcagagagatgaagaaccagcaaagacaatggagaggaccagtcgtgaggcaagaggacactcaagaaagtgtgatatcctggaagccagacaaagaacatgtttcaaggcagtgggggttattgtttatgcagtatttgctctactgagaaacttttatatactttatgtcagctcatcaataccacaattctgtaagttagatattggactcattttatggattggaaaacaaaagctcagggaggagaaattttcacaaattaatgtttctcatgtgcacctaattcatctgatccaattctgaacattttgcagcaagagctggactgtgaaaagcattttacaaatactattcctcagacctggaacttagacaaaattaaaggaaatgaagattagttgcagggaaagaaacctgttaggacacatgaatttttcttttgcaatccaagattgtttttccaaggagaattttctactttttcaggtaatcatagtttctttcttccttttccctttcytttttccttttctttcytttcctttcctttttcctttcctttcctttttcctttcctttcctttcctttcctttcctttcctttcctttttctttttctttttctttcccctttcccctttcctttctttctttttttttggagatagggtctcattctatcacccaggctgggtgcagtggcacaagcacagctcactgtagcctcgacttcccagtctccagcagtcctcctgcctcagcctcccaagtagctgagaccacaggtgcatgccacaatacccagctaattgttttttgttgttgttgttgttgttgttttgagacagagtctcactctgttgctcaggctggagtgcagtgacgcggtctcggctcactgcaagctccgcctcccaggttcacaccattctcctgcctccgcctcccgagtagctgggattacaggcacccgctactacacctggctaacttttttgtatttttagtagagatggggtttcaccgtgttagtcaggatggtctcgatctcctgacctcgtgatcggcccgccttggcctcccaaagtgctgggattataggcgtgagccaccgctcccggccctacacccagstaattgttaattttttgtagagacggggtctcgccatgttgcccaggctggtcttgaactcctgggctcaagcgacctgcctacgttagcctcccaaagttctaggattacaggcgtgagccaccatacccagtcaatcatagtttcttaattgcttgaaaatgtgatgtaatttgacccctcagcctatgaggaattagtggattaactggactataaatgagctaaattctatgaaagaaaaagggaaaggcgaggtgcggtggctcacacctgtaatcccagcacttttggaggccgaggtgggcggatcacaaggtcaggagtttgagaccagcctcaccaacttggtgaaaccctgtctctactaaaaatacaaaaaattagccgggcatggtggcatgcatctttaatcccagctactcaagaggctgaggcaggagaatcacttgatcctgggaggcggagggtgcagtgagccgagattgtgccattgcactccagcctgggagacagagtgagactctgtctcaaaaaaaaagaaaaaaagataaaagggaaaatcttccttagtagagtgagttagaatatttagtgtactcctaacctaacctttgggacatgtgcaataaataattgatacagtttatgcttccattttgagaattcgtagtgatyggtgttcaaagtaacttttcattgtggcaaataatagttcagactcctttcttcttcttttttgtttttagatcatgtacaaaatgaagaaaactatgcacaagttcttgataagtttgggagtaattttttaagtcgagacaaccccgaccttggcacygcgtttgtcaagttttctactcttacaaaggaactgtccacactgctgaaaaatctggtaagacatttcatatgtgagtaaaaagaattacagcctttccaaaataytaygtcatatagagaacatttcaataatccttccccctcaatccttggtcctaggggtgagaaagaaaaaacaaaaagctttttagtcmtaggtaacttycacacctcaactaaaaagctttttagtcgcctaggatttgcttaaagaaaatcccattgtgaaattcctggaatttgtacctttggcccagctgatagagtagatttatcgaagctgagagagaaactgcttaacctgaattctcttccacatctctaccattgatttttttttaaagataacctttagcaacttttgctttttaattggctaaaagaatgatgatttctgtgtcgaacatacattggaaatacacattgaaagtattatatctcacttgtgtgaaggtgatcatgcattttggtttctgatatataaataatgaacctccctcaactccccacatccttttaacccccaaccaagaaaagggttttgagatttaaggaatctctggtttccaaagtaaatgacaggaagaatccctaacgatctgagacactagaggtgctggccccgggaggcagacccagggatgggggtggtggaggaaactgtttgccaggcagtcgtgtgtgggcatccccatgttgtgctgcaaccccctccccagccctcayaccatgtgcacacttagaaaggttctgggtaacaccacctggacggatcatttggattttgttggttttgggggatgaaattatttctctaagagccacccagtgaaataatttaatcctcctaagtccccagagaaaggagtacaatgaggttgaaaggtgccaaaggaaaactatttatatcatgcttttccaagttagccctgccctggagaagaggagctgttccctcttctctcccagtctcttggtattgtgcttttacctcctttaaggatccagaactcattctcaagatgtccttaacctaggtcagttattcatgtatcacataggcttctgtggccttaggtgataatttgtcataatccattagatrcaaaaggttagtttacagatgaagataacctatttgaaaaatgaaaactacctttctacactccattaacctatttggccagttacaatattctttttctctgtcacaataaataaacgtgtgtatgtgtctgtcttcctgacagtttttctaattggcgatgtatgccattgaattaatcttacacagcgaataagcaaatctgaaagaaaataaatatcgaacatagaattatttattattttcaaaaacttcggaaaggataattttgaactttggctctaatgtttctgtgcttttggatttaacaaatccatgtttttgtaaatcttagattatataaacctcatttattcagaagagcaccctcggttttccttcactctgagcattgcctgcactttcactggaggycttgctcaaagtgtggtgtggtagaaagagaggaagcaaaacaagactgacagttcactttggtaatagctggtaaaggacttgcttgggcaggaagatctgttttctctgagatgggtgttttcgcattgatgtcttgctttagtttccaaggaccaaatgtattggcttaagtcaagagtcatcacctccaaggttcctggaccaatctcatctctacggtttgctacgctgcaggttcctttcaactgtgtgtatatgtgccatacacacagctcagtggccattcaggccaacattcatcatctgcgtttgctcacctratacatttgtttgtctccatacaaaaccatctgagatttattgaatgtttttgatgaacctggcagtttggtgggtgtgttatgtagattatttcattgaagacattacaacaatcctgtggttactgtacctttaatccagatgaggaaactgaggcaaattgagatatataacttgttcatttaccctattagtatgtgttacagacttgaacccaaacattctgtctctgaacccgttgcctttgctcttctacaatatcctgcctctgtcacctcatgctctggttgtgctgtttccctcagcagaagtactgatcaagctactcccatatacatacctcaagctacagccctttttccacacccactcccctttaaggagtagaagtctaagaaaaatctaaaggaaattgctggaaaacctaattcatttagtaaaggaaaacaaattttgcctttgaaagtggtggtggcattcctggtgagggagccaagtagaagaatcagtttctactgtagtttggttactaagaaaacattattctgattgaataaaaggcagtcccaggagtttacacaacttgacaacagccagcaactttctgcttccctttttatgcttttcctggaaagggaagagcaaactagacagattgatagggccacaccttggattagagggctcccagaaagccaactcaccccgagggggtcagggttctggatcttcgtgcagcacctgcagcccccagctgagcagcactcaacaccctcctggggctcaggagtacccccgtgggaacccatacttctcagaagattcccaaaaatcctgttctcttaggctagtgaaggccagaaacgttaagcaaactgatacagtagaaattaaagagaaggtgctttggtactttatagactttgtaaattgtattcccagttcaaccagcaagtaccaaaagtctattatgttcgaaggtctatgctaaatactaaaaaatgtcattttctaattaagtattgcctttgaagagtattttaatagtttatactaaatcattacttatttttatggagaaaaaggaaaggatagatttgcgggccaggtctcatactagctttcagcttttgactaactctggatgagaaaaacatttgttatttgttcgatgtaagaaatcactattgcaggtgtattgtgtttatcagtttctggggcagtggtcttaaaaaatatcagtgcactaaatgatggtaactatctcaaccatcattgagatgcttcgggtttttttcctttttctgaactgtctgtgattatagaaagtacgatcaagtgagatgttatgtgaaaactcccaagggctacctacaaagatgttggcattaacagtgcatagggctgaggctgtttttaattaaccatacgtctgaggactgcgaaaaggattgcacttacagctgattactctgtgagcccataccgcagttgatgcaccaagtcagttttaaagtaacttgcttttcttactcccccctcctccacattatagaaaattgttcctataaaaagtttttctaccttgtaacataggattcgagaggctatgaagcataggtggttggaggatcatgggttttggtcccaatcacacctggaatcctagtttccgcctcaccagctttatagcctttggcaattcacttaacttttctaatgctagtttccttgtctctaaaaataaataagagtgactgtttcttggtagtggcagggtttcattgaggtcagagaagcaagtcactaagcataatacctgacaaaaaatttgtttcacaaatacaaaccttaattgttatttacatcttctcattttatttttaaggtaactcagtgtaaagacagctatcagtcatatcccattttagagatagatgcaccaaatcttcaaaaaatatatacctgcaaaatggtgcaattagggattgagctcaagccctgtggctacagattatgccttgtttcagtgatgctgccccacgaattacattgccttgatggattatgtggatggtaaaggcccacctgacacaatgaccagggcctgtcctggtgataattaaactaatgtgtgtgtttagcgtgcaaggtactttcttggttgtttttgtcctttgatttctctcattggtgagttatagcatattggaaagagtgagagtgttagatggtagttctcaaactttttggttttaggacctcagtcttaaaaatgactaaggacactatgtggtttctgtttatgtggactacttctattcatatttactgtcttagaaattaaaactgagacgttttccatgtgtattatgtattttaaaataaacccactttaaaaatctatttttatggaaaaataactattttctcaaaccaaaaaacattagaagggtggcattgtttaacatttttgtaaatccctttaaagccaacttaatagacggtagctatattttcatgtctacttctgtattcattttgttgcaatttattgttttagttgaggtagatgggaaataaggcctcatacagatctgtattgggaaaagagaagagtattttaagagccatttcaggtaatctttgatactacataaaaacttcataagtagtccttccttaaatgttattaacggtgtgaatctgaaaccatgcaaatgaacattatttggaaactgtcagctcgtggcaaattcaagttttccaaaattttagcttccactgaaagctctgtttttatcattagcaataaatgctatcagttgtttacctcgaggtgataagctcacttcattcattttcaagaaaatgtttggcaaatactggagtccgaataaccatagtttgctagtctttctttcaaaaaaaaaggtgttccactaaaaaaacartgccagttagttcaacttgcaactcaaaaaattacataagtacttttcctcaaaacaaccatcatattttggtatgcctaaaaagggctttatgcatacttcctatttcatcaaacagaacattgaaaagatgcatttgagggtcaagatgtgataaaaatccatttttactttttcattatgggtattcttaaatgaaaatagcctttcttttttttttttttactgtaagagcaagaccatgaagaatacagtaactttagtttgtagcagtgccttgatttatgcttaagacaacagctgttttactcactgttgcttttacactgtcagtgcaaatgtcaacacagtgaaagattcagataacctcttagtattattgtgaaaatagtttggaccttgggaacctctaggggcctaggcgccatactttgagaaccactggtgtcagaaattgaaggctttgttatgattccaaccctaccgttaagtaggttaatgttgcctaacttacagacgtaaatttcctcactagtagaatggggaaagtactttttctgcatactttattggttgtgtagggatcaaatcataccattcatgtgaaaaatattgtaacctgcaaagtcctttgtacacactggattattatagtattaataggctacattaatattagtattactatggtattaatagccactataggggactttgtattataaaaagaacacatgcytacaggggaattgcaatttctctttcatattccccctaatcaaagataactataattgacacttggagtttatctttctagtccttttgtctgtacctctttttttttagggggatggcaaatagatgaaatgacatgttctaagcaattttgaatttgctagatttcatgtagtactggaactagagcagacacactttcccaagttgagtcaagtcatagattcagaagttcaaaagaatatgacttatccgagagccccatgtaatgaattcctcatcattggcagatcagccttcatcctcattgcagcctcatccccttctagttgtgagagccaatgcggtgacatctgcggaatggcaatccaactactggggcaggaagatgatcgaagatgacccaagtacgtgcaagatcttttgtcttttacatccacgttctttatacccctgtaagcttttattgccttaaagtgaaaaaaaaaaagttccctaaaagagtgactttaaataagataaccttgccatctgtgtatttttatgactaaagtcaaagtcatccaaaattacaaagatggagagcagatcagtagttaccagcggttaggaaagggagcagcagtgtaacctgagggagttgctttgtattgatggaacagtttgataacttggtggtggtgattgttgtagttatctatacatgtgacagaatgccatagaactatacacaaagacataccaaaacaatgaatgcatgcaaaaatggggggaattctagtaaagtctgtggcctagttgtcttgcaccagtgtctgttttttcgttttgataatgtactgtttaacatatataagatgttactattgggggaagctggttgatgggtacaagggacctctctactagttttacaattttttggtgagtctataattttttcaaaataagtttaaataaaagtataacctatcaaattattatcaaggagagaaaagtaggggaaagtgtttagtatacattgttacataaaaatttcagcataaaacaaatgtgcagaacacaaatcaaactcacttcctgatactctttgagccaactgatctgcagtcctcagtcctgcttccttcgcactttaataggttttctaatttcttcctctaattgaagtcctatatgtggttgctattccataaaagtaggaatgattagctatttcctcccagaagtgagtctagttgtcatgattgaatatatctagggaatgctgcctcttagtggtgagaagccagagaaatgtggacaagatctattctattgctgttgtttttactatatttgtggcatacttacaagtgcatgggttttgatttttaatgaggcctgtattaaaatactcagcatcttacttgtgtgggcttgttgagttctttgagtcttggtttcttcatttttgtaaaaagggtttagtaatccctccttgtgttcatttatgattcattctgttacttattagggttctacataagcactgtgggtaggctgtagggatgcagcagtaagaagaacacagacaagggccgtatcctcttggagttgccattctggtggcatttttagaaataatttatgtgaaatacctatgaaagcattcagttcgtagcatgtacttaacagataatgacatttttaaaaacattttttaaatatttatttagttgccttgcaatctctctaaacttatccttcctctcattaaagatgccttcctaatcaaagccaactccagacataacaaacgatttgttgttcatggaatatataccatttcacgcttccatgcctttatagattccattccttccactttgagtgccccttagtagttagtgtattaataataaagactttctttgcaatgcagctttcttgtttaaaaaaagaaaaaggaagcagaatgctcttgagttttagctgtttctaagtggttttgttatatgtttgattaaatgtatagtactgaaaaattacgttcaaccttttttttttaaccatgaaaaggaaaccaataaaatcattacttgctaagcaatgctgggtctgctctactcctggcatcaggcatcattcctgtgatcctagcaaagaagttaaggagtcagcagagatttgcatccatttaataccaaaaccgcaaaatgggtcaggaaaggaataactggtggattgaaatagattctcaatggacagaggaaaaccatttaaatgccataccctttgaaagtcccaaggcagcaatggttttagaaaatgtatataaattattttttaaatagtgggagtcacccggaagtattctaggtcagccaggactcaccatgcatctggtttcttctctccggaggcctttggacaattctatagcttgcataagagcttgagtctcattaaacagttggagggcagttattgcttcagagctgttgaagcaaagcaaagatttctccatctgcatagcatttcctgtttgcaatctctgactgtagggtattgtggtttgtgttaaagwtgtttttttttttatttttcttcttttctttcccctcaaataagaatatctgataatgtacaggttggatctagatttgtagccagcagattatttctcaagttcttctttgaaatgttaaaaagtatggagagcatggatgtgcctaatggtaaaattggtagcttctgggtgccctgaactatataatgcatttttaaaaccttatcttttaaaaaaatggtcatcaatcattggcagttttcagcgtttgatctaccaggtatccccttatttcctgacatgcctcactgcctcactaccaattaatactgtgggacattttgtgaaatgtgatctatccatgtgggttggtgggtgggtaagagggaaaggtttatttttaactccttctatttaaaaaatcatacatatttattataaaaatttgagatatatggaaaattttaaaataaaaattataattctagcttctgttaatatttaagagtagtatttgaaacaattttatggatttgtacacagagatactgctgatttgcatagatatctgcaggtataggtatatatctcattcaggtccaaaatccttggggttagatttgtttcaaaattcagagttttaccgatttcagaagggtgacagggtgtacatgccttatattatgcagcacaccccctagtgacttcttgggaagatgcttataattaaacacagttttgtgtctgcagtgaaacttgaatattcacatgaagtctgatatataaagactattaggtgccccacctcaagtctagtcaagagattaccaaccaaatggagtcagaacaggttttgctattaagtgagtttaagctaaaaaaaaaaaaaaaaaaagccgtgtattttatatatatatatgcaaatttgctctaacaggctgcatactgtttcattgtatatctgtaccataactgattatttgaattttctgtttgtcaatacaggtataccttgtcttaaatacatccaataaacaggtrtcctagtgtatatatacctcaggctgaatttgaatatggtttttgttttttttttttttttttcttataaggattcacattcagtgtttcaaggtaggatttcaaataatacattttaaataggattgcattttcagcttgtggcttttgcatgttgttcatagcacttgtctaaagggtgtatgcacgcgatatgtgtacgtgattgtctagtattatttcacttacatttggtatagagttttggttctatgtgagaggaaggaagaaggaaaagggagagtggagaagggagaagaaaaaccatcgcttattggagcaaagtttcattgaccataagaaaagattgaactttaagaatgattggtactggaatgctttatgctgtctctaacattttgctaatcaatatctctttgataaaagagctggtctcaccctcacagccttaaggcaggtgaagttttcattatttttatttttatggttaacttttrctatacaagtaattctgataacaggagcttgtctttatactgtggtgactgtatgccaggcactggcactttgagtactttacatgttttattggttaagataggctaggatatactgcagtaatacatgaacccccaaatctccatggcttaacatggtttattttcttctcgtgtgacatgtctactgaagggatctgttctgcttagcaacagcaactcagagacttagacgcatggaagctcccccttctctacaggggaagagagagactagagaagcgtatgcatacttttcacagctttcctaggtgttgtagttcattggtttgaactgtgatcttggccccacctacctagctgcaggagacctggaaatgggagggagcaggagctgcaggagacctggaaaggggagtatttggtgagcattatcctctgcctcatctgtatgtagcctcatttactcctcacagcagccctaccaggtagtaaccatagttacccttatttaagagctcacaaactgagtcacagagcattaagtagatctcagattcagcattcaaacccaggtggtctgctctagggcatcggtccccaacctttttggcaccagggaccggttttgtggatgacagtttttccacatacaagagggtagccgggaggatggtttcgggatgatttgagcacattacatttatcattagattctcataagtagcgtgcaacctagatcccttgcatatgcagttcacagtagggttccgtctcctatgagagtctgatgctgcccttgatctaacaggaggcggaactcagcttcgctcartagcccgcaactcactcctgctgtgtggcctggttcctaacaagccacagacctgtaccggttcgtggcctggggactggggacccgtgctctagagtatgctgtacctcctcgcaaaagatatggacatcctgttttggacataatgtaaaatttacttttaaattaatttaagttaaaagttgtattgatttaaaaaacagcaattaaaacatagacaatgatgttacaaagataaggcaaacactgattggagagaattaacagccttctgtctgcatgatctttgtcccagaagcctccagagctctttctttaggcccagatctggaagtacattgcaaacagcaaatgcaagtctttttctcttttcctttcttaacagaaaattctgtcaaactctgccccacattcacttcttccacttctttccactccacattcccttccactattccttgatttcccattttccatcccaggcataaccttttatctggatctcccactcttcctagccgattcagattaaatgttctgtcttgagctgactttggattcctctgcacaatgttgcctgagtctctcctcacctccacataccatggccctcagacaaggccaccactccagatctggactgttgggaggtcctacagcccagcctggtgcttttttcagggctgatgttagccagcaccgggaaacaygggttagtgaggggagcatggctggacttcaggcttcccttgtacaagccaggtgggtgctttgagccatgtacaccctgcacagccgtacacagtggccatactgtgtccagtgcatctggcatcttcttgcctgggagcaagagtataaagaaacttgtccaatgcagtgctttctaatttatttgagcatggactttgttgttgtataagaaacattgacttttcatggaaccacttcagaaaatgctgatttagatgttttgctggaccaggtgatccatttcatttgttgttgtgtgtgttttttttttaattcaaattcacttctgccctccaacaatttatttctaatttatatttcagtatgtaatttctcattgtttttaagctggttgccacttccccttttcttttcattttagattatactgtatggtaaccccttagggttaaacatgaagaaatggcccgctgatgcagtcttgaactagtatctgactacatctttcagtaaaaatgagtggatcttttcattgacatattgccacagataygttaagcaactgaaaattcagaaaattggcagaaatagcttgactttgaagttggatataattgagttctatctctgctccaccacctcccaagctaggtcacctgaggcagattcattcattcactcattcattcctctagaaagcaagagtatctaagaaggctttacagaggaggtaccctttatctgagccgtaaattatcaagagatattcatgaaacgctgttctcttaagctagcagagactgttttcataagtagaaacattaaataatattaagcaatggttgatatacttgataaagggtgaggtgaaagtctatactttagtagtaagaaagaaacttcctatgaagtgtgttcttatctctgccagcagttaccaagtgcccactctgttccagaatctgtgctaagactgtcattttctatgtgagagattgcttatacataatattttaatagtttaccctaaagcactacttaattttacaaggaaagatggacaaaggtataggaccagacttttaaaacattgtgcttttggtttcccacaagtggggtttcctggcagcagctggcatcacaaatgtaatatctaagaagattccttttctgcaagggaagctttgaaatatatcaaacaactgcctatcacagttaccatttaggtggattctttgacttctgaaaaatttaatgaggattaagtgaaataagtcttaaaacatgaagatgtagaccaagcagacagggcagggctttccaagcaaagggagcagagatggctttgacctcctgtcagttaaatgaagacaataatgtctactatgagacattactrtgtcaccctagtacgtggtaagccctgtgtgcttgcatatgtttgttgaattttttaaattgtgttaagaaggtgtgtcctgagtaaaagatattgcaaaacatttatcataatctgtgataaagatgttgagtgaaagcaaggaaaatgtgatccgatgttacagtgtggttttattctagggaaaaagaacaaattgtagatgccatgcgtggaaatgaaattaaaggtctgaaagttgatcatgaactaactgattatcattttaagtacaacaaagaaatccttaggatagggatatctttctcaaaccaaggcctagccatatagcacaccccctccttttactttctcctttgtcttggtcttataaatcctagctacttcccctttccatataattatcgtcaaatgaaatcagrtgctgcagataatgcacagggaaatggtactttcattttcacttgatgtaggagatgatgttaaatctaacccaccatttactaaattgaattagataaaatataattgcattattttaagttaaggaattctcatattccctggtactcttagacctacccatttttctttctagcatttccagtaaaatgtactttatgagtaaattcagtcttgtcagtcccgagtgcctttagcacatggtgtaatttgtyttgcatttttccttgggcctttcccagatcttccagagcagtacctctgttcttcattgtaattatgccttagaccataggcaagtgatttctgctctctggctgtaagtctttccttctctaaaggaactttggtttttcttccacttggacagcctttagtctaaggcagtggttctcacacttgatcttgcatccatttcaccttgagagcttgttaaaacttaggttgctgggacccactcttggagtttctgattaattaggtctgggatttcataaccaacaagyttccaggtgatattgacactactgatttgaggaccacacttttgagaaccactaggaaggattgtcactctggacagagatccagaatttcctagtgttacggagaagctgcaactgtttttctctccagattcacttttatattaattgtttttacttttatacatgacatctgatttacatctttatcactgaataaagaacaagttgaatgagaaataggctgctggttaattatatcaccctcttgtgattttgcatcatgtttctttttaataactttgtacgtacaaaaataataccacttcattgttgaaaactcagaaaatgtagggagaaaaagactaaaataaaaatcaacagtaatcttatctgttatggagtgtgtgtatgtgtgtttgtgtgtacaccctctgtctttctaaactttttgctgtttaaacatcttttttctcgtatttttaaagtcatataatttttttaacattgggttcatactgcagtgctattttatactgtggttttccaccgataacattttgaaaatgttttcctgttttgtaaaatactgcagcctaagaacctttgcttagttggaagccatacaacctcttaaatcaaggcttgtttgtgcagggtttggagaaaggatcctctcccccattacccctggcagtctccgaagaggggtctgcagaacccagaggcacattctaaaaactgtatagaatgcccatcttatatttgcactataatttatttacccaacttcctgttttgaatatttctattgtttccatttaccactgtccaaaatgtaatagtttgaaatctctacacatctcatgattatatattatttagttactggttgtcattactccattaattcagtttgtaatgcttttgcttctcctccttccctgtcatttaagagtcaagaagtgggggaaaactgccagtagcccaaggccctggtaggtcatagttggtgccttgctctgatcaaattaagatgctcactttgttgaaatatttcagactttttcaaaaagttatgtttatactgtgccagaagtttcatagtgaacattgtggatggactatactaaaaaattgagaattgttataagaattatgaatggacttttctaactctccggctttaccacagaactgtttgtttgtttgtttttgttactttgttgagttggggaccagggctgccctgtctctgaggcagtttgagcatctccctatagttctcacccatttgaggtggaattttttctgctttattcagttgtatctcagtagctcattttaagctgtaagagtgttacaactggaaggtaccttagaggtctttttagagacctcacactttattgatgccagaaacaaaaagtgacctgcctaaacatccacagctggttggagacaggttcaagtctagaacaggtctcctgaccttcattctttcttctcttcttgccagacaaagcctaacagctgcaggatgggaggggtacccttggtttgtcactcccaaccatatcctgggagcagttctaactcttctgtccctctcctgaatctwgccccttcccccattctggtgctgagcactccaggacgaccaaaactggttcaggttctataacacttgatgtttcagagcagtccttctgatttggagaggaattcattcatccatttacttaatcagtaagcatttttatttggtgtatagaacaagtcaacactttgctctaggagtttgatgtagctcaatggtgggcaaagcagtcatagcctctgcctccaagaagctttgctctagacagtaaaggaacacacggataattgtaaagtgcagtactctgtgaaagtgagcctattctgccactggtccagagtaacaggaggttagggagaagggacttatttattatttagaatggtcaaggcctcactgagaaagtgacatggagacagaggaagagtgttccagacagagtaaagcacgtgcaaagtgggagagatctctgtgggttgagaagccaaaaggagttgtagygcagtgagaatgggtagagggactcaaaacaggttggcagggccagagctaaattgggagcttggatatgagtgtagttcagtgggaagccaatgatgggttttaagcaggagagtgatataatctggtaatcactttaaaagatcgctgtaacagcagagcacagasgaaatgagagtggcctttggagtcagtaaaaaccttaattaataacctgatcatctgctttactcactgtttgaccttgggcgagttacttaacctctctaagcctgtttcctcgttaacctagtgagactaagacccatcttacagaggtgttgtgagcaatatctttagataatataygttagatacagtaccctctgtcatttaaataaaattcatgctgttctgcctagattagaacacagtataatgggctgcattatcttacagtttatggagactgccttgcagacgaggcagggaggcaggaactgtgagatggagagaatgtggtgcaataaaaaggaaattttggagctccccatcccagccttaaaagtacctgaaatgccagctcattatcattttttcaccactactgctgagcttttcaagtgtaaagaatcttatgattcaacatgacgaaaccctgtctctactaaaaatacaaaaatcagctgggtgtggtggcaggtgcctgtagtcccagctactcaggaggctgaaacaggagaatcgcttgaacccaggaggcagaggttgcagtgagcaaggctgcactccagcctggatgacagagtaagactctgtctcaaaaaaaaaaaaaaaaatcttatgaaaataaacctagttaaatttgattaaggggtattatgtagttgttgtgccaaacccctagcctcagtagggaaggcaccaggttcaagaggccgaagaaaagacccagagccagcaaatgagacatggggtgtattaggggcttacatacaggggagagagtccagtggcagcaggctgaacaagaaaacttcacccactagtgaacagcacgtagcttatataggattttcacttaacactccccttaatgacttccatctggcaaccttcatggaacccaaaactcagggcctcaatcttctgtatggcctgtgttccacagttcgggccggggacttggacgtttctcatagacaaggaactaatttctgtgattactactcctgggattccctaactcagaacacacattcaggtgcatctgccacagggtcattctaagggtgtgcttaagttactgctatcagggcacttgccctacagtagtgtcaggcattttgcctgtatttgcatccrctgtgtctcagctaactgcgtgtgtttggccaagttatttagtaataccttgtagggttaccaggagcagctaatgagactgtgtgtaaaacgagccacctctgtggcctggaataaagtggagcttcattggtgtcagttcttttcttttctyttttcttttgagacagtctgttctgtctcaaaaggtctcattctgttgcccaggctggagcgcaatggcatgatctcagctcactgcagcctcaacctcctgggctcaggcaatcctcccacctcagccttctgagcagctgaggtttaggcatgcactaccaagcccagctaatgtttgtatttttttgtagagatgagggtttcaccatgtcgcctaggcgggtctcgaactcctgaactcaagcaaaccacctgcctcagcctcccaaagtgctggaattacagatgtgccactgcacctggcccgttggtgtcagttctgtctcgatccactgacactggcatgggctagttcaggaaggtgctgggacaccagcaaggttaaacggttttcccagttcacgcaggccgggagtgatgagtggccacatgcctctgggattctttgctctgtatcacagtaccttggaaagcagcctaatgacgaggcatcagttttatttttatttagttttattttttgacctgccacttcaggaggcaccagttttaaatagcttcaaggtattataactctgtagggcatgaaggagttaatatactagacagaatacccagtttataccagggaatcgcagacttaactactgggagctggctcattattttaattggattttccaatgcgttgagcaagtcagcagatttgcattagccttactttcagagaaactgtttcagttatggagagagagagaaccaatgggcagtggagagggaatgtcaagattaatgcaagatgacaaagcaagcaaattatgtcctcattaattaatacagtcttgtgtgcatgtaggtgtcctggaagtaccatttgtagagctgtgctctgctcttctgtcagaggcaagaaaaaacgaggccctgctgactgactgtctttctgccagttggctgctccagcaggacagggtggcttgttggggtgagccctcccttaagggcactccacctgcaggcccatagaggggcttggagctgagttgggcagtattcaggcaagccagaaatgatagtacagtgtgacctacaacttttttttttttttttgagatggagtttcactcttgtcacccaggctggagcacagtggcgtgatctcagctcactgcatcctccacctcccaggttcaagcgattctcctgcttcagcctcctgagtagctgggattacaggtgcctgccaacacacctggctaatttttgtatttttagtagagatggggtttcaccacattggctaggctggtctcgaactcctgacctcaggtgatccgcctgcctcggccttccagcgtgctcggattacaggcgtgagccactgtgcccgacctacaactgcttcttgattccttctttgggatctgatcagttagtaaacaaaatagatacagggcctccccttaagaagcaaaccttctagtgaagaaagatgataaatcagtaaacaataagtgagatcatttcttttagtggtaaagcataaagacattttaaaaatcagagcagaagatgtatgtttatatatacagagggaaaactgtttatgaagtcatctccagtgactaggataacgggctatttgtatactgctggcagtgttgaagcaattgtaaggaataaacggctatttttgtccagtttaatattaattacagtyacttgcttccttaagccccttttgcataatgaaagatagacctcggcctccctctgtttgatttactccaaatttctggttaggcttgatgtatgtactagcagggggaatacctcttctttgaggaaagaaatttagaagcaatttgtgcagaaagcaaaaatatttaccatacctaaatatcattctggaattttttttttaagagacagggtcacactctatcactcaggcagtggcaggatcatagctcactgtaatcttgcagtccttgcctcagcctcctgagtagctgaaactacaggcrtgcgccatcatgcccagctcatctttttttttttttttttttttttcctaaagagatggtggagtcttgctatacttcccaggctgttcttgaactcmtgsgctcaagcagttcccacaccttggcccccsccaattgcttggattacaggcatgagccaccattcctcgtcctgaaatgattttaaatgtgttgtttgcttaataaaatgaaaaaaatgcactttaaaaaacatacccttcgacttcttatagacttgaatcatgtaaagaacttatgttaattcaacttaatgaataaaggaaaggaaatgatttggaagttgagtaaatggagatagagtaatcaatagaattttagtaaaatcaatgggaaataattatataatggatttgaaaagcttttttaaaaatttattgaagataatgaaggtcatacaggaagtttactgatactgttattgtattatgtcggctgtattgtaagtgccttggagatgactgttacacatcagtttgcaaaactcttgctcaggtcatataaaggaggggcccccaacccctgctgactcattgtctttgttaggaaccttgctgcatagcaggaggtgagcggtgggtgagcaagcattacctcctgagctccacctcctgtcacatcagcggtgacattagattctcaaagcagcgcaaaccctgttgtgaactgtgaatgtragggacttaggttgaacactctttatgagaatctaatgcctggtgatctgaggtggaagagtttcatcctgaaaacagctcccccaacccctgccatctgtagaaaaactgtcttccacaaaaccagcctctggtgccagaaaggttggggactgctaatataaaggattcctgaaagaactrtagaagtgaaaacacaggaaatttgtagaatcccatgactgtgaagtcatatactccatcttcgtggcacaataatcacctaaaataactgagagaataggttttctgttctttgagatctccaagaaaggatttttttttttttgctccccccagtgaatatttcctaaaatttcctcctcttgagattggtttgctttctctttaacctttctttgtgcctttataatgacaaaggtaattactattcacttgtcacttaaaattttcgttgctggtttttttaattaacctacgttttcctgggaagttagttggaaagactttgtaaatttaaattttatttttcctgtagccttttcattgactagtcactgggaacattctgaattcataataacatgttttgcgttcatgatttcttatcagccctcaagaatgtgtgtagataaccacggagaaattcttaattcttggggttttctatcttcccctcatgcctaaccacaatgatgacattaaaaagttactatgtgtggcggagcatggttgctcacgcctgtaatcccagcactttgggaggcagaggcgggcagatcacatgaggccaggagttggaaaccagcctgaccaacaagggaagaccccatatctgctttttaaaaaaaaggatttactgtttgtgtttggtgtgtggtcagtacatgatttgaggcactttttgtttggaacaacctgcacattcagtactaaccacagagtttcataattctttaattgttattttataatacagcctttcagatcaaggtactaataacattaatgtattttttttaatttgctgcttcatttcacaaaggatttgaggcattgatgcaaaccgtaatttggaacaaagagttgaaaaggggttatttataatcactgtcttttcatattttgttttaaatttttgactttttaaataaacaacatattacatattacaatttttttaaaatgcaaaaatctcctctcccaccctatttctttgcccagtttccaaccctggaggaaattggtatcaacagatttctgtgtattatttcagaaataattaaagcagagagttttttgggggttttttttgtcttttgttttttggggttttttttttagatggagtcttgctctgtcacccaggctggagtgcagtggcacaatcttggctcactgcaacctccacctcccaggttcaggcgattctcctgtctcagcctcccaagtagctgggattatagatgtgtgccaccatgcctggctaatttttgtatttttagtagaggcagggtttcatcttgttggccaggctggtctcaaactcctgacctcaagtgattcgcccgcctcggcctcccaaaatgctgggattggaggtgtgagcctggccttttttcctccttgttatgcaaattcttgcataccataagtaatgttttataccttgcttttatcacataaatatttatcttggagatattttcaaagtgaagcataaagagctttctcgttttttttggctgttgtttagaaactctgtaatttatttagccagtgccctattgataggcacgtaactttccatcagttatagatagccctgtagagaagaactttgtacacaaatgattctgtatttcatttcttctgcaagtattttttgagcaccctctctgtgctaggcagtgttctgggaatatagcagtgagcatattgacccctctctcaaactggcaaccaggctggggagacagcaacaaatagggaaacaaacatatatacaaatgggtagggatggtaagtgctttgaagaaaaataaggcaaggatctccgtgaacagaggaaaagtaggcaatggcttggctagtgaaggcaggtcaggccccccaaccttacttacccaccatccatccaaacttctaaggcccataggataggaggatgctagggaattgtactccaagaatgaaattgaggactcagagcaaattatttcagctatctgtgtagaatagagggtgagtcctattaatcttcatattttcagtctcagacccagttagtgttgctcaaccttttttttcctcattatgatccaaagccttcctccttttccccaagagcctttttagacatagtcccccatcgctcccccccgtgaaattttaatacagctaatagacatagttgatatcagttatatactgtggccctttggagggccacagacagttataacagctaagattttttggttttttattttttgccccactccccaagaaccagtgtcttagagcctcacagaatgtagactctcagactatagctctctggtatgccagccagtctgttggtgtgtgattgttggcaaaatcacagacagaattgtcttggtagaaatccctttgtctttgaaataagaaagaagtgattgtttcttagatgtgtgtcaccagagaagccctctggtgacacacattgggaaaccttccgctgtgtaaaattagttgttgttcagggagagtaaagaggtagaatgactgagaatttcaagaagcctaagatgaaaacaacaggaaagggttaggaagaagttaagagcaaaaaggggaaaacctgttccccgcccctctctgctccctcattatcttatccatatttagcatgccatagcatttaaaatataaacatgtattcaacacttcctaggtatcagggagtaagctagcactttttacacatattaattcattccatcctcacaacagctgcttgcagtaggttataatattctactttacagatgtggttaagagggtcatgcacaaagccctttcaagtcagcgttggtccttctcacaccactctctccctctgccactaacacataatacataatagcataatgtagtagagttggctgtgtagtgactgcctctgttcctagaatatgagctctccacaggtaggaacagtgtttattcatctttgcctatcaagcttctagtgtagtgtgtggcacagagtagatatcttattaatgatggatggatggacaggctgacagttgaatacacttatgtgtgagtaaaatcatttcttgagtgaggggacccacaaacctttccatctataatctgctcctgcaggtctctgcagtcttgggttccacacctactaaaacttgattttaccaagattacttggggtctccttgaagacaagtaggtaaaaactcttctcagtccttgttttggttactcctttcacacctgactctgcctcccttggttccctcctgccattcttctctgcagctgggtagcatctccatctccatttccttctcctttgtagattcctctttgtgccatcttaaaatcaaggagactcaggccactgccgcagagcagtggaaaaaaaaaaaaaactatttcccggttatagattgcacttcctaaatatctcatctttttaatggaatctaggcattaaggatatagctgtgaacagaaaagtcaaagtccctgtccccatcgaggttatgtactagtgagggagacagaatacacaagctggaggcatcacattacctgacttcaaattatactactaagctgtagtaatcaaaccagcatgatgctggcataaaaacagatgcataggccaggtgcggtggctcacgtctgtaatcccagcactttgggaggccaaggagggtggatcacaaggtcaggagtttgagaccagcatgactaatatggtgaaaccccatctctactaaaaatacaagaattggccggacgtagtgatgcatgcctgtgatcccagctattcaggaggctgagacaggagaatcgcttgaacctaagaggtggagattgcagtgagcagagatcatgccactgcactccagcctgggcgacagagtgagactctgtctcaaaaaataaaaataaaaataaatgcataaatcagtggaaccaaatagagaacccagagataaattcacatgctcacagtcaacttatttttgacaaaggcaccaagaacatacattggggaaagaatatcctcttcaataaatggtgctgggaaaattggatatccatatttagaagaataaaactagaccctatctctcaccatatacaaaaatcaaatccaaatggattaaagacttaaatctaagacctgaaactgtgaacctaccagaagaaaactttgggggaaactctccagcacattgctctcagcaaagatgtcttgagaaagacctcaaaagcacagwcaaccaaagcaaaaatgagcaaacgcaagtgggatcatatgaagttaaaaagcttctgcaccacaaaggaaacaatcaacaaagtgaagagacaacccacagaataggagaaaatatttgcaaattacccatctgacaagggactaataaccagaatatataaggatctcaaataactcataggaaaaaaatcyagttttaaactgggcaaaagatctgaatatatatttctcaaaagaagacctacaaatggcccacaggtttattaaaaaatgctcaacatcactaatcatcagaggaatgcgaatcaaaacttcagtgaaatatcatctcaagccagctaaaatggcttttataaaaaaaacagtaatggatgctagcaaggatgcagagaaaggggaactctcatacgcwgttggtggtaatataaattagtacaaccactatggagaatggtatagaggctcctcagaaaactaaaaagagaactaccataagatccaggaatcccagtgctgggtatatacctaaaagaaaagaaatcagtgtatcaacaagataacccgtactctcatgttcatcggagcactattcacagtagccaagatacggaatcaacctaagtgtccatcaacagttgagtagataaagaaaatacrgtatatatacacaatggaatattattcagccataaaaaacaaagtcatgccacttgccacaaaatggatccaacattatgttaggtgaaataagccaagtacagaaagataagtattgcatgttctgtctcatgtgggagctaaaaaaggaaattgatctcatagagatagagaatagaatgatggttaccagaggctgggaaggatagtggggaggagggaataaagagggattggttattaggtacaaaaatacagttagatagaagtaacacagtctagtgttaggtagcacagcagagtgactgtagttaatgatttttattatatatttcaaaataactagagtggaattgaaatgttctagcacaaagaaatgataaatgcttgaggtgatggaaaccccaattccctgattcgatcattatacattgtacgcttgtatcaaatttcacatgtacttcataaatacaactattatgtatccataaaaactaaaaattaaaagataaatctgagcaaaaaaaaatccaaacacagtaatttcagataatgatacatgctataaaaaaatgtgaaaaggaaatgagaaaagccctccttactctgacagaagcagttgaagaaaattcaccgtaagagctacaattttggcagaggtgttaatggaagtgctaaaatgatttgaggaattatttgtacacatatacgtgtactgtagtatagtgtttaagaacacaagctctggagctacaccacctaaattcaattttcttttcttttcttttytttttttttttttttttgagagagtctctcactcaggctggaatgcagtgtggtgatctcggctcactgcaacctccgcctcccaggtttaaatgattctcctgcctcagcctcccaggtagctggaactacagttgtasaccaccatacctggctaatttttgtatttttagcagagacggtgtctccccatgttggccaggctggtctcgaactcctgacctccagtgatcctcctgcctcrgcctcccaaagtgctgggattacaggcgtaagccaccatgcccagcctacactgcctaaattcaaatcttagctcctcactcacatgctttatggttctgcacaaatgactccacctctgttccctcagctgcaaagtagtgataattgtgtcgcctaacctacagaggtgtcatgtaggttcaatgaaataatgcatggaaagcccttcaacagagcctggtgtgtggaaaatgctcagtcaatagtagctggttttattgttcatgtggactttattttttaaccatctcccatcttccctttgctttttcagctccagggtttgagccacaatgtgatcttcaccttggattctttgttaaaaggagacctaaagggagtcaaaggagtaagtgttcagaaatttgattttcactttaacttgaaaggattaattttttttttcctctttcaagatcatagtagtacttgtatttgaaagactcyttgaacattttcagcgttaaaaatgctcttggaaaatgatcattggaaaaaatgtgcctcttcacataatggtattgacagaggaatgagattaggcactttcaagaagattgggaaggtcctccatgggtgggagagagaagctaagcccgagtcttggctcccacagtgtgaccactggggacccagcccttctgaacctcgggctcctgcttcatcagcatgaccagggcgcttacccttctttcctctctcaggcttcttgtgtatataacacatggtttgatgttggccaggcacagtggtcatgcctataatctgagcactttgggagaccatggcggcgggtaaattgcttgagcccaggagttcaagaccagcctgggcaacataataagacccccatgtctacagaagaagtacaagaattagccaggggtggtggtgagtgcctgtagttctagctactcaggaagctgaggtgggaagatcaattgagcctgggagttcaaggctacagtgagctgtgattgtggcactgcactccattctaggcaacagagtgagaccctgtcaaaaaaaaaaaaaaatggtgtaacgtgcataaagtgaagttcccagtgtcctataaaggaaacaattcttgctaagatgtcatttcaaaactatttattaattttcagcaaaagtagttgcaattttaatctcattttctcgtttctaaggatctcaagaagccatttgacaaagcctggaaagattatgagacaaagttgtaagtggttttttgtttagagtttttgtttgttttttaatattgttgtgaattttggacaacaaaaaaaaaaacttaactggaaaaaggacagagcccttaactaataacttctcaacaaaaacctgtttagtatatcctctagcatatccttattagggctaagaggttgggtacactgacctaaagtggttgcatgtcctgtgctatttgtctgaagggagaggtacttttactatcagttgttctcgcatttatggctgctagtactatcaagttatagggctatgactctcattatagatagcatgtaattatggaccatttatgtttctgtatagtataaaaattgggaaataatagaagtaacagctaatactgtgacatcttggtgcctgccaggacgtgcactaagtgttttttgcatgtatgacctcttcacaggaaactatctgtacagctttactctctgtttatatacatcagggaaactgaaacctggagaggctaaggggctcatgaaaggctagaaagctagttatgtgtccagctagcattcactccaggtctgtcttgaccacagagcctcagcatagcatgggcactgaagtcagaccaccaacctcgtggagttcttgttagggattaggacaataagcactttgcagggtgctcggcccatctcgatactgtgtgtatcataccacattcctttattattattaccctgagacatttgtaacaccaagcagtagggtggggtgggaggagatatgtatttttaaagcttttaataaaagtcttggacaactataaacataagagaataaaacatttctgtaggcagcaatagcagcaggataaaaacaagcaaaagaaaaacaaattcaggattaaaaaaagtagtttttcccaaactacttttgtaattatgtgaaaagtgcattgttagggacttgctgtcttaggaatatatccgtacattgacagttctaaatgcagcagagaacaaaaacgttcttaaaatggtcaactgataaatgaatgctgtgggctatgagtctttctgtatgaaaagtgggtcatgagtactcaacttgtaagcgaagtactgccgctgcccagagacaacagtgcatgaacttggaatggaatagaattaagtacttagaaaatggaaggacaaagggggaagaaaaaaaccttgttctacacttgtagaatatgtcttctttgtaggatataggaacaacgaaacatgatgtaatatgtgctttgtcaactaaagtactaccaatattaggtagtacaactttatttatattttttaaatctctgttggctgaagacctagaagtatctggtgcttagtattataaatgacttagaatataaagcattctaagatggtacaggtgctcttccttgtacttctcactcaacatatgaacttgtctggcttttctttttttttctttttctttttctttttttttttttttttttgaggcggagtttcactcttgttgcccaggctagagttcagtggctcaatctcgtctcactgcagcctctgcctcctgggttcaagcgattctcctgcctcagcctcccgagtaattgggattacaggtgcctgccaccaacacccagctaattttttgtatttttagtagagacggagtttcaccattttggccaggctggtctctaactcctggcctcaggtatccacctgcctcagccaaagtgctgggattacaggcgtgagccaccatgcccggcctggctgttcatttttctgtattgtcctctacaatctaaatttggtgaagaccacaaccacattattcttatatatggtgttattctaccagtgcctaatgactcatagtttatgtactatttcattgaagaaataaaagaattattcagacctggaaatgtataacaggaatagcaagttgagtgcctcctgaatttaagaccttatgaaggcaggttttgtttgtttgcttagtaaatccctgtcaacaattttcctgagatagacttctttgtcactaaagtatagtggtgcaggaaagaaagaaaacaagcatttgtctctttgatgtactgggacttatgctgttataagttagagaaaacaaaatgactccacacaaaaaagttcatttattagttttgataatggagaaggctggacattttctgtggtcttctatttggaactctggaggcagtgaagtttgtaatgatttagatcacagacttagaaatcattaccagttttgtgacattgagccaaaatacttaattttgatgatccttacttgtaaaataatataaaaattacctacttctcagggtttttgtgaggacgagataaggtagtgtgttgaagcagttgtcacagtgtttagcatagggaagtcacacaataaatagtttctastaagttctctttaagaatcaaatttcatttggtcaaagtgataaatgtacgtaaactaaaacatcagatagtgcttttactagttaagacttactctgtcagcatgtaatggaaaccccaaataacagtggcttcaacattgttaaagtttatcatagaacagagcattctaggatggaccaggtaccctttgtagcacttctcacttatctgtattgtcctccacaatctaaactcagtgattttatgtcatacctaatggtacagggttctttacaaatcatgacagggaaaatattaagtaggcaacaaatgtgcttctaatggaaacacagtggccktctgcctgcccctcttgatcctgttagtccctcccctttttccaactcttttacctgcttcctgacttatctacacgttcctcagtattttcttgctctttctagctttagctgtgatgtattgctgtggtagacgaggattacattcccttgcatagacaccccatcactttcgcacccttgttcatccattgtggttaatagaacaatttttattaaactagtttcagtgtttacatttttataggtataagcattcattgctaatctgaatggtagaataggattgaatttctgttcttagagtacagttgtttactttttcttaatgacataatggcctcatttcttcatttgcttagttctgtgtgaatcttctgtgaattcttatctgctctagcagatgtcagacacctgtcaataatatttctgtttataaagtacattatgtattttattagcatgattatatatctattagtattaaattgtgtcagcttcttctttcctggagacatccctttgcagagctctttagatcagcagtacagctgccatcctgggatggcgtttgactctctttagttttaaatctaattcctcttgactagtatagttccatattttggtggcccattacctccagtagttttcagagaacagctctaaaggaggcaaagagtttaggttttgtgtttccaaaactatcttcattctgccaccacaaaaagtgatagttataaatcatttttataaaagtggtaaatcagtataaaatactgattttataataattttcaggcacggtggctcatgcctgtggtcccagcactttgggaaaccaaggtgggcaaatcgcttgaggtcgaaagtttgagaccagcctgaccaacgtggcaaaaccttgtctctactaaaaaatacaaaaattagctgggcgtggtggcgggttcctgtagtcccagctactcaggaggctgaggcaggagaatcgcttgaacccaggaggcagaggttgtagtgagccgagatcggaccactgcactccagcctgggcaagaaagcgagactttgtctcaaaaataataacaataataataataattttatctctaaatgttgaaggcattgttccattgttttctactttccagtattgctaataaaaaaaaaaatctgatacctttctgattcccatttatttgtatgtgatatgtggttgttgtttgttgcatttatttttggttagagaatgtaaggtcttgtctctgtaaaaggttttacgaagagtcttcaagtgccacggtatgtgcattctgtttgcaatctttctgtttacaagtttgagttcatcactcctggaaacttcttgtaattcttcctgttttttcttttattcctctttcgggaattttcattatataatatttgacttcctagacagttcttaaaattttcttctcttttctgttctatttatattatattttaggttattttttcagtgttttttccccactgtttcagttagcttttttattttggctgtcattttaaatttctaagagctcttttgctcagttgggtttttttttttttttttttgcctttttatagtttctatttcttgtttcatagatgcaatattttagctgaagatttaatgacattttgtaaaatgttttatctgcttccttagtgcctctggttccttcccaaccctcccccttttgttattaatactttcactctcactttcattttggagacttataatctttgggtgcattcatatttcagagcaaggtacccaaagactaaaagtttatatgcatcattagagatctgctttctccaagaaagcagaaagccttctttttaggtttcaagttttaggatgtgaaggcagctcttttattaggggttttccaaatgtcagtgtctgaggtttgtctcagaaccttgcagttctttcacgctcctgcttagtaatcacatatggtggcattttggaagctatgtaagtgagggagacagagaaccctatagtttgaggtgctctccttctctcttcagccttgctcttccaaatatttattgaattccgtcatccttttttgtcttcaattctttctttgggagattatctgttcttatgcctttactctcattttagtgggatcactggaggaagaagaaataaagacatgtatgtttaagtcaccatggtaaattgaaaggcttattattaagttatgcctgtccctccatatttcttctcttcccacccacatcagtggagaaagagctgagatttattctttctgttaaaatccctgttatgcctcttcgactgccaaggtggcatgattaaagagtttcttaaatataatagcattagggtattagagtcaatcccgactgggtttataagtagatttttcattggcttgatcggtggattttccactatgtctgtgtataggtaaggatgttggctttcttcagagttggtttcccctaccaccaccataacttaaagaagacttgacggataaatcagttagtctttgcattcacagctagaaattacaggttgtttctgaaattagaagtccattttcaggttaatgatttttggaaagcaggctataatctttggtattattaccagagtatcatctatcagagccgagcactagcgtcagctactgtatgtttaatgtgggcctttcttctttatcacctcgtttcccctggccccctccccacacacagaagaacattgtgataggattccaaattaggatttcttctgaattttgtacattccagtgacaagtggttgactgattaaaatgtattcttggaatgtggaaatagctcaagtttagaggaatgttggaaattacctttgactaaattttgtgcatacccacaaagacccattatatactttaattatttgaaataattgaagtcttgcaagctgtcgatattcaaggaaagcctcatgtctccaactttctgattctttttttattataaagtgctttacccaatagtaggtaaactatcaaaatttcttcatgcctaccaaaatttaagagaatgtatatgaatctgtcatgtgtaagatcaaaggaaaaatgtaagaggtttccccatatgaaaatccatacagtgtttgtgttctgtttgattgtaggcttttacttctgattgattctaccaacttaagaattcttgccttttaactttaggaattaataatcagtggcttttgttaacgggaagacatgagtgtggtttgtttttagtagacttccttcttgagcagaagatacaagagagttcccatatgctccctccccccacacatgcacagcctcccccgttatcactgacccccaccagagtggtacaattgatacaactgatgaacctacatagacacatcgtcaccccaaatccatagtttgtattaggatctgctgttggtattgtacatgagtgtatttttttttttttaaataatgacattggctttaattacagtacaaaaattgagaaagagaaaagagagcacgcaaaacaacatgggatgatccgcacagagataacaggagctgagattgcggaagaaatggagaaggaaaggcgcctctttcagctccaaatgtgtgaagtaagaatggacttttccaccatttgcctagaattataacaactgtgatcttttcctgctagtcagcagtctttatgcttaaaggcagactgtgtttgattattagagaggaaactgtttcttaaggattctaatctccatttttctccaagccttttgggaacctgccattgcactgttgtctcatattttgagccttggccctatggggctgtttaagccaaaacaggattctttggtgagaaccttaatgttgcttgtgagtggttgtgggaggaaaacattggtgagaggtaacactggtgaatattaagttttattggtgtatgtttagagcatgtttttttaaccatatgtccagtttgaatgaaaactcaaatgaagttgtcattaagaaagtcgatttcacgaaaaatgcaacaaaaagcatgctgccttaaacttagagcagtggttctcaaactgaattccaattgaacatgaacacttcttgacctagaaaccaacctgttctgacacggctgttgagtaagagtttcttttgcagttttcagaaaatattaaagtggagaactttgtcaaatttttttccttccctagatttttttctcctttccttttccttcttcctcgctttctctctctattccctccttctctttctctttcccccttccccttccccttctcctccctccctcccttccttccttccctccctctcctttctttctctctctctctttctcacctctctctctctcattctctttctctttctctttctctcttttttctgtttcataaccctttggctccttgagtttgtgtgctcatgaacctttttacagaataaaacaagtgagcaaacagtgtcaatagaaaatcttgaccagtgcacagtacaagtacactactgtgtttagttacctcaataaattagtgggttattcttacttttattctttaatttttgagtagtaaaaattctttctgattcacctctttttcctaaagtttcaatatcctatggtatattctttgatgagaatgctattctgcgtactttctgcaaaaaacaatcaatctttccagtttttgaccacataaactatacgtttgagatccactgcaccaaggggaaataataattctagaatgttttgctgtgttttatttctgcttgtcgagtaaactaatcataaaataatttataaaatgctaacactctagtcaatttgttttgaacactttgtgactgcgaaatcagcattctctaaactgtctaaaggacaccaaggcttggtaacttgtgcagattcaggggtgatgttcagccacctgaacccatggctgaagagccccatctggaattaatcaacgcaaaaccctgttttattttcacagtatctcattaaagttaatgaaatcaagaccaaaaagggtgtggatctgctgcagaatcttataaagtattaccatgcacagtgcaagtgagtagaatattgcaagcattgttattagcccaattactgccccctgtacttcattatttgtcttaatcctcttcatatcttttcttcatctcgtgactaaataaagtgatataatgacctttttcagctaaatggataagaaatagtgtcttccatcttcagtgttttatacaaatcagtagctcaaattagggcttaaaaatattgtcttccttacaagaagacaaatacttacaaatacttcttcctaaatttgatcgcctgtggagctcttattacagatgcatgatcccctgtcactgaagagtcctttctgatgaccccctaccctgactctcttacttggcattttgcctttttttttttttcctttgagacggagtctcactctgttgcctggctggagtgcagtggtgcagtctcggctcactctaatctccgcctcctgggttcaggcaattcttctgcctcagcctccccagtagttgggatgacaggcgcacgccaccacacccagttaattttttttttgtattgttagtagagactgggtctcaccgtgttggccaggatggccttgatctcctgacctcgcgatccaccttggccttggcctattattgcaccatttgcaccatgtatttccacctggagtcttcagttttgttttgtttcatctaaaataagtgaatttaaatagttggggcattaagaatactttgcatttgtacatggattcctatataatttgtgttacattttgagaaataccattgttctacactggcaccatttttgtttgcctatattgcagggctatctttttgttatgtttgtgattctgtggtgccacatttgcttgtttacttattgggttaactttcatgggttttctggtagagtctgtgtgtgaaaatgtgccagctacacatggagactctaccagaaaagtaaagtctgtattagtaaagtctgtattcgttgatggaagttataccgaaaataatgsaaggaccttccagaaatggaatggacagctctcataagcaaaataatgtaaaggtcgtttggactagataaaatactctcaaaaaagttaaattcataatttcctttgatctttcttattcttttcaatagttatatttagaaagatacctgtattcaactraaacatttaaggaggtyagcattaatattatgtcaaaagcacaaagcttgggttagacaaattagatgagtcaacattttggctctgcagctrgttaactgtattcttaatcaggtacttcactaaacctcagtatactcactcgtcaagctgggttacgattctgtagcaaccaccttagggtttttgtaaggctgtaaaaagtgaaaaagaatgcatgtggagtgcttagcccagtgcctgcgaccttgtatgtgttgacagctgtgatgattctaagtggcatttaaaattatttatttatatattttattgtctaggatatttctcttaaggaaaacctttttgatgatcaaattgttgtttacataaatttgatgataactttttttcaaagtaaattgtaccttatataagtgtctttcaaaaataaaaataatatattgaagtagaaagttttcaccttcttaagattaagtttgtttattgaagacctggattaactaacttacttttggctttgtagtgtggttgggcagttatgaaactttggcctgtgttctaatggtccctgattttagtattgggtggaattttttatctttcatcaaatttagttttcctggaaacatttaattcctttgaaagttttaaagaaataagtgaatctctcagtctcctgaattctgcagtactttggcagcaaaactgatttcacctgactttagaaatctattttcacgttaaattctctaagtttataaggaagagtttggcctacacaaacaagagtttttcaaaatagaagatgctttgtaaagtatacatatattagccttcgctagtaatggtgatkctaacttgtatagctaatgcatcctccctttattctcttattctttgctttttccctttccacaaatatgtattagtcttttaccaaagatcagctactgtgcccagttctgggacagagataaagcaaggcttttccgctcaggagttaattgtccaggtataggaagtaagtcagatccrttattaatcataatggggctggacagtgacgggtaccatggagcatcaagaggaagagagacggctgggcgcggtggctcacgcctgtaatccccgcactttgggaggctgaggcaggtggattattagattacaggagttcaacaccagcctgaccaacatggcaaaaccccgtttctactaaaagtacaaaattagccaggtgtggttgcgcatacctgtaatcccagctacttgggaggctgaggcaggagaatcgcttgaatccaggaggcagaggttgcagtgagccgagatcacgccattgcactccagcctggacaacaagagcaaaactctgtctcaaaagaaaaaaaaaaaaaacaggaagagagacatctgaccaggaggactgaggagaaggtattagcaccttgaaggaggtggtgggacttgtcattgaacttggaggatagctaggattttgttaccagattgcaatctggtagacgaatgtcccctaggtcagagagagatcatcagaagaaaaccctacacagtaaaaaccttgtagggagagagatgttctgagacatcaagtagtagaaccatgttataaggggattcaactaaaagttactccatggtggaaccccaagaactctatcatagcaagaagccagagtagtttcctttattcttttctacttctgtcagttcctcaaaactcttaataggcatattgtatggacctgttaagcattctctacgtaggtgttttttgttttgttttgtttttaagatttattcttctcagtacttacttcagttcccaaagtgattttcagtacaaagtcagctggtattcaacagtgaatttgcctaggtagtaatagtcacgacacttccgtgtggatgaagctactacactggagaaataaataaagggaacagaaaagaagggcttttaactgtttccaactcatttcagctcactcactaattactgctcaatttcagacatgaacattgtcgggaacatgctgctttccaracagacatatcctccagttcacctgctccttttacctcctcacaagtgtcattatgacctgcagagttaacagcatttataaacattgctttattatctgkcattttacagataataagaataatagctaacatttaccgagagcttattttctgggacgaattatataggccctgcctctaagttccttacatgtgttttctcatttaatattcccaacactcaagaagttgtagctcagaaaggatcagtattttgctcaaagtcatgttcattcatttaataaacgcttagtaaatgtgtcaaagcagacaaagtaagcacaggaaaccaaataaaaatataaattggacttcaaaattaaaaacttttgttcatggaagtatattatcaagaaagtaaaagacaacccacagaataggagaaaatatttacaaaatatttttctgataagagtctgatatccagaatatatwaaaaaaactcaacaacagtccaggtgtrctggctcacacctataatcctagcactttaggaggccgatgcaggaggatcacttgagcccaggagttcgagaccagcctgggcaacacagggagactctgtctctacaaaaaataaaaataaaaaattaccctggtgtggtggcacacgcctattttcccagctacttgggaggccaaggtgggaggatcgcttgagcctgggagatcaaggctgcagtgagccataatgacttactccagcctaggcaacaaagcaagactctgtatattaaaaaaattgtacacacacacacacaaatggccagaaaaacacgtgaaaaggtgctcaacatcattagtcggtgttaagtacaaatcaaaacctcaatgaaatagcacttcacacccactgggattgttgtaattaaaacaaaaaaagtcttggtgaggatgtgggaagattgcaacctatgcattgccagtaggaatgtaaatggtgcaacttctttggaaaacagtttgggaatttctcacaaagttaagcatagaattatttaaataaaatgtgtacatgaatatttataacagcgttatttacaataaacaaaacacggaaacacccagatatccatcagttgataaaaggttaaacaaaatgtggtatatcaaaatggaacattgttcagccacaatgctgaatgtgaatgaaatattgatacatgttacatatgggtgaacatttaaaacattaatgctaagtgaaagaagccagacacaaaagatggcatatgttcactaactcagcagctctctaaacccctttgtttagaagattttatagaggttttattacataggcatgattgattaaatcattggctgttggttattggcccaatctccagcccctctgccctccccagaggtgggaggaggggtggggctgaaagttctgaacctagttgcatggttggttctgtaacgagactaaaaagagattccatgaattgtgtataatagtgcggtgactggtacagagtaaatactcagttacatgttagctgccattactgttactgttactggtttttgaagatcttgttatgttacagtaatttatagagaaagtggctaagagatraatgagacatcctcgaggtaattttcccttctatttggaagatttatgtgttaagtgtagtgataggtagtcagaactcacacatrtgcttcactttccagctaacaacacttttatctgtagtagctcatctgatgctccttgaaactagaaaatgtccactttggagatgagcattctgttattcagacagggtgaataactgcccaaggttaccacgtatagtaaggtttagagccaaaatataaaatatgatatggttttgactcctaagcctttttttttttttttttttttttttggagacggagtcttgccactctgtcacccaggtgggagtacagtggcgtgatttctgctcactgcaccctccacctactgggttcaaacatcaagcagtcctcctgcctcagcctcccaagtagctgggactacaggcgcatgctgccacgccaagctaattttttttttcttttttttttagtagagacaaggttttaccttgttgcccaggctggtctcgaactcctgagctcaggcaatctacccatctcggcctcccaaagtgttaggattacaggcgtgagccaccacacccggcctttttatttttttttttctttttgagtcagagtctcactctgtcacccagcctggagtgcagtggtacaatcctagctcactgcagcttcaacctcctgggttcaagcgatccacccacctcagtctcccaagtagcagggactacaggcatgtaccaccacgcccggctaatgtttgtattttttttgtagagacagggcttcaccatgttgtccaggctggtctcaaactcctgggctcaagcaatcgtcctgccttggccccccaaagtgctggtattacaggcatgagccatgtgtgcagtagcccttgcatgtccactgaactaggaygagctaaaacagagagaagagagaaaggaggaacagagaagccactgccctctgtgaaatgttttggcaggtcrtggtggctctctgtctaccctgtccacagctggaactgtgaccctcaaggagaagagaatgaagctcagagggacagtgcagatgacagcatgtcaccctttgctttttatggtgtcactgatacattgctaatgactgccatggttattttattcttctacaactcgtcctcctttcctgctcctatttcttaccaaaactagaacttggccctccctgaaattactttctgcaaggggcttgcctccaaattgttcatcccagagaaaatgttgactctttaattttgttttaactgattaatacgtgatatccttaagaaaaaaattagaaactgaagttaaggaagaatgaaaaaaccctgtaatctcctcacttagatgattactagattcatgtatctggtttgttttgtttacaaaaatgggattatgctacagattaaagcaattattacattgatttttcttagaatctgggtatgtaacagtctgaataattgaagcagaaggaaagtaaatttgtttggagtcttcagccttgtaattggcaggaattttcatttttatcagtgccatttcaaactaaaacagttccgtctttctccctaaaatttataatgtgttcttcagtatttcttttgtgctgttcaaatatttgcttattctttttctagagtgttgtccagtagaactttctgctatggtggaaatgttcatactctttaccatctacatggtacccattggccacacgtggctaccaagcacttgaaatatggcttatgagtcttcaggaacagaatttttcatttaatttttaatagccagatgtgactagtggctaccatattggaaaacacagatgtagagcattctcattgaaactcacctttaaaaaaaaaaattgggaagagatttaattagtgttctcttatttttaaaaaawgtttatttcagtagtttctggagtacaggtggtttttggttacatggataagttatttagtggtgatttctgggatcttggtgtacctgtcacccgagcaaaactcacatttttttaaagcataaagattaaattccctttatgttaaaagtgaaaatgaaataccttttcaaaaatatctacaaagaatctgtatccctctgcaaaggaaacagttccttatatgataaagttatgcagctccggggaagagaatgatttcttgagcacatgctaactgccccacactttgctgggtagtttcacatgtcctatctgtattatttgcccatttacacatgagcaaactgaggccaagagaagttaaatgacttgccagaacacagattcttggtcataatcatctgaccccaaagccattgcttcttctgttgtaagaagtcctgacaacatccatcttaaatttaaatgctctaccttcaaaacttttctccagaaatcacttaagtgcagtatcagagaccaaaacagattttgctatgattaactttgtacccatacttttaactcctgggcatatatcccttccttgatgtagaggatgctggtttcaggttaacacttatagatggcctgctctgtgcagaacattgccaacctctccaggtctggcacttaggcctgggcccacatgctcaatgaagccgctgctttgactatcaggtctagagaatactgcttatggggtagcagccgagctgagtcttgataaaagagagtttggcaggcaggttgatagggtttggctccatgtccccacccaaatctcaccttgaattgtaatttccataatccccacatgtcaagggcaggaccaggtggagttaattgagtcatgggggcagtttcccccatgctgttctcttgataatgagtgagtctcaaggaatctgatggttttttaagtgtctagcatttctcctgctggcattattctctctcctgccgccctgtgaagaggtgccttctgccatggttgtaagtttcctgaggtctccctagccatgtggaactgtgagtcaattaaacctcttttctttataaattactccgtcttgggtgttccttcatagcaacatgggaacgtactactacacaggtatagaggggaagggcattccaggcagagggaatagcatatgcaaaggctgaagtggggaaggatggattgaaaaagaacaggcaactagaaataatgtagcatggctagaccttggagtttttaagggaaaatggtaagagataaaacagaagtattcaagggtcagaacgtaaacttttaaaattctatactgagaagttttacttgcatcgctataggcagtgccgaaaacccaaatgctagaaaataagggtttaggccaggcacggtggctcacacctttaatctcagcacttcgggagaccaaggagagcagattacttgagtccaggagttggagaccagcccaagcaatgtggcaaaaccttatctttacaaaaataaaaatgagccaggcatggtggggtgcctctgtagtcccggctactcagaaggctgagatgggaggatcacttgagcccaggaagtctaggcttcattgagccactgcactccagtgtgggtgacagagtgagaccctgccgagagagagagagagagatgaggctttacatgtgttcatgtatttttcagttaaatggttaactaaaaggccatttttatctctcatccctgttgctgaaaaactttctaaaggtagtatttttcttctttatttcaataaggtttctttgccaaagatgtcagccttaaaaaatgttggaacttgtaggatttcagtaatcattctgaaggccacttctaatagcctgtgttattgccactgaacactgaatatacatattaagcttaaaatatgtctcttaagatatgccttaagctgggcgcagtggctcacacctgtaatcccagcattttgggaggccgaggtgggcagatcacttgaggtcaggagttcaagacgagcctgatcaacttggtgaaaccctgtctctactgaaaatacaaaaattagcctggtgtggtggcaggcacctgtagtcccagctacctgggaggcagaggtttcagtgagctgagatcacgccgctgcactccagcctgggcaacgaagagagactccatctcaaaaaaaaaaagatattccttaaaatgtcttgatattgcttcattcagtctgctttgtgttgggcccactgtgatagggagatgagayagtcctcatgctcaaggtcctcgttgtttgtagggagacagcaaaacagrtagtgttttgagaaatagtctgctgtagggacatggttagagaagcttccaatagggcagagaaaattctaaacacgttttctgaggcatattgtttatttttctaaactgatatcagagactgggttcctgagtggaagtgtgccacctgagacaagaaatcttcacttgctggtaaagagcgtggatcagaatctggcagacctggatctgaattccaccagctytgctgcttactagctgcaacttaaccaagttttatacatactctgtacctcagttttacaaatggagatgagattgaagtgctttaattcattagagttgtgtacatgaaatcacttgtgtaaagtgttcagtgcagtactgggcatgtgctaaatgctccacagatattaattcttgttatttttcaggtgaagtcatgcaaccatgtgttgtaggataaagctttccaaacccgttggtattattgctttgaattcttgtgtttcaaatatatgttggaacacagggatctttgaggaactgaatgaattttgacttttctcctgcctttatctgtagttccatcatatttctctttatagtgtccagatcaacctcatgatattccactggttaatgtgtccttctctctccttcaaattcaaatatggtttaactgggaagaactgttctatgtatagatgcatatgtacgttatgaaatcactgttttgggactgcaactgtaatttccagtgtccttgtgatatcttctatcaaatgtcaactgacagccataatttatttgttggtacatctttataaaaatgccgtaattagttttataactgtcttgtatagataaatccatagagaatgagtatatatatacagataagtgtattttcagattttgtaggttattatagttcctttttttatttccacataaggaaacaaatactcttttttttttaatactggtggtaaatctctgatttttttaattgtagtttctttcaagatggcttgaaaacagctgataagttgaaacagtacattgaaaaactggctgctgatttatataatgtaagttctttataaaatacatgcagtttaacttgctttcatggataagtttcagtaaatttgaaatctgtattagaaaggtgttaaaagcagaaaagattaaatgatatgtctgtacaaacctaggacagataacccttcagtttaagtcagagaagtcatcgatggtcaaatgctccagagtccttctggggccataasaggagcagggaggggagtatwcagccatcagttccagatggttctgcatttacgattcagttagcatcacatttgagtgttccttggtcagcagttgcagaaagaatgcatgattgtggaaggataaaaattgactctgaataggcaggtttatagagttttttggggtttttgtttgtttgtttctgtttttgtttttgtttttcagagtctcactctgtcgcccaggctggagtacagtggcacgatcttggctcactgcaatgtccgccttctgggctcaagcaattctcgtgcctcagccttttggtacagatggggtttcactgtgttgcccagactagtcttgaactcctgagctcaagtgatccacccgccttggcctcccaaagtgctgggattacaagcgtgagccaccacgcctttgatttataagggtttttgttttgttttgttttgttttttgcatgttttatattatctctctttttttagtgtctaggtctaaatgtatatattagaaatggtaaagttgttgcccaaaaatcatttgggggtaaataaaagcgtatatattatgagtatgagtaaatatcctcaaataaagttttataattacaaagaatgccttttatataactttaaaaatgcatagctatgtattttttctgattttcttttagtagttaacatggttcaggttacagttaagtcccaagtggttaaaaaaagcagcactgatcccttgtccccatttcatgctatgtaaactttgatgtatgcattggcccattagactcctggtcattcttaggattctctcctggaccatttaatcacattatggtattttcattaccaccctttgaaaaaccagaagcaaataatctcaatgatataagctgtttagaatagtacttcagagttaactatctagcttagataggttatttaataagaatgcatgttgcattattcactaatttcaaaacccactgctgcttttataagatgagaaatatcatatcaaaaatgagacagtataaaggacttttagtaagaaaaccaaatatataatagaattttgatgagtggtatttttggataaattaaactctgcctgtgaaagtgtaaatggtaagtaatagaagtaatttttttttcatagataaaacagacccaggatgaagaaaagaaacagctaactgcactccgagacttaataaaatcctctcttcaactggatcagaaagaagtaagtggtttacatgtttacaacagggctaacagtgtaggtaaggctgcttgtaataccctttgtgtttcctgatctgcaagacaggcacagtgatatataatatgcaagtatgtacctaccataagccccatgtagaaactgtattttagttccttttccttgcttataggaaagatgttctgggtatccaattccatgactctggattttttttttttcttttttctttacttttttgagacagggtctcactctgtcacccaggctagagtgaggcggcaggcacacttatggctcatcgcagccttgacctcaaccattccacctcagcctcccagggtagctgggactacaggcacatgccaccatgcctggataatttttgtattttttgtagagatggagtttgaccatgttgccctggctggtcttgaactgctggactcaagcaattctcccacctcggcctcccaaaattctgggattacagacatgagccactgtgcccagccccatgactatagattttcaatcctagttttgargacatgcacttcaggagcatatgctgaaacatagtacattctacaactttcctctttagaccacttctgtctttctgggcagccaaaacaggcatgtctcatttgccagggaaatattttgatgcagaatcctacagaagctttgccccacaattaggaaatttgaggtgagttggtccttggatattgaaagagcatagaatgcatggtagaggctggatgaatgcagtacagatccttagttataaatgtcatttgttcaaacatttcattaacacctgctgtgtgccaggcacagttctaggtactaagctttagtccctttcatctagtagctcattatctagtcagccatatgaacaatccatcatgcctaaagtggtatggatactattagagatacrttggaagatgactgcagccagacagaaacctacaagacccagagatggaaaactccccagcatattcaaggggctgcagacattttggggcaggatgggtggaggagtcagaaatgcagtttctgaggtaaaaactcagamctgactacggaggaccttgggtgttgtactaagggacgtagacttcatgataaggataaattaaacagtaagcaccatttgttttctgggagaaattaaaaacgtgcctgtttttgttatgaaattatgggttaaatttaagagcagtggctcatgcctgtaatccaaacattttgggaggccaaggtgggaggatcacttgggcccaggagtttgagaccagcctaggcaacaaagtaagagcctgtgtctacaaaaaattttgaaaaattagccacgcatggtggcatgtgcctgtagtcccagctactagggaagctgaggagcccaggaagtggaggctgtagtaagctgtatttgtgtcactgtactccagcctgggcaatggaggaagaccctgcctcaaacaaacaaacaaacaaaaaatgaagagcaatatttaataataataacatgaaatacagcatttttatagtcagtttttaaatactatcacacaacaatagcaagttcacttattttaatttctaaaatttctgaaaggggtttatgagtctaaaacaaaacaactcccataaaacatgggaagccctgcactagtgacactaatcttttaaagcaaccctgaaggttttctttattgagtgaatataagcctctatttttctggttctccaaatccaggtatatgcactggggattggtcaagtgagagaagtctatagcactgtaacactaggcatctgctaacctgtggagtaggcagagtggccaggaacatctgtgtacactaaggcagtttctgcatccatgtcattcagtctcaggcagtgactgcacctgtggtttgaggcctctgactgtgatttacaagaatttccaagtattagacccccagtagacttcagactgaagcacagatatgccatgcatgccctttgaaggtgcttattactgacacataaatcctaggagaaatgtggtctctttgaatgatttctcagtgtaagagcattaaaaagacccaggtagaagggagtacggggtggtagatttcagtcttgggagaatattgtgaggttttttggggtttttttgtttattgttgttttacttactgtatgtacttaaccactccctacctttgttttgtcacacagtattacctctttcctacatatggaagctttcttgaaaaataaagaggaggactgttacaacccctttttgttttgcatggagacttaagtgttccgctcatgctagctaaagaacaaagttgcatataagccaaaggaatgtgtacatgatgaaatgcacatgatttgatttaaccccaccccagattaataaatgatgagttttcattagtaccttgcatcacagagttttacaagtaatacattgatctttcacaacatgcctgttcctttctcatgctgtttatcatcactcattgcagaatatgtttagaagatagtgatttttcatgactgagattaaatgtgagaggagaccatccacagagagttctgaccatggtactatttgaaaagaatgtcaagtaatcttaaagattaactgaggaatcaaaagcacccaacaaatcatttagcctactcatccccaccgggttctaacttggctccattaaaggaagttccaagaattttagttgtgaataggatccctggaatttcagtaaactcattttttttctattaagtttttattgtcttagcaaataaatgttctatgaaattatattaagcttttgtaatagcttaatctacaaaagaactatttgctatataactgtttttagagttggaagtaggtttttgttttggtttttttgagacggagtctctgtcgcccagactggagtgcagtggtacaaatctcgctcactgcagcctctgcctcccaggttcaagtgattctcgtgcctcagcctcccaagtagctgggactacaggcatgtaccaccaygcctggctaatttttatgtttttagtagagaccggggtttcaccatgttggccaggctggtctcgaactcctcaagtgacctcaagtgatctgcccgcctcagcctcccaaagtgctgggattacaggcatgagctactgcgcctggcctgaaagtattttaaatggtgataagtcatatttaggatatacagaattattccaaaaattacacctgttttgtttgaattcacttatggactcttttaaaaccccatcacattatcgtttgcaggtttgacagattctttgtttctgttttactcatgtcacagtatctgtcctgtagcctggtcccagaaaactattcaaatatttagaaaaatgaaacagaaggaatcttttgcccactccattgataccttgcattagaaattttaggcttctgtagtagaggtttagttttaaattggataccagaaacatttatagccccattaaatcaatgaatgtataattgcttgcacttttaaaagatttgagactctacctcttaataatacattttatacattaataagattttcaaataagaaagtgatttgtctatactaatagagaataggaaattaaaaagattttaagttcattgtttatgttttatgtttttgcccaaatgagtttttctgtttcctgaatacataatttccgttaacactatcaaaggattcagaacctatttcattccttcagtgtgtcagtttttaaattgttgttaatgttattaaatgtccagtatctactttctcaggaaagaaaatcctctttgcatttgtctagagtgccctgcttagcaagctgaatggccatcatttctcaaagagcacaagtaataatcggtgtgactttattaagccatgaaactcattcatagttaatttaggattgttgatactaaacttctgaaacatactgcttcctttctgctcagtttaatgaggtcaaaccctggagtttagccactttattcatctttaaaagcatattagtttgatgtaaagcaagcacattcactccgaggagtttgttattcagaatttaaggtttacttaagctagtaataaatatataaggaacgtcttaatgatacatttacagaatataatcgtttttataagttgttagtgtctgaatccttgtttaaaagaagtatttttattttttaaacttagtgttttattttaaaggttagcaaaggttaagattagagatacacagttgcttgtttttgattgagtgcctagtagtgagacatccatttttgtttttgtttttgttttcctgccacatgtgggagccattctctgatagaggaaaggcgtgaaaggcttgagagatatctcattgtcacaggcctttgccaactccagtataatacatgtggcagtgttaggcccatttgaaaacttaacaaatgtgccaaaaagaaaactaccacgagagatacatagttttaaagcatttggacagacctaggaattatgtgggcagatgaagagaagtctagttccgtaacaagggttccaaggaagagggttatgagtgagcaccagtgtacagggaaattttagattttgtttgtttttttttttttttgagacggagtctccctctgtcgcccaggctggagtgcagtggcgcaatctcggttcactgcaagccccgcctcctgggttcacgccattcttctgcctcagcctcctgagtagctgggagtacaggcgcccgccaccacgcccggctaattttttgtatttttagtagagacggggtttcaccgtgttagccaggatggtctcgatctcctgacctcatgatccacccgcctcagcctcccaaagtgctgggattacaggcgtgagccactgcgcctggccatgtttttaatgtttctggaagatacagatagggcagagatccctgactccaaattcataattgagtaattttcctgtgattttgttggattaaagcagaaagccctgtggatttctttaatccctgcctcttgctttgtctcatgcctcagttccctgcaacccaatccatttttcttcattaggattatgaacacactgctgcctctcttaaaaaacaacaacaaaacaaaaacctgttactactgttgttactagggactgttgctggaggtattggtaggggaaggctgctcttcttgcttgtctgctatttagtacagtccctcagtcctacctccatttagaaagtgtgaaaatatctattagggaggacttagtgaaccacattactataggaattcaaggctataggccctgattaaaagtgaacatttaggtcgagcatggtgctcacacctgtaatcccagcacctcggaaggccaaagtaggagaattgcttgtgtccaggagttcaagaccagcctgggcaacacagtgaaaccccatccctacaaaaaagcaaaannnnnnnnnnnnnnnnnnnncccctccctctctccctcaaaagcaaaaattagcctgacatggtagcacacacctgtagtcccagctactcagaaggctgaggcgagagactcatttcagcttgggaggttcaggcygcagtgagctgtgatcacactattgcattcagcctgggcaacaaagcaagaccctgtctcaaaaataaatatatacatatgtattttttaaaaggaaatatttagggagaattttgcaagaaaatcctagattcaagtccatgcctcatctctcccaaatgattaatattgtccaattaaatgtttcatatggagggaatctggccagttataaacagagaaattattcaaatagaaaataactcaagtttgtaacctctttaatgtgagtcagcttgcctggttaagtgtacagtaagctcccagttacctacacaagagagcaggacagtgatatggtgagagtgtgagcgtccatgtcaaagccagggcttatgttgtatactcagggtccttaatacctggcttttaggaggtattcaggacatgcttttgaacacggaatctatgattttcctttgattgttacttatattaattttgcatcactgaacatacattacttggcccaaaaggatcctgagtgtcagaaagaagccatcctggcgttaaaggtatttcgtacacaagtcagtaaatagccagtggttggttcagcttacctcgacactatcacatttcaggtgttgtttatgaactggatatatttaagttcttttcccttggggaaaaataaaaaaaaaaagtcctgctacaatttgtggctattcctagattttctgaataattcattttgggtttcactgaggtattgattccctatacatacacatttgaggtttgtcaaccattttatcttcctaaaatgtgtgtgtgcctcacattcttctatttagccatgtttctgttctcacgccatatgacctgaaataaaacctgataaatacagacatttgattgtcctgtcacccaaagtttatcctgaatctagaggtgtatgtgttttctggtattatctttacagtgatattttctgtgtacattatataaaatgcttaaattatggataacattttcaatgaaattaactatattttcaaatgttctgccttttttctctgtttcttttgcccttcctgatcgaagtctaggagagtaagtcaatactttttatgagaatatattgtcctacttgtatgtctaaagaccatgttctcrttctgcagttcaacgttgttgattttatttcttacattttcgtaatgtaatggctgtttctagtcatgtagtccttagaaactatggttaaatgtcagtggaatgctaataataaatcaaccttttttacatctatgttgttggtttggcccttgtcaccctccacgacatcataacacttttcactgctgtagaattgtcttaatttaaaaaatgtggttataggtatattttacagagcactaattacaaaatgagagacataataattgttaaaaccttgcttagaaggttccccttttatttgggggcatattggcagaatgtgtaaagggagaaaggtacagcctaagggaagaacatgtttgggttgcatggactttattttctggtccacttcattttttccagtccctcctgtgtttgcctctgccgctagtgtaaactggattcagtcttacagtagtctgtctaccagtgcattgtgcttgtttgaattcagttcagagtagaggtgggttttgaactagaaatcagagacccagaccccagctctgcctcggacttgctttgtgactctggcaagtgtttagctgccctgtttcctcctctaaaataaaggaaaggacctgacagctcttaaagttccataattcccttagacccagaccagtgccaaaggctcaatggcagaatagaatcaaagatgggagaattgtctctagtttttgtttaatctgtagtttttctttcctaggattctcagagccggcaaggaggatacagcatgcatcagctccagggcaataaggaatatggcagtgaaaagaaggggtacctgctaaagaaaagtgacgggtatgtatgagcccagcccagtgtctcagtgtgtgattaacctagaaaatgtttccagtctctcatatagggaaacacacttaaaattttataatacactagctgcagacctttagcacactggttttcttcaagtaaatccgagatttgaccagctctctttagaagaaacagtaattgctctgtggtccctaaatggcacttctgtcttgtaacgtgcaattataggaaggcagctactgagtagcacatgcagcaggcaagtgctgacctcatactcacccacctctccgcttttttttttttttttttttcctgagttcacgccattctcctgcctcagcctcccgagtagctgggactgcaggcgcctgccaccacgcctggctaattttttgtatttttactagagacgagatttcaccatgttagccaggttggtctcgatcttctgacctygtgatctgcccacctcagcctcccaaagtgctgggattttaggtgtgagccaccgtgcccggcccctctacccttttattcactgcagttttctctgcctgttgctcaccaggccacccaaccttgggtgtcacccttgactcctcttttgcctcttgtattatagccaatctggcaaaagctcttccatttctaactctgaaagtaatatactcttgccatcccctcagcccctgctctagggtgagctgctgctgtctctcctggagtattcagcggcctcctaactggtctctttgtatcgctcattcttctttttctgcagttcaccttcacacagcaattagagtggtcttttaaaaatcataaagcacagccgggcgcggtggctcacgcctgtaatcccagcactttgggaggccgaggtgggcagatcacgaggtcaggagatcgagaccatcctggctaacacagtgaaaccccgtctctactaaaaatacaaaaaattagccaggcatggtggcaggcacctgtggtcccagctacttgggaggctgaggcaggagaatggtgcgaaccctggaggcagagcttgcagtgagctgagatcgcaccactgcactccagcctgggcaacagtgcgagacaaaaaaaaaaaaatcataaagcatatgatgtcattcgcctgcttaaaatactccagcggcttccctttgcatatagcatctcaaccctgccttcctgtcccacctcatcttgttccattttctcccctgatcctgccacatgaggcttcttttctgttgcttaaacaaatgattctgcttcacagtaagtgcataagtagaatcttcattattccctttaataattgtctttttggagggaggggacaggaccttgctctgtcttccaggctggagtacagtggcaccatcacagctcactacaacctcccaattcctgggcacaagcgattctaccacctcagcctcctgagtagctgggactataggcacatgccaccatgcctggatacttttttttttttttttttaaatataagcagggtccctctttgttgcccaggctggtcttgaactcctggcctcaagaaattctcccaccttggtcccccaaagtattgggattacgggcatgactcactgtgcctggcctattgtcattgtttttttttaaaagaaagctccttgttttctgattacttgtggatacgtactccttggcttaatctgagacatgtacattttttactgtaatttgtttgttaaaattataaatatttctcttctaaatttctggggtcattgactgttttgcttattattctactcatgcattcaacaaagatattttgagtcctgctgtatgtctaggactcactcttctaggtcctgagaatacagcattgaacaaaagaaaatctggccctgatagagctgacattctaaggaaggaaagagacaaaaaatactcaatatatggtagatcagatggtaattagtgctacggagaaagatcaagcaagagatgcaggtggtgtgggggatgggagtggttcttgctattatacaggtgattagggaagactttatcaagttgatgtttgagcaaaggaagtgagagaaattctatgcagatacctgggagaagaggaannnnnnnnnnnnnnnnnnnnaagtagtcaggagcatgcatctcatggtgacaaaatacttgagagttcaatgtagctagagtagtgagcaagccaggaggtcataggagataaggtcagagggacagggaaccactccgtgaggtggggaatcattagagggttttgagcacaagagtgacataatccaacatgttttggaagcttctctctgactaccaagcaaagcagagtcatggagggtgaaagcacagagacaaggagaccagttagagggagggctgcatcagaaacctagatgggagctgatgatgaggccaggggaactgcagaagagagggtaaaaagtggtcagttgtggataatggaggcaggggcagcaggacttgctgatatggggtgtagagaaagaaaatcacccctcgtccagcatctggctcattgtagaatcagttagcttaatcctgctgtgaaagtaaaaggagaaaagaaatcccaactaacaattcacagatttaaactgggctctagaatggtgaccaaatgctagtccaaactgcatgagataaagtgtacataaattgtaaattccatagcttatcttgctgaaaagcctcaggctcagctccttgttcttccctgaccatctgtggtacaaacatctcttggaaatgtgacctgttctgtcatcaaacgaaaagttaatattgtgttccattatgagcaacaatgtactattacatatctattgaagcaaaagtataaaagtcattttttaacactactctcccgaaatcacaatgatcttcttgaaattagaattgcctaattctaagtgaaacggttaaaatctgtatatccaaggaagatcaacagtcttttcttaagtgttgcatagttcaaaccctaaagtgttcaagtaaattatcttgagagcacctgtgtatgcctgccacacacccaggtgcctgctcactcatctcatttgacatcttttacagagggattaaataatttgactaagatcatacggacagtaagtatgaacactcaaatttgaacctgggtcttctgacttaatgccagggtatctcccctttgtttttcaaaagggccactgctgctgttatcactctaaggatatgcaaggcataaactggcacaaattcacccccttgacttcttcgttcttttgttcttttccttcatgtactcattccacacacatagatgaaatactctagtgtatgaggcagcctgctagatgctggaggtaaaacataaatgagatacggtcctcaccctcactttgactgcagtctgttggaaagagatacagacagagctgttggatcatagagttggaaaggaggttggaagtcaggtggttccacctcctaataatggcacagatagcaaagatgagcactaataacctggagttgcttgtgacttctgtggaagagtaaaaaattraaatgcttatacatgaaaacagactcatttgcaaacaatgaccactgatatgtcctgtgatttttctctgaagtattatttgcgttggtaatttttgaccstagctttggaatgctctttattacttaaaggattataaaaataattttttaaaactttatggaccagaggcaattattgagagacaaaggagcaattgctttattatattttctcattatatgtacgaaagtgggcattactgtctttgtaatacagaaaaggagaatgagtctccaagaggtcaaataacatgagcaaagtcacatagctagagatcgcgctgggatcaaagctcaagtgatctggcatcaaagttggaattatctatttatacgagaccattttctaatagaattttcttttctggaattgtaagattctagcatggcataatcagtaatcgtgtgtggcactctctgtgagcaccagatgccaagagtctttggtatgtccattcaggagctatgcagactggaacatttgtaaagctttcagtacagagagtgggggagatcacagcaattcagtctagtccatagaagtcttgggaatagaagctatcaaaatgttcacaaagatcaggtgctggctgggcgcagtggctcatgcctgtaatcccaacactttaggaggccgaggccggcagatcacgtgagcccaccagcctgggcgacatggcaaaaccctatctctacaaaaattagccaggcgtagtggcacatgcttgtaggcccagctactcaggaggccgaggtgggagtatcgcttgagcctgggaggtcaagactgcagtgagccatgatcgcaccactgcactctagcctgggttacaaagtgacaccctgtctctctcgcacacaaaagatcaggcaatactgctctcaactgtgccaggagatatctcaagattgttccctttcctctggcgatctgaaagtgcctcagtcacaatctctgtcaacccagaataatgcttctgtgttactttccttggctttattagcagcagaagagaaggggtgtgtgcgcgcgtgtgtgtgtattgtttccataatatacatgtgtaagtaaaactaatgagtaaagacttaataaaatggataaactgaggctttaaactattcctgaaggttgaatagtttgattggtggattgagtgtttgatrtttaggatgacactggttttggcttagtgtatacagggatgcctcacctatgttagcaggctcttgtgagagtaagatggatgcaaaactacttgcagagagttagtcacgttaaccaaatgtggctctgattagttgagagatgccacctctaatcagacatttccctggccagtacttctagaagaaagtatgtgatttagctcttatttgaggatggtttatcaattagtagttaaattacctcctcagcaaggctagcattytgaatacagtatgttcaatttgcatttggttagatggtgtcagattcttacttccttctgtgaagcatgctttagaacaaactgtgcttctagtagttaaatgcacaatattatttgtgtttagagatggttttaaatttgtgttgtggcagctttcttagaggactaatttaagaaggaaaagaaaaacataagatgatactgttttaaatgcctgggaaagctacagtggtctcctgatgtcatttgtttccacagcaacagaaggccttcaaaacttacttccagcctagggaatcactgttccctgcccatttcttcttatctgatggaagtagttagtctcaactagtgcatttgcatctacctgcacacacgcagatctaccacacatgcagtctcgtctgtgcctggagcttcacacacacaaaactcttccaagttttaattcgttctctttggctttttttatccttcaatatcatcaaatcacatttttcaaaatgtctatcacttgttactaactatttgtgaatgatttggtcaccatttacttccctttgtgaatcatgaacagttttttctcggggctctgaggcaccattctgtctctggaagacccctaaaggggtggtgtatgagttaccaaaaatgatgatgcattcttgagccctggctaagcttgtcctgtacctcccgaggcagttcacccctcgctccttgcatggcagacttcttgagttactttcttaactttaatttttattttttgtagatatgggatttccctatgttgtccaggctggtcttgaactcctgggctgaagcagtcctcccacctcagcctcccagagtgctgggattacgggcatgagccaccatgcccaaccactttcttaatttttaaaaatcaattattaataacaaaagtaatcaattgaacattcttatgaaagattcacagatatgattgaaaactacttaattaacaccacccccaacaggtttgggtccccttcctagagaggagttattattatatcattgtagtacctgtcattcatttattgagtctcctgctgttagattattattgtttctatttcccatttttactgtccaaagcagtgccacggccagtcacagtggctcacacctgtaatttcagcattctgggagggcgaggcgggcagattgcatgagcccaggagtttgagaccattctgggcaacatggcaaaaccttgtctacaaaaaatgtaaaaattagccaggcatggtggggtgtgcctgtggtcccagctactctactctggaggttgaggtgggaggatcatatgagtctgagaagtcaaggctgcagtgagccatgattatgccactgtactctagcctggatgtcagagcaagaccctgtctcaaaatatatatatatatatatatatatatatatnnnnnnnnnnnnnnnnnnnnnnnnnnnnnnnnnnnnnnnnnnnnnnnnnnnnnnnnnnnnnnnnnnnnnnnnnnnnnnnnnnnnctactaaaaataaaaaaattagccgggcgcagtggcaggagcctgtaatcccagctgctcgggaggctgaggcaggagaatcgcttcaacccgggagatggaggttgcagtgagccgagatcatgccactgcaccactctatcttgggcaacagagcaagactccatctcaaaaaaaaaattaaaaagcagtgctgtaatgagcatccttgtacatggctacttgtgtgaattaccttccacctgggataataaaaggcaaccaggatttttttgggggggttggattttttggtttggggaagttattttgtaattattattatgtatcatactgtatcgtcgcatgtcccagagtgaatcagwtactatatctagttgtgtttgacttcctccttaggatccggaaagtatggcagaggaggaagtgttcagtcaagaatgggattctgaccatctcacatgccacagtaagtatgtttcttaatttaccctgcctcatgggccagaaagcaaacacgattatgtactcagcagtaaaaattggcgcaaatatatttatgcatttgggtcagatcattttagatattcctttaccaaaaaaaaaaaaaaaaagttttatcttgtcctgtggtagtctgcaccattctttggcatcactagaaacttgtttttttgctctctcaaaatgaatacggtattttgatttcataatattatcttttgggaaatattgattgttctgaaaaacctaggtctttgaattatagagatgacaggctgttctttgcatgtaaaaataatgtaggaaacgtaacagtagatgtaaaaaccttggtggtagtcaaagaagtgcacagtaagttttgccctttttaaaccaacagaaaactcttttcagttcttaaagatgcagagattgtagtggaaaatgtaccaagcaggaatggaaatggcaaagtatatgccaagacttttttaatgtgcttgctgtttaacccagtaatctcagtttggattttaaaaactcattaaattacagtatcctgtgccaagtgatgtccttggggcactgctcaatgaattgccagcagaatagtagaaawgagagatgagcatttattatgttggcaattttgtatgacttacagctgactttagatatctatcagggaggaaaggaagtaccacttaccttcataaactttatttcagttaatcctcccaacaacccatgtggtataataaccttcattttacagatgaagaaactgaagcacaaagaacagctgtaacttggctagttactcacagaattggaagttcaaactcgggtgtctgtctgacattagtccttgtggcctttctctctcttcctgcagaacacatcatcttactagactgtaagcgcccccttgggcacttactagtcctgttctttctgtcttcagcctctcacacagaacttgacatacagaaggctcttagtatacacttgtggcccagtcctttgtggtaaatgactgcacacatcttaaagattgttgtcctttatggaacttgagcagttgcattgtctctgtcccttgcccctcgcagcacacttttcagtgattcttcggaggaattcctcagaggtctgcaatttccctcaaacagcccagctgagatttttagctgtcatgccagttrtgtccagctacccatctgatatcagaaatcctgtctacagacttggatctgtttgtaattatgattgaggctgtctaacagttattcatttcttcagcaatctttttttttttttttttttttttttttttttttttttgagactgagtctcgctctttcacccaggctggagtgcagtggtgcagtcttggctcactgtaacctccatctcccaggttcaagcgagtctcctgcctcagcctcttgagtagctgggactacaggcgcccaccaccacacctggctaatttttgtatttttagtagagacagggtttcatcatattgaccaggctggtctcaaactcctgaccttgtgatctgcccgcttcggcctcccaaagtgctgggattacaggcgtgagcctgcacgcctggcccttcttcagcaatcttttgttaagcttccattctgccatgttctggtgtaggcatcaaagatgcatgaatgaaaaattagataatttttattttcttatatttaattccatacacagtcatctgtgtatgccagagtgaacatttctgatcctttgactatatagatggtgagtttttagtcagttaccatgtttttgttttgttttgtttgagacagggtctggctctgtcgcccaggctggaatgcagtagcacgatctcggcttactgcaacctctgcatcctgggcccaagccatcctcccatctcagcctcctaagtagctgggaatgcaggcacacttcaccacgcccagctaattttggtatttttttgtagaggtaggggtttcgctgtgttgcccagctggtctcaagctcctgagcttaagtgatccacccgcctcggcctcccaaagtgctgggattacaggcatgagccaccgcacctggccagcgttaccatgcataccctaactctctttgccttctgctgcagagctctcccctgggatttgtgaggctgtaacagtcctcactaggcattttgagaagttatatgatggttttatcatgttgtatctatttgcttttcttaggaatctgctgtggaaggcagtgcagagtgatgggagatcatatagttgatgaagtgaatcagtggcactgcttagtggttatatgaccttgggcaatttgctaaaaataaaataagttcccttccccctcctgattttattcctgccaaaacacattgttgtggccaaaacaactgtttatatgcattcttaaggcttgaattaacaagtctcatcacatcatccacattgtttagtggctaagataatggactgtggcatctgtctgatgtgagtctgaatgccaactttgccatttactttgtgaccttgagaaaagtatttaacacataaagattatatgaggattcagtgagataacatgccatgtgtggccattctgttaatacttattgctgctattaccgttagtttattggatgttgctgacaatactgaaatctgttgacaagcaaaccctcctgctacaaacatcagcactctcctgcccccagagcagcctggagggaaatggcttactctcctaacttctgattccctcctgctaatttgtgctattctgttccccacttttcactggctttggcccagaccttttttgctgccagtwacatcactcataatcacattgctgctcccacagaaaggtctctagccagttttagcgggcttttcctgactttgcaaacaccattgattagaattagattgaaaatcaaggccagcagttttctgagaaaaacataaagggcttctttgaaaaagtggggagaagagcttttgttgtcagaaaacttgaggtgtttgggacacatggaaattctttggtttgaaggccctcatcagtgtcacctttgcaaattgttcttatcaaagtgattcaggagaaggccaagtatgcatttagattaatgatgcagggtttgttggcttggccacccaagcaaggtctgcaccagaggtgattcatctccccagcttactgttctaaagagaaatacatttctgtgtacacctgaaaaattggcagcccatccttagaagatttcattcataaattctttgcttttcatgtatctgttaaaacaaaaaaaattcttttaccaactattcaaagtaatgcagaaytgtgggaaccaaattcagtgtgaatctctgaatttgctataacagtagtaatattgtgatagcagcttccaactatggaccatctagtatgttctaaacacagtataagatgctttcatttcaaaataccagttccaacaaatctttggcaaacatttcagttagcctcaggccaggcgcggyggctcatgcctgtaatccgctcatgcctcattttgggaggctgagacaggcagatcacttgagcccaggagttcgagaccagcctgggcaacatggagaaaccctatctctacaaaaaaaaaaaaaaaaatgcaaaaattagctgggcatgatggtgcacacctgtattcccagctacttgggaggctgtgaagtgggaggatcgcttgaacctgggaggcagaggccgcagtgagccaagattgcgccactgcactccagcytgggcgacagagccaggccctgtctcaagaaaaaaaagttttagcctcaaaactcaagtataaagcttatatgaagcgactaaactattatcatttctatagttttgaattgtttgttttttctaactaaaagtattgtagtataaataaatatcataaaacaaattacaacagaaagtataagaattatagttgacatatttattgtagtaatcttgagaaatcaatttcaaaagtataagcagctatgttcttcaaaaaccctgttctgtgaattaaccagtgtcacattctgtttaaataatgggttgtaaaaagaaagagaactgccatttatgcagcacttagaatgcaccctgcacttcatcttcaagatggccctacaggataggcatcactatcttcatttctcaccatgctggaaattcctaggaggtagggaccgcatcttactcatctttgaattttcagtacctaacacattgcctgacgtgtacttagtgctcagtgaatacttttctaatgagactgcattttatagatgaagctcagagaggttaaatcccatgctcagggtcatgaagtttgtaaatagctggaccagttttccagccttaaagcctgtactctttctactgtatcatagggtttttttttcctcagctgccagattgttgttaggtctttgaaagtttcatgaataacagttctttgcagtggaactgcttaccttggccttaccttgatactccttgaattagtcaggggtcttagggtagagagggctgtaagggattccgggaagggaggagaaggaggagtacttgtcatgaagataatgcaagtgttctaagaatttatatttgaatctgaaactgcctaaataatgcattacatctttcagatgtcttcagatgcccttatgattaacacttacaacgattattaaatttattgtcacttttttctcaatcaaccaacaccaacagtatttttaatagcacacagaagttcattaaggtctggtgttttactcaaaagggttggaaatccagctggcctctttagaggttccacctcttaggtagataatgtgtgtgtgtccacctgcttgatgggctgatcattttgaacagggggagagtcagaccacatccttttgagtccatctgcagtaaatgcccattcaggatcttaytgtatgtgccttttattaagctacttaacttgtactaatctgtgaaacagaataacagtacctgtcttccatgttacgagaattaaataagatgatgcatttaaagctttgcagagcctggaccgcaataagtgttccttaaacttaatagctgttgtcatctcagtgagctgaagtaggatcacagcatctggaaccctggagccagactgcctagacttgaatttcaaccctgacactgaatctctagtgaggattttccatctaaataaaatggggctattaatgaggcctaattcataagtgattgtaaagattaaatgagtttattgattataaataattagaacagaatgtagggcagaattagtgctcaataaatgtcagctattagtattactacttctctaatgtacaactatccccattttaaactgtggtttattggaattctttttttttttttttttttttttttttgagactgcatttccctttggagtgcagtggcaccatcttggctccctgggctcaagcaattctcatgtcacagcctcctgagtagctgggactacaggcatgcgccaccacagccagctaatttttagtatttttagtagagacggggtttcaccatgttggccgggctggtctcaaattcatgacttcaagtgatccacccacctcggcttcccaaagttctgggattacagacatgagctgccacacctggccgttggaattcttttgtattgctattttcattactactcagtgtactttacagagcccatttggggtacctcttctttcatagaaatttaatttctgcctttagggattaacagcagctctgtcaccttccatggcatttcactaaagcaagaattggatgtgtctcttctccctttcctttggatctttgggtctaaggtctgttgttttcttgccccatccagagcgctgaagataacattcagcttccagggctttaaaagaagcactgaaagcacatacaggaaacaggaagagacctgcaaaatggattgctctcttctttgctattaatgtattcagtaaccttgtttctgttactggccttcggagctctccttggctgtcctctgattccacgtctttactctcattgtcactgaaaagagagaatgagaatatttttcttcgctccaacagattagaaagcagcactgtcagttgtaagagggcgaactttggagccagttaaacccaggctcacaaatttagagctcacaaatttagaaagtgtgaccatttggttagagtatgtgctgttggtccttagcatatacagaggtcttagcatatacgaaggtatatgctaaggggtaaaaaggttttttttacttttactaaggggtaaaaaggcttttttaaagtcttgatttacaaatttgaaggtataaaaccaaggaacctgcagtttgacatcagctgtgatgttacctcctgcccacattcctaatataagaaataatagagttctttaaaatgtttcaggccaggtgcattggctctcacctgtaaacccagcactttgggagtttgaggcttaagtccaggacttggagaccagcctgggctacgtggcaaaaccccatctctaaaaaaaaaaaaaaaaaacacaaaacttagccaggtatggtggcacatgcctgttgtaccagctccttgggaggctcaggcaggaggatcactgaagcccatgtggcagaggttgcaatgagccgagatcacaccmccgtaccccaccctgggcgacagagtgagaccccatctcaaaaaaaaaaaaaaaagttttactttgacctaatgttctgttgttaacagctgtgaccttaaggctgagttaacttaaccttttggtgccttattttccacatctctcaaatagtaataatagtggtacttagttgtagggtggttatcagaattaagtgagcaagtatatgtaaaacatatggcatggagcccagcatgagtaaatgctgtgttctcatcaacataatgatgccctcgctttaaagactgccctttctgtgtgaggctaataaaagcctcaagcacattttgtctcagccattcatgaggtcatgagttcaagaacagcctggccaacatggtgaaaccccgtctctactaaaaatacagaaaagtagccgggtgtggtggcgcgtgcctgtaatcccagctactcgggaggctgaggcaggagaatcgcttgaacccaggaggcagaggttgcagtaagccaagatcacaccactgtactccagtctgggcaacagagcgagactccgtctaaaaaaaagaaaaaaacatatgccatagctcagatgttttactatcaaattaatgcattttatacaaatattccaagtctgaaggttttagttttatgtacccttgttggatagcatgacgtaaagtggctactgaaattaataggaaatgtgaatttaaaaattcttcctgtattggcccaaactctatatactatcaaatagtaggtacttaatacatatttgcagaaatgcctgcgtggatgactatctagcacattcattgggtgcagtaacctcagcgccacgtcttagcaggagccccagtaagctctttttttctatttgcattgtagcattgattgtttaatgttgatttgagtggaacatcctctcaaaagtaaggtaaccgattccttgctgcaataaaaaacattttcttggagatctccattttcaaatatttctttctcacatatacatacattctgccaactggaaatgagtccctttattaaaatgattgggagatacagtgataaatgtttgacaaaaaaattagtaaaatggttgggagggttaagggaattcagccatctacyctagaatgaattacttcagttagataatcactacttatctttttccctgtctgaaggatcacacaggggatgtgagagctttagttgtggccacagagtaataagtttggaatttggaacgtgcatctggagggaagatgagggaactggccatttaagggcagtaagaaccagaaaaggcaaaacagtaaagctatattttgactgactttgtaagttttcctagggcttggcttgacagggaaacagtgtgataagtgagaagagatttgttcagaattcagctttgccttttattttttgtaaaacataggttagtttacttcaccttcctgatccttggttacctcatttatgaaatgggtttgggaacagtacctaactcatagagtcattgcaaaaattaaataatagaattcatataatgtatctggcagtttaggtactcagtttttcaaaaaattgttaccttttatctgtttggaaggccaaaagccaatagtcttgattgctaaaattctggcgataagatctctctgcagtggtaagtgttcagcatgtaccttaatttcttaccacggttgtagttattgattgtatgccaaaaatatatgtccctgtagggcacagtaggtgtctaaaaaactatttattgaatgaaaactttgaaatgaccataatggtctgagcagctctgttttcagacactagcataggaagtgaagagagctttgtcattttatttttacctctttccacgcgtcagcctcatcctggctgggtcaggcctattttccaagtaattaatgttcacttcttgtttgtaaagcagagcaattcagtaagatgatgggaggaaataatttcatttctgggtactaattccagtagcagctgttttctgctaactgagaaatatgcctgtgctaayaactttacacttccagcaaaaacactggaaccatggtgcacactaagctgtctaaagacaaatgtgcggtgtttattttcttttaggaaacacagaaacattaattgggattgactcattctgtttctgcatgcatttctacttacttatttgatgattttcctagctaaacagccactttctgttatgtcagagggatatcttcatcacttctcttcatgaaatgtacccagagcttccctgattgaaacattttcaaaaatcaaaaacttgaataggtttgccttttgtctgagggtgtgtaggagaggggtgtgtaaaatgaagacatctgtgtatattgttaattgggaaaaacagtttacaaaatagtatatacaagttgaaccaacatatgtcaaaaaaaaaaaaaacagacatctcacacacacatcttggtaaaattaaggtattaacagtgattattgctgcatgtgaaagtgagattccaacaactaatgtttggtttcttctttgtactatctctgtctccttttcttctatgaatgtgttttattttaatgagaagtgaaacctataaaaggacaagcctcagagtttgaaggaacagagttgtagaattgtcagytttgaaaagtgtcataactatatttagagaagctcttgtagcttttgaaagagatgctgctcaagacagccttcaggaacaatgtgtccctccattcaccattcaaatttctgcactgaataattcacatagtaggtaatgattacttgtggaatgatgcattgaaagtctccttttctagctgtcttaagcctctggccaccagcaccactaccgtacgtagctctaattcaggccctcctcatttcattgctcatcttccttactctctcagcctctctctgcctcctctacctttcccaccaactgcccccccaccaccccaccgtgaaatagagatctaactggccactctgctttctccagtagattgccagagtcatggataggaatgtgagtttcttagtatcatatgcagagtctcccttcctgtgtgctcagtgtcacctcctgcagcttgtcccctcctatgccccaggcctttggacctgcttatcacacttcccagtttgtccatattccctcctccaagtcctctctgaaggttgaggctgcctgtgtggaaccttgcctacatctttggtgcacacccttgagctcaggtccctgggctccctgggcccccatacgtaatcaagtctgtttccacagatgtttaatggcatggaccatgtgtttctcagatgtgcttggaatgtggtagagacttaataaatatatgatgaatgagtaagtaggaatttcaaagtggcttctaaaatttctcttttccccaattatgaaagtaagtacttagaggagagtcagataacccaagaagatattaaaatagaaattaatctttggagcttttgcttcattgacctctaacccttactgtaatcaggaggaaatgttcttgtgtgctgggcatccagctgttattctccgagctatatcagattactttctttccaggctggactgcagagtgaccgcagaagagaaggagtgggggctctgacccatccaaaccactttcttaccgggagagcttaggaatgttacttaacctttctgtgcctttatttcttcacttagtaaaagaaactgaagacttccctcacaggtagtacatgagatagtatatgacataagatgcctggaatgtagtcattaatttagtaaatatttattgagggctgggcacggtggtacatggctataatctcagcactttgagaggctgaggcaggaggatcacttgaggccgggagtttaagatcagcctgggcaacaaaccaagatcccatctctacaaaaatttaaaaaattagtcaagcatggtgaggcatgcctgtagtcccagctacttgggaggctgaggcaggaggatgccttgagcccaggagttcaaggctgcagtgagccatgattgtgccactgcattccagcctgggcaacagagtgaaatcctgtctctaaaaaatacatatttttaaaattagcctcgtgtggtagcgtgcgcatatagtgccagttactgggaaggctaaggtaggacaatcacttcgcctgggaggtcaaggctgccatgagccatgatcttgctagtacccgatgtgtgccaagcacattttaatgagaaaaatgtgtgtgtccttagtgagaaggaagacaggaagcaaataaggagtgttaagagccagaaagaaaatacagcagggtgtacaaaaatggaacatcatggggaggtggtcaggccaggtaccgcctcctctgaggaggtgctgattgatgagagttctgcagggagtgagcagggagstctccgagggcctgcaggagtgtgtgagcagcaggagggaccagtgcccctcctcagccaaaggaacaactcagagtgacaggagctgagtgcgagaaggggcctgcgattggtgcctggaggtcatggcacagatgtgtgtttattctgaacaggatgggaatcaacagcaaggactcaatagatacatagacgtttccagagtttctcctgttttgttttcttttttctctcctgtacttaaacaatatgaaagcatttcctaaactgttccactgtggtgtagcccagagtaaatcatttagttttactttaattttagtctgctgaaatcccaggaaagattatacagtctccaatcaatatacctataaattagtactaaatgtcaagaaagtgctttgaaattttggaaagttacacaaacatctgaagttacaattattactgtagtgatttctgtgcttcaaatgccttggtttttggacttctgtggaacataccactcccctctggtattcgtgggctcagccctgggtaagtcagctgcttagacagtcaaaacttaygcgtacttggctcctcaaagtcacatttgggatgatggccatttgtcaagtgcctcactggcagctcagtttggagaagagcactatgtttaggcaagatgtgcctgtgtcaaatgcagttcatgttaatgtagcaaaagtcagtctagtagatttggcaaacttctaagagaataaacatcataacgtcatcaccactgaagttgtgggtcaatcatggaatgacttaaaccatataaattccttatcagcaaaatactttgaaatagtccgtgcttagaaatgagaggtgaggaggatgggaggagggaaaggagcagaaaaggtaactattgggtacttggcctaatacctggatgataaaataatacgtacaacaaacccctgtgacacatgtttacytacataataaacattcacatgtacccccaaacctaaaagtttttttttaaaaaaaaaagaaagaaagaaagaaatgagagctgagacctgaggccagcatggtgcctcacgcctrtaatctcacttgaggctgacagatcacttgagctcaggagtttaagagcagcctgggcaacatggagagactgtctccactaaaaataccaaaaaaaaatagtaataaccaggtgtgatggtgtgcatccatagtcccagctacttgggaggctgaggtgggaggatcgcttgagcctaggaggttgagactgcagtgatctatgatcaccccagtgcactctagcctggccgacaaagcgagaccctatctcaaaaaaaaaaaaacaaaaaggagaaagaaaaagaaagaaatgagaggtaaatagtgctgtttaacttgcctgaatgcagttaatactcagctgagtgtatggtgtttttttgttgtttttttttttttaagatttgtatctactcttggttgtatctgttggtaagattgttcagaaacaccggagaaatctagattttgggagaattaaaaaataaagttaaccttctgtcacattcaaatgtgaatagtgtctaaaaattactaaatttttctttttctttttttttttgttttttgtttgtttgtttttttgagatggagtcttgctctgtcaccctgttgcccaggctggagtgcaatggcgtgactttggcttacagcagcctccacctgtcaggctcaagtgattctcctgccttagcctcctgagtagctgggattacaggcatgcrccgtcatgcttagctaagttttgtattttcagtagagacaacggggtttcgccacgttggccaggctggtcttgaaccccaggcctcaggtgatccgcctgcctcagcctcccaaagtgctgggattacaggcatgagacaccacgcctggtcagcttaaaaattattaaatttttcaaaggcagtccttctctacttaagaaacctgaaacctcttattatgcataatcaacttaagcttgggaagttcttccttatttctggcccaaatcttctgcaattggagtgtatttcttttcatctgagctaatggaaaacagctgcccaaccttcccaataacaaccttcatatacttgaagatggtcattaagtcaccccctagctttccctcctctgtactaagtaatgcctctaactcatcttcagagtttccattttccaccctttcaatcatctcttcatctccccaagcttttctgcatccttctttaaatgtggtttcctaattggaacataatatcgtagcaagagttgttctcaccattaactgggtcactgccttttcaggtggtcatatgccattgtcatttatatgagaaagtcagcaattttatcaacatccaaaaagatgagatgtagaactaacagttctttttacagtgagctaagcctgcttcgtggctacagattctgattttggagtctgaggcctttagcaacccaaacacttcagctgttttcttttttttttttttttttgagacggagtttcactcttgttgcccaggctggagtgcagtggcgagatctcggctcagtgcaacctccacctcccaagttcaagcgattctcctgcctcagcctcccgagtagctgggattacaggcacccgacaccacgcccggctaattttgtatttttagtagagacagggtttctccatgttgatcaggcgggtctggaactcccgacctcaggtgatccacccacctcagcctttcaaagtgctgggattacaggcatgagccacctcgtctggctcttcagctgttttctcagaaaaacttgcaggcccacaagctcctgcctccccttctaggtttggtgacaagttctggagtacaggaatcttcccaagcactgtttcctctttggcaaaattctcttgtacttgacttctggttccattcctaaatcaaaggtacatgcattgaacatggaatccyctggggtctctcacttcctcccctaaagcagttcgctttggaatagatagatatgggacaaagggcattgttttctatgtttaatctcattgaaatcatagagggagaaagatcttgaaaaatggtccagagagcacaggaagataaatagaaattgtttaatgcccattatttagaaggagaggtggcagtgtgtcattgaaggtgtcttgattgtatgccatctctgttgtttcaggcttactgatgtgacttgtctctaactccctccccctctcttttccctgaaaattttaattcctcagctggagatgcacctggtactaggattttcagaaccacagctctcaatcgaaacagggatataggtccaattaaagagtttcattgcttatttctccaggcttctcgtgttcgagcacagcccagcctgggcactcaaacatttcattccttggtcagcttctgcaggaaggagggatcctagtatcagccattgtccagcatgtgaccttgaacatgggcaggcaggagagtgttttgaccagtgtgaatacgtggtgagacttcctaagttagcgtgactatctagatactatagggtctgttttatatgtgtgaccaagagatttgctgataagttatatgaaatccttatcaaattttctctctccccagatattggggttcattaagcattgcctcacaggtagtaattgtcattgtacttctgagagaagtaatgtaaattttgcatcacaaccaaaatttgttgaatccatggatacctgggagatcaatttggggatgattgattaccggggtcattttgaatgaataaatgaaatatagctcagctacatttcatagtaagatacagcattaaaagtgccaactgttggtgcttagttatgggtaggttccagaaaggtgcatttccatggaccatgccgactgttcattggaagtgaggtggattatttttttattctcttctgaaaaatcaccaggatatttatgcacagtttaaagacatttagtaggacacctaatttttttttccatctttaatgagattcagaattcaactgggataaataaaactttactaaacttaccagcttatatttgagggcagaaacctacagatctgttgtcttcttgcagcaaacttggaacaatgctcagatgtctgtttcttctttgctgaaaatgtatttttgtaccactgagcaggccttatgaacagcatacctgccctacagggcactgaacctgcagacaagagagtggagctgcatgtaacttctccattttctctttttttccagtctaacaggcaaccagccaagttgaaccttctcacctgccaagtaaaacctaatgccgaagacaaaaaatcttttgacctgatatcacgtgagtcctttttctctctctgagttggttattgtggcttctgacacctgcacatttccattctccaggtcagcagcttttccaagcagggctcctcacagttggcattggaacagttattcctgcatgtgctgctctaggaagatgccccaggtctcttaatttccactgagcccacctgcagttgacaaggcatagcagtgtcagatctgaccagcaatagaatagaatctaggatttgtacattgaactaaaccartgcttgactgtgagtacacagctttatccccttggagagatgtttcttagtatattcccatttctgtcttagatctactgaattatagttgttggtatgaggcccagacatagtttaaaaaaaaaaaaaaagccactaggtgattgtaatgtgcacctgtggttaagaagcacggatgtagacttgggaatgcagatgtgccactatatctgtacaacgaatttgcccagagttatatccctgcaaaatctagctcttaaaggaaaaatcatttccttgcttccaagcagaactgccttcaacctctgtgaattgatggcactgcaccctgtcactcttctacttcatggttcagagtttgcttttctcttgtgatgagagagcgtaatgagctacccaccccacagcctgttatagcctgtgccctcatagtgtgtaaagagttggggggagatgttcctttaggctggctacctgtgcttgtactgattcctatgggtgtgcttaccgacccacactgtagactgagaggactcctctttgtaaagagaggatgacagtgccattgaagtgactctcgtgaatatcctgaaatcctgcaacactaatcttaagtatccttccttctctatcacagcccagcaaggcagacccacagccaaagtggatgatctatgtatagaagcacagaaatattttcttgccctttgaaacctttctgatgcagttgtgtgaatagtcctgacccaaaagatagagtcagtcatgaggctctttaggggtagtcgaaactgtattctgcagcatctgtatgaagtttagattccctgtgattttcatgaccaagagatttattgagttattgatgagaaagaaataggaaaatttggaattattttatgacttcaaaaagccaaaaacccctagttatgagagtctgtaggttattaataatagttggcagttatagagcatctgttacatgccaggtgccttatatacattagtgctaatcctcatgaaagccctatcagttttccattttacagaagaaaaaactcagactccaagaggttcagtgacctacagaaggtcacacagcaataaagcagagattcaaccaaagctctcaggctctgccacccatggcatgttcttttttttgttttgttttgttttgggttttttttgttttgttttttgtttttgaggcagggtctcactctgtcacccaggctgcagtgcagtggttcagtcgcagctcactgcagcctcaacctcctgggctctagtgatcctgcttcaccctcccaagtagctgggaccacaggtgcatgccaccacatctggctgatttttaattttttgtctagaggcagggtctctgttgctgaagctggtctcgaactcctaggcttaagcagtcctcctacctcaacctcccaaagtgttaggattatagccatgagctgtaacattaagcatggtatgttctttgacatacacattgtctctctctccaagagagatgaagggtgtgaytgcctagcctagagtagtcacacaggaagtgctcaggatatgttagtttgacctgaatatattgagaaagagcttccctcatgtacatccagcccaaagtatccaagttaggtcactccttcccactccttcccttacatggatagcagagattgagcctttcttcctgcaacctgattcagccagagagcagccccaacatctggggcatagtatgtctagtgttgggggtgttggggctaccccatggttaagtctcagaacaaatagggaacagtaaatgaatcatttctgaaaaggagatttctttaaaaaaaaagaaaacacagtaacaattgaattgaaaatgaaacagaaaatactgaattagctggcactctccagtttgtcatggaaatccatttggatcaaataggaccttcccctctcctcactgtttattcaaaagcagtgccagatgtatgcatggtatttgtggttattttattgtattcttgttgcacttaagaagaataacctcgacagaatgaatcatgtagctgttttattgccgtgtgaccttgtgtaagtcactgaacctcttggagcctcagtttttttttctgtaaaaatatgagaaacagatagagcttttgtgaagattagcaataatatacacaaggcacctggcacataatggcgtaaaactaaaataatattaaaattctacttttactggttttcttcccaggaacttaaatctgtgttgtacctgaaagtaccctgctttctaaggtttcacttatttttctttttttttattttagataatagaacatatcactttcaggcagaagatgagcaggattatgtagcgtaagtagttttgaaataaaggtgcgatgccttggattgaaaaagcacctctctgtttacaatacacatcaacattttcttttcatttgtaagaacctcgcctggtggctccatgcttctttcccgcctgtgggccatcacatgttgctcttctctctgtctgtggttctccctcttgtctactcaataagctctggtacctcctgcaagattctgctcaagcctcaccctctctggggttatagctcactactccttgcccgcggcctcttcataaccttctgtgatcctgtggtgcatgtctgcagccctttagagaccaagagcttttcgagggcaaggaccgtgccttatgcatcttttaatcacatcccttgccctcaggaggggcctttgctcagtttttggtggccaaacatatcagccagcctacctgggcacttgaccattattgtaagaggagcaggtgagccaggccctgaaggaaggaaactgccatgtgcctttcactggggtgaacagagtcaataaaagggagygtgatatagtggaaaggaacaggttggtatcacatactcctgggttggagttttttgtttttttttttgtttgtttgtttgtttgtttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtragccaccgcgcccggcccctgggttggagttttgcactcacctgaccaggtatgcaaccttagatagtccctagtcccttttttaaaatgctagccctggtcctgagctgtctttattccctcttctttcctgtagcctgtctagackgaaaaaggcagtgtgtgactattataaatctcagctgcttgggagagggatgtttttgttaaaatgggcaattattgttcactttttttttttttatttctaatgagtacttggggtaatttggaccgagttttataaactgtcaaacttcctgtcccatcagtggcacagaatacatgctatgttcctctcttatttctggagagccacagaattctgctcataccctttttgccttatactcacttctyttctctctcccactcgcttacttttgttattgctcacacacacaatcttctctggggaattttactcttttcccatttcaaaggagaaatgataaaggatcagaaagagaagagaacatgggtagaaaagatacagaggtgggaggaacagggtggggaaagaaaactgagagagaaggtagaaagacaaaggaaaaggatgagaaaggtctaattagctattcattatttgaatatttaatgaatgccagctgtatgccaaggctatgcaaagccttgagaatacaacattaaattagatggagcccctgccctgaaggaactgcatctctactgcaggaggctgttggtacgacatggtgcaggtgctaagtgtaaggacagaggaggccatgtgctggaggaatagactcggggcacacaccctcatggtttcctggggttgttcctcagagatgacttccaagaggaaggtaaggctgagctggctcaggaacgtaggggaaggttgtaaatactctatactccaggcaggaggctctgatggcacagaaacaggaggatggaataggaaggaagtgattgatgacttgttgttatgggtatagagttggtagactgaaaggtgactagaagtcaatgaggaggaagtcagaggcctggccctccacccacaggttcagagaggtactatttataataaaaatgggtaatagttattgagatgttacgtgctaaatgcacttcatgtcttattaatcctcacaaccccagaaagtagggacttttgtccctagtttgcaaatgaggaaacagaggcacaatgtgcccatggtaacagtcctagtaagctaggatttgaacccagatagaattccacagtcaccttggaatattgtttctccttctccgatttcattctctcttcctcatttccctttctcaaaaccctaagtgaaacacaggtgagtaatttgggtgaggcagggaacacaaccactttctgtttgttcccttatgactcaaactcagatcttcaatattttatttactcttagaacttacaggtaattcagtcccagttttgttaagagattggtgtcctgcccgtgagacttaacatttttcagtaaaagaattacatggcccaccctgaagttgcgcattttgcactttgcagttttgttttgtttctgagacaaggtctcactctgtcacacatgctggagtgcagtggcgtgattatagctcacttgcagcctcagtcctcagtctcccaggctcaggtgatcctcctgtcgcagccttgcaagtagctagtgctataagcacgcatcaccacgcccagctaattttcrtttctttttttttttttttttttttttttttcagtagccatgaggtcttgctgttgttacccaggctggcctcaaactcctgagctcaagccatcctcccacctcgaccccaraaagtgctgggattacaggcgtgagctatagtgcccagcctgcattctctctgggtgctggtggtgagaggggaactttgttttgagtgctgtaggaggtaatggcagtccacaaagaaagcacatgcctcaragggaagccttagttcttcacttacctccaggttacatagaggcagtttcactgcatcattgagtttatttttcatatgaaagtgttcgatgaaattgaatgaaaaaatttcttctcactgaggaaagttcacaaagagcagatgcatgttagactcatttggcttcttgtccaggctctgctggctagtggcttttttgtttgttgtttgtttgtttgtttgtttgtttgtttgttttcagagtcttgctctgtcgcccaggctggagtgcagtggcgcgatctcggctcactgcaacctatgcctcccgggttcaagcaattctgctgcctcagcctcgcgagtacctggaactacaggcgcgtgccaccacgcctggctaatttttttgtgtttttagtagagatggggtttcaccgtgttagccaggatggtctcgatctcctgacctcgtgatttgcccgccttggcctcccaaagtgctgggcttacaggcgtgagcgtggcttttttttttaaaatgagatctatgttgcccaggctggacttgaactcctaggctagagcgatcttcccgcttcagcctccccagtagctgggactacatacgtgcactatggtggttagtggctttttaaccttaggcagatcatctggcttcagtcttctcatcagtaagatgggattatatacctcgattgcaggattttgagaggataagctatgtaaagcccttagcacagtgccaagttattttttatcttataaaactcaaagcgacgtttaaagtattaaaatacaattatgcattctttatgcttttgagtatgcttgttacttgaaaataatttaaaagttaatgtcacaaatgatcactgtgagtcttggtccttttgaaatttagccatttcattccaccaaatttgaattattttctctagaaaattatcctttaaatatactttttctgattatcatgacaaacttctttatttatttgtcatgagctcctgagtaaagaggcaaatggaaggaactctgaaaaagtgagtcaacaaaagtgttttcttatccccatctggtctgacagaatccagcctagaaccttaggcaagtcatataacttcagtttcctcatctataaagtattataaaccctaacttagaggcatgtgagaagattctacaggttgagtatcccttatttgaaatgcttgggcccacaacttttttggatttcaaatttggggtgttcaatctatatgttaaaaattgtaagtatttggtacatagtagatactggccaatattagccaaatgctagaatgcctgaggaaagcgaaatagaggctttgcagtcaagtgaaaaatccagtaacatcagtgccgctgataaaatgcagtaatcagtcctgttgaacccaggttcttgatttgtttttaacaaaacaatttctagtttctaacttcagactgatataaaaawtactgttttaatcttctaaaaggtataaaatccccccattccttctgcatatgaattcctagactcttggttttgaaatgttcrgttttctgcatcacagaagttaagctgtgtatatgcgtttctcccaacatactgaaggtgagcgccacctagagtcaaaggtgtgacttgcatagttcacatactccaaaaacataatttggtttttaattcttatgctgtcactattgcttattcaaagtcttttgtatagtgctttgtttcatatccatttcattcaacgatatacaaaaaaatgagagactcagttctgaacctctgtattgtctgttgagaataaacattagctgtctatatagtaacaaaaaattaacactggtttggaaatgttttttattttctttttagaaaataaatttggcttttttctcattcatgaaagtaatacaagttcattatagttttgaaaaattatagaaaggcacaaagtcgggcaattcctctatcagttgttttctatagaaaatcactcagagacaaccactattgacgtatttgtgaaattccttttagcctttattacatacatatatttaaatttgggattatatcattctattagcccgttctcacactgctataaggaaatactgtagactgggtaatttataaaggaaagaagtttaattgactcacagttccacatggctggggaggcctcaggagacttacaattatggtggaagggcagcaaacatgtctttcttcacatggcagcaggagagagaagtgtgtggagcaaagagggaagagccccttataaaaccatcagatctcaactcactcactatcatgagaacagcatgggggaaaccgccaccttgatccaatcacctcctacaygggtctctccccagacacstggggattatggggataacaattcaagatgagatttgggtgaggacacaaatccaaaccatatcaatcatataataggtttttttgttgttgatttcacaaaacactatattatgagcatttatccaatgtcacccaaaaattatttgaaaatgtacactttaatgcctgcttaactgttctactttgtggttatttcaggcctagttaatcaactctctgttgttgggtttctaggttattttagtagcaaagggttattttgtttgggacatacagtagtcatactgtatataagtaaatctgcagtcttcatttaatattataaatgtcatcatgtttccatgttaatatgcctttttcataagtataaatttttatggctgctaatgaaatatcccttcattttcactgttaagtgtccccactgacatggacttgcagaaaatacataccttttgctaaactccttttcctggctcctctccatttctcatcatttctttctcatccttgcattggatgggtccctcattgagtcctctccattccaacattccctttattcagtatgcccacacggaaatgcagtctccttgtatattcgttcaagtcctcagttatattgattttttacttttctcatctgctcctctcctctctctcattttcccctatgtgtcatttttcattctttaactctcaccttccttcaagtttgatttctttgtttttcctcactttattgctattttggaagggggcttctcttttggaattacttgacaaaagtagattttttttttttgcagtggcaaaaaaaaaaaaaaaaaaaaaaaaatgaccatgctcttataaagacttttttcctcttatgtttttaccaacagatggatatcagtattgacaaatagcaaagaagaggccctaaccatggccttccgtggagagcagagtgcgggagagaacagcctggaagacctgacaaaagccattattgaggatgtccagcggctcccagggaatgacatttgctgcgattgtggctcatcaggtttttgtccccatatttgaacgagcttttacaacatcctttctcttcctgtagaatataaaacgatctagttattgaaaaaccttaacccctatggacacactcacatacacacacaaaacacgtattcccaacgtgatttttcctaccgctgagctgcttttacctatgctgttttctctacctggaaagccccctcttgctctcctaggtgtcactgccaaaatactacctttcctataaggtccaggtatataagcaccatggacattatggagagagtagggggcatggggtccacattttgtatcactgtccaccactcccagcctggaccatctcacactgagtccctttagtattctgattcgtagtttacttatcctaaaaaatgggtcagtaaacctcttgctatggcacggtggctcacgcctgtaatcccagcactttgggaggctgaggcgggcggatcacttgaggtcaggagttcgagaccagcctggccaacatggtgaaaccccatctctattaaaaatacaaaaactagctgggcgaggtggcgggcacctgtaatcccagctacttgggaggataaggcagaagaatcatttgaacccaggaggcagaggttgcagtgagccaagattgcaccattgcactctagcctgggcgacagagcgagactgtctcaaaaaaaagaaaaaagaaatggtgcatgtgaaatcaactgacatgtggtacatgattttccttccttcctactcagccacaccttccctcacctctgtatcacattgaagtcgccttctcccaaacttttattttcaaatagcactatattaccagtgtattggcaacagctaacactgagtgttcccgctgtactgagaatcatgctaggtgttttgcttatctcagtgaatccttgcagaacccctgtgagcaagatcccaatgttctcattttacagatgaggaaactgggactcagagaggttgaatgacttgcataaggtcacacagctagtaggagtcagaacaaggatgcaaacctggtattcttaagcactgtgatataccttttttgcggttttacttgtgaaactggattttctacacaagaagccataagcacctcagagagaagtctcagattttctgccattattgtgtacatgtatgatagtgacacacgtagtgtcaggaaatggcaagcaggtagtaaaatctcaagcattgaccagtcaggaagaagcttgacccagagagagaaacctgaagatttggctaacatggaagtaatagttcccattgttctagggccattggaggttgtagaaaaaaggccttaggtcactgaaagaaacatttggtgttcaatatttacagctgtcttattactaagaagtgctcatggggaggccatgaccaagaactgttgaggttaatgttagttgcaacttggaggttaatgatggctatagaatccactcccctgtgagcagtacttaatagaccttcagtccatcactgtcagaggtgatagtggcagtgagggaacatctctcacaggcctagaggtgttgcatagggtctctkaaggaaagcctttctcactttttcacaaggataaagtgcttaattttgttttcagttcagtatcaaagggaaacttttatggtagcccctaggctaaacctcaagagtccatttcttccatttaagtcttttcttcatagttcttaacaatttgtactactgttttagcttcctctgtagttggcacactaaaattagatgtcttttttgtttcattgtcttcaacattckttccacagaacccacctggctttcaaccaacttgggtattttgacctgtatagaatgttctggcatccatagggaaatgggggttcatatttctcgcattcagtctttggaactagacaaattaggaacttctgaactcttggtaagtagtgacctgtacttgggaagaatgatattattgtcatgagtaattttaatatattgttttggattttttttgtatgtctgctgagtacaaagaattataattcctgaattttgtgagtttgcgtagacgtttaaaatgtaacttttgtggtatgtaatgctgactttctatttcctgtttgaagaaaggatgaatcatacatgtctataagtagctcagtgaaattggctcttttcttttgggatggtcttcttcaaaactacatttttctttatgaattagttttcatataactcgtggaaatagcagttaaactcaaatgttcacattacctcatggcttctgttgtaaataatgactaaagagtttatctcaatttttttttattatttctaagtttgtaaaagtacacatgaattacaagtggcttgttaactattgtcataaaaccaactactcttgaacccataacttctttaggtagtaagggaagaaattgtgagaagttgtggtgcttagcttcttaatccaaaaaaggggttatgtacacttaaacttgttttcctttaacctctgcccttcccatcatgagtcacccagatttggagttgtcatcaggtccaaattgctccccgagatataccaaaatacagaaggggagcctacttggcatcccccaagtaggatgcctactggacaaatgccccattttgcataattttaacacctggtgcactgtgagagagtctttgtactaagagtgaaatttttaaaataaagtatgacttctcagacaggaggctcacccttgagcagaacctgaatgaacctgggctcaaaaaaaagctgaaagtctagcttatcattagccttaaccaaaaagggcagttagtgacccagccagcagccctggtcatctgagcgttcactaagcaatcgtgatctgtcttgtgttctatgcacaatacaagacattccttctaatttagaatgtaggaagttaccatgctgatactcggctccctagttcacttcaggattgtagagaaaagacacagacctattacctgtaacacattctttagtgcagaaatgatgtccctcatctccttgacctgtattaatgaaacccagtttgacaacaagaaagaggaaagtccaaatcctaaacgtttgccatgcaataaacccaagactttttccctcaaagacatggttgcatgtatgtttcttaaactttgcatcccaaaattacataaaatgattagaggcccttcagaacaaattttcttagaatgctcttgaacccagaagcaaaatggttcctgggtcctctgctgcctgcagcatcttaatctgtatccagatataaagtaatcctgtgtccttttctgtcctgggagtaaatttgttcaatataaaaaggaaacatgatggtggttgataagctattgctgtttattaaaagtttaacctagactcacatatggagcctgctctctgtaatctcatatagtttatatgtgtgtagaaccagattctgttctagcatttatcacatatttgtagacatgattgatttccttgtcaatggccccactagactatgagcatctatggaaagggaacatagtttacccatctctgtatttccagcacttagtttggtgcttggcacgtagtagatgctcagtaaatatttgtagaccagatggacggtggtttgtattctaagtcaaatgagggaaaatacatattcataaatctcaaaaacaaataataggagacttttaactagtagcaaagagtttgctatattgtggttgtttgttttttctgttacagctggccaagaatgtaggaaacaatagttttaatgatattatggaagcaaatttacccagcccctcaccaaaacccaccccttcaagtgatatgtaagtatttctgatatattgaacttttttaaaccattctataattgtttttctacccttccaaaaaacttctttttttttttttkgctgggtgcagtggctcacgcctgtaatcccagcactttgggaggctgaggcaaacggatcacgaggtcaggagatcaagaccatcctggctaacacggtgaaacccgtctctattaaaaattttwwaaaaattagccgggcgtggtggcaggcactttgtagtcccagctactcgggaggctgaggcaggagaatggcatgaacccgggaggcggagcttgcagtgagccgagatcgcacccctgcactccagcctgggcaacagtgcgagaccccatctcaaaaataaaagaaagtctttagttttttacagtgtttgtttgtttgtttrtttgttttccagagcaaaccccattgtcaggggaaagcagaacaaagaaaagtatttagaaatgtatttccgggatgcacagattcttttcaccctcaccttcccctaggttgttgcagctgcgcacctgctctgtgaagcacagattgtcatgggggcagttctctcaaaaacatggcatattgtgatgagtaagagacattcaaagacaatgggagattccttttagcctggcaaaaatccaaatgcttaaaaacccactcagcaagactgtggggaaactgacattctgtctcataatattgccagtgggagtacaaaatggtacactatgaaaaacaaattaaccatatttaccaaaattataaatgtacttaccctttgactcagcagtcccactcctgggaatttattcctattctgtaatgcaaaaagattaggaacaaaacaagtatccatctgtaggcatctgatgaaatactctatggtagagccacacaacagaacactatgcagatggaaaaaaaaagcacaaattacactgaaaaggcttttcaaaagttaatttgatygtaaaactaccatgaacaaataagacctaagttttactttaccagcttgataacagcaagtgctcaagcacatacacagtgcactcttgtccacaccagcattttttaaatgtttgcatgacccaaaccttgaaggcacagctgccagatgaatgtcataacaacatgggtttttatgtcctgtttctcatgtgggaagcagcatcagcgccacctggtcagctttgtgcctcatctagtcatttggcctctgtaagactttcaccttcaaaatgtctgtgattctccaatatctctaatgtagtggttagggtcatagattttgaagccagactgctggagttcatatcatagctctgccacttcctaaactatgtgaccttggacaagtaactttaattgtctgtgccttagtttcctcatccagaacatatatctacctcatagggttgtggtgacaattaaggggcttgaataaaaagtgcttggagcagcatttggtctatagttagtgctgtataagtatctgttattattattattggtctgtagtaagtgctgtataagtatttactactactactattattacttccttgtttggccagtgacccagaagcataaagtgaacctcttgtaacatgcagtttgatcactcatttagttgttgatcaaatccttacgaggcagcttccctacttcagccagtcttgtaggtgctgaagatacagtagcaaacaagacagagtttctgtcctgcttacattctgaggagatgaaaacacagggaattaaaaagtcagtcatacaattacacattgtattaggtgttatgaagaaattacaacaagaggaggtgttgaagtgtgtggggaatggggagagggtatttttttcaagttgaaggtggggaaagtgcagaattgaggggcatgaaggcaccctccctggggggaagcagccaggcagctggaacaggtcatatgggtgccccaaggggcagtaaggcatatttgagctatgtcatgaaggaagatgtggcgggagagaactgagcaagagggagatgcaggggaatgctgggcaagatagaggtggagccagatcgtgtaggtcatggactgcctggggatttgattgtaagtgtgattgagaggttttaaacaggagtggcgtgatctgagttattttctaaattgatcgtatgttctttttttttttttttttttttttttttgagatggaatttcactctcatwgcctaggctggagtgcagtgatgcgatctttgctcactgcaacctccacctcccgggttcaagtgattctcctgtcgcagcctcccraatagctgggattacaggcatgcgccactatgcccgactagttttttgtatttttagtagagaaggagttttctccatgttgatcaggctggtctcaaactcccgacctcaggtgattcacccacctcrgcctcccagtgtgctgggattacaggcatgagccactgcacccagcctcttaaactgatcatatgatattggttctcaaccaagggtgactttgcccycagaggatacttggcaatgtctggagatactcagttgtcatgacttggacaggtgctactgtcacccagtgggtagaggtcagggatggtgctaaacataggacagctgtcaagagaaaagaatgtacccagccccaaatgtcagtagggctgaggttgagaaacccagctgtagctgacgtgtgaaggacagactggcggggagtgtggcggggcctgggtgcctatgaaaacagacagaggagaagctgttagaatagatccactgagcgcygaaggtaaactggacaaaggtggtagcaatgaagataatgaaatgtggttgacttcccaatgtattttgaagggagagccaacaggatttgctgatcagttttaatatgagatgtttaagactcagtcaagatgacacccaaggttttacatctaggtaaatagatagtagcattaacaaaaacggagcagataaagagaggactgggtttaaggggacagaggagaaaagttgtctttatcagccataggactagaattctagtgtccagatttccagacaaatctattttccactctccctattactccagtgtcagaaaacattaaattgccaggggactatgggctgagtgcccataaaaagttgaaggcattgtgcctagtaagaggccagatacttcctatggccacagaattagagacctaagggtagaggtgattttcaaggtgatcatgtgatacctgagcaccctctgcatcattgcttccaaataattgcgtggcatctgcatgatatttccagtgacaggaagccacctgcagacattcctgaaacgcagatgaatgcatggaaacagtaatctaagatctacctccccgcaactttgcatctttaagcctagttctggcctcccggataataatgggaaggaagctttcaaatgaacccctaacatgtgcatccctctttgttccttacccataatcttgcttccttggaaggcagctatgattactaatattttacaggtaaagaaactgagattcagtgagaacttgatttacccagggtcacatagttagcacgtggtctcagacttgaatcragcgatttaatttttaagtctgctgctccatccatcaacacagtagctgcctttcacactttatataagacacatgcagcagaggcctcagaagccaggcttgggccgttcttttggttactggaagtcctctaattcatcaggctctagccatcctaaaaaggactttgacctaagcataagggacacacgtgagcataagattttggttacttagtagaatcagttggtctcttctcaactgcacagggttgagaaaagaccagaggctgtgtgccatcatcaaccagctcaactgtttttactgccaacccaaaatgaaagaaaaaggtaccagcacagtgttaaactgtgttgcctgactgtgggctgttggaaacagtagcagcttccacaggtggaatgcatatttttgagcaagaaagtttatgtcctttgtgttagagccctctcagaaggaagaaaacacttcttaggcactgtacatcctttaattcaaaatataccaatgtcttatccccattttcagattaaaaaaaaaaaactgaagctcatgacgattaagcagtttactatggtcacacagctggggtgctgtagaactaaaagatttaatccaaagttcatttactgtctttattaattagctcatgtaactgggaaattcaaggggtggattcaggtacagctggatccaggctgtcagacagcatcacgtggaccctagctctctttccttgactcctacctctcctttcctctgagctgacttccattttagtctttccccagaggtggccaaggtgaccattgggccacttaggtcatttactcacccctgtggctgggaggtgagctcagtcccaccagaaacacttgaacggaagtaaagaaggcaattcctcaagaaaaggaaaaagtactacaccctttcagactttgggcatgttatccatgtggtctcctgctcccatactgaacctgtgcaggaaagacagctcatcttcacccctttggagctcaatgcctggcctgggggagttgcttcagtgacagcctttctgagccttagtttcctcacctataaaatagagagttatggccgggtacaggccggctcacacctgtaatcccaactctttgggaggccaaggcaggagaattgcttgagctcaggagttcaagaccagcctgggcaacatagcgagacccgatccttttaaaaattttacaaaataaataaaaaatagagagttatatcagacgaccaaaatcctttccgtgaagctctgaaaacttttaattggtctttcagaatgtgtttaacttcttaaatttttaaatttattcatatgcttatatatcagagtttgaagtatttataaatagttgatttctcatgctgttggtcaaggtgaaaaagaaatctgtgatttatgtgcccgtttactttgtaactatatctattacttgtatatattagtaaacatatattattttctttattctgtctctgttggagtaatttggtctaaaacctggtttatttgaatggtgaaaagaagcgtatcttaattaaaataacttctcaaagagaaatgtttgtcagaaaaatgtaaacctttcctagcacttggaaaataaaaattctttattttgttctgttttaggactgtacgaaaagaatatatcactgcaaagtatgtagatcataggttttcaaggaagacctgttcaacttcatcagctaaactaaatgaattgcttgaggccatcaaatccagggatttacttgcactaattcaagtctatgcagaaggggtagagctaatggaaccactgctggaacctgggcaggtaaggcctcactaaaatcattggataaaaagtaatgtggaaaatcagtttaaaaggtgacttattttaacattataccatataatgagattcttatacattgggtggccatgtctaaatcaagagaatatgagagtgaaraggtgtgctccttataattacttgggggcaactgatatatatgaagcctcccttggcagagcatattattgacttacttatacttttctttccctttttaggagcttggggagacagcccttcaccttgccgtccgaactgcagatcagacatctctccatttggttgacttccttgtacaaaactggtatcgtttttgttttctctgttgaattacctgaatatgccttataaattaacacaaaccagtcctatcagtggcctagatcgggaattggcaagctttttctgtgtcatgctagatataaaaattatttttggctttgcaggcatgaagtctctctgtcagagctattcacttctgccatggtagtgtgaaagcagccactgacaatgtgtaaacaagcaagtgtggctgtattccaatgaaactttattattttgtttataaaaacagacagtgaaccagatatggcctacaggctgtagtttgccatctcttggcctttataaatgtaaaattatgtctgtatccaaaaatctgctgcacagattggacacatttgctaaccgttaggagaggttaaaagagagaagacttaacagcacaggtcaaccatatttgtgagttttcattgttcctaaatttaatataagacagcagcagtgtgtgtggctggatcaatagctcattcaagtttgggatatactgatggaagtataagagtgaatataggaagtttggacttgctggattctttattctctttatctgttctgtaagcaacagatgatgaggaggaactagagctcatctaaagaagaagatcaaaatagtgaggggatttgaacccatagaggaaaaatggtacatagacacaagccaaattgtataaaagtccaggtttcttcctcagagacaatatagcatagtggctcaaaacattggctccagagatagattacctgtgttcaaatatccctgcttcaccatccctatcttgaaaatcttgaaagcaagcacttcagcctctctgcgcttcagggttttttatctgtaaaagcggttattattagtatttaccccatcatatagttgtaaagattcaatgaactaatacatgtaaatgttaagaaacagtgtctgtcccrtaggacctggcactctaaataaatactgcctgttatcactgtattgcttataaatctaggttagaaacatcataattttctctattataataattaggtctcaaatttgactcagttgtcagcacaaaaataagtggctaatctatagttttaagttataaagtaagtcatttttttctaatcatcatctaatttttcagtgggaacctggataagcagacggccctgggaaacacagttctacactactgtagtatgtacagtaaacctgagtgtttgaagcttttgctcaggagcaagcccactgtggatataggtaagagtgtgtctagtgtcttcatgactgtagtaagcgtgtgttgcatggtacattgtaatttgattattgttccttgccttcttaaggtgtttcctagataattatgcaaattaatttttttcctatttcagttaaccaggctggagaaactgccctagacatagcaaagagactaaaagctacccagtgtgaagatctggtaagcaaaaatggacgtgggagatttattagacattggctgccttaaaagtgtcattctgagaagctagaattgaatattaaaaatgcagattcatttttttttaacacttgctaaagaaaatcagatgagcaatgtgctacattasaaaaagtggtaaaatgataaatttgtcatccacatgtttttggaatgcagttaaaggaggtgaaaggcattacacaagtattattaccagatcgacttgtgcattgaggtcatgctttttatttcccagaccattagactttctctgcagcttaatagtaaagaattatttgagaagctgctccaaaaattgggcaagtaaagctcagagagtagtggtcttcaaaatgttaacacactgttctcccagcccctccccttcctgtgcacattcaccttttttgaccctactagttcttgcttagcaagtcagggccttcacattagtgtgattctcttgagtttctgctaagtgccaggttccaggcccaccagttgggcctttttattcttaaaagaatcctttgagacaattatccctgctcccattttatgaatgagaaaatggggccacagattggactgggaccttaaaagcctacgtcttaaacttcaaagactcgttttgcctttcagccaggaatttgcaagtttgaggcccatttaataagaagaaagcttttaattttggagacaagtcatcaaaataaagaaggctctgcctgcaattgtttgcatttcttcttgagcctgtcacatagcagtgcagcttgtctaagcagagtgttgcctatagtacacctacagatgattcattgaaaactaggaataaggtgggatttgctcagtgtttgtataatattgggatgtttcagcatttaaattaaaatggtgcacatttgctgttccttccagctttcccaggctaaatctggaaagttcaatccacacgtccaygtagaatatgagtggaatcttcgacaggaggagatagatgagagcgatgatgatctggatgacaaagtgagtgtaaattatgtcctcgaattctcaacaactaccccarcttttctagtctgtgtagacaagatccatttttggtgagattgattgattgtggttttatgatccaatgtatcagggccatttatgttgttcagtccttattgggcaccatttaacagctatattaaggttgtccagagaaacagagccaacaggatagggagagagacagagaaattttttttaaggaattggctcacatgattgaaggagctgtcaagttcaaaatgcacagggcaggccagcaggctggaaatcccagcaggagttaatgttgcagtcttcaggctaaagacagtctggaggcagcattccttaccctttgggggacctcagtctttttaaggcctttctttggctgattaggtgaggcacacccacatcatgaagggtagttcccttgactcgaaatctactcatttaaatggtaattgcatctaaaaaattcctttrcagcaacatctagaytagtatttgaccaaacaccaggacactgtagcctgttgacacataaaattaaccatgaagctaggcatggtggctcatgcctataatcccagcgctttgggaggccaaggcagaactatcgcttgagaccaggaattcgagagcaacctaagcaaaatggtgagaccctgtctctacaaagtaaatggatcaatcaataaaacgtggtggtgctatttgacaagctgaggcaggaggattgcttgagcccaggagtttgaggctgcagtgagctatgattgtactactgcactcttgacctgaatgacagagcaagaccctatatcttaaaaaaaaaaaaaaaaaaaattaaccttcaaaacaagtaattagtaagtaaataacagttgttatttattgaacataatcatgcactgtataataacatttcagtccacaacacactgcatactcaatggggatcaatataagattaaaacggagctgaaaaatagccatcacctagtgatgccatagatgtcataatacggtagtgcaacacattcctcaaatggttgtgggatgctggtataaaccaacctactgcactgagttgtataaaaatgtacagtaatgtcctaggccttcactcacacccagagcagcttccagtccttccagctccatttatggaaagtgtcctacatagatgtaccattttttaatcttatataacatgtttttattttacctcttctatgtttagatacacaagtaattaccattgtgttacagttgtttacaatgtttagtatagtagcatgctgtacaggtttgtagcctgggagcaataggctataccatatagcctaggtgtgtagtaggctctcccatctaggtttgtgtaagtatactctatgatgttcgcacaagaacgaaatcacctaacacatttctcagaatgtatgcctgtcattaaggaatgatgttcattaaatatggattagacagatttaagcacttacgttatctcagatcatctttattgaaagtccataactgagtgctgtggctcacacctgtaatcccagcactttgggagggtgagacgggtggatgccttgagcccagaagcttgagaccagcctgggcaacatggcgaaaccctctctctacaaaaaatacaaaaattagctggccgtggtggtgtgcgcctgtggtcccagctgcccgggaggcagaggtgggagaatcacctgagcccaggaactcaaggctgtgatgagccaagattgtcccattgcactccagcctgggtgtgggtgtctgagtgagaccctgtctcagaggaaaaaaaaaaaaaagtacataagggacattgttatccccattttacagaagagaaaacttacaaagagaatttagcaacttgtctaaagtctcccagctagtaaagacagtttggaggattaaacccagttctcactgagttttccttataagcagttaactacctctgaaagttcattcatgcattaattgattgcctatgtattggacatttcctgtatcacaggcaggatgtaaggaatggccaaagaggtcctcaagccttaacaactttaagaggaaataaattataatacaatgtgataatcattataagagtatrgaaaaattcctgagagctattcagaggaccaagcagctgcctcagtctgccttctcaaggacattggagatgggtttctaaggataggtggaagcttgccagggaaagaagtggggtggaatgcatcattccagaacaccacgtgccaagggaaggagtcatggtagagtctggatgtcggaggaatggagagaagcactgtgtgtgagatgcattcacctggctgggtggggagaggcaggcagctgccttgtagagtcaggcaaaccagatcaggatggctttgtgggcaaggtttggcctttgggtttttgtgcaagcagtcagaagcccacagaggtttattgtctaaagagcaaggtttcccaccagctctggctgcagtgtggagaatggactggaggaaggaaactggagaaggggccattctggaggctagagctgcagtgggagctggtgagcacctgtactagraggggcttcaagggatatttccaargggaatgcaggaaccagggactccaggtgacactgaggtttctaacctgggcagttgagtggatcctaatgccatcaccacaagcgcaaataccagagatacctcatgggccattggtttggaacacaagtcactggggttgtatttacagatctgtaagtaattattgtgtagcgggcagtgggtgtgaatccgtttactttgcagggggatataaaatgagaaaagaggcaaagaaagaacttcaacgttaaagggttgagcagggaacaaaacttaatgtagcaaattagaaataggtggaaatactattcaaatgttgctgaaaaagtcctgcattctgaaggtgtttgcttattaaaagttaaatctacctgtgaccttactgtgcttctgacactgctgctgatcctaaccagtgtttcactagtgtgattattcatagtggtgaacgatatgaaagtgtggtatctagatccttcccttgtactgtgtcagcatcatgaggctcattgtggctgacctcataaagctcagagagccacaggaacccagattcccacctgagcccgccctgcggaggccctctgtacacatgaagggtggtccttgattattatctcaccttcttatttcatctgccagccaagccctrtcaagaaagagcgctcacccagacctcagagcttctgccactcctccagcatctccccccaggacaagctggcactgccaggattcagcactccaagggacaaacagcggctctcctatggagccttcaccaaccagatcttcgtttccacaagcacagactcgcccacatcaccaaccacggaggctccccctctgcctcctaggaacgccgggaaaggtatgggctttgagaagggcttgtgactccatcctcgaagggcttgtgactccatcctcagagctgatagtctagccagctttgaggtaagaattgcaaggtacatttgagtggcgcggatcgtgttgtcaggagcagcttgaaatagggaccatgccatttgccaggtaccaagagcaggacaggcagtgctgtgggctctctttgtgcattatttgtgttaaccttacaacaatcctgtgaagtatgtgcttttgtgcccattttacagaagaggaaactaaggctcaatgagatacactgaccagcccaaggtcacaccactggtaagaggtaaagttgagattcaatctgaggtccacgtggctccagaacctgtactttttrtaatgtggagtggagtttcagttctctggaaagttacttttctctacattaaaatgccactcttttgaagacgctagtaataatagtggtagttaatagttatggagcacttgccttatgagaggctctacgcctagtacttcttttgtaatcatctcaaaatgaggtaggtgctattatgcagttactggcatcatgtraattaggggatttgttcagagatactgagtaattggcctgtagttctcagcctgggattctaacccaggttctgtgtgaccaaagcccattctcttgtactctctaataaggaacatttttccagagacagtacttggagaggaattttttttttcccttgagacaggcctttctcagtcgcctccatctccggggctcaagtgatcctgatcctcccacctcagccttccaagtagctggaaccacaggtgtgtggcaccatgcccagcttttttttttttttttttttttttttggtagagatgaggtcttgctatgttgcccaggctggtcttgaattcctgtactcaactgatcctcccaccttgacccctcaaggtgctgggactacaggcttgagccactgcgcccagacgaggaatcccgctcataggagggttgttgtgctgtgagttgtcaaatgtctcacagggctggcgcctcaggctaccattaaagtgttgcctcagccagtagggataattgagaggtacccagagctatagcttcaagtttggtctttgccagtgaatccaaatgcagggttctccctgtgtgctcagctcgtgctcccacaggtttcatggcttctcgctacacaatgccatgcctatttgaatcacactagggctattttctgggaaatgtgagctttattcaaaacagtgttttttcagagcttattctctattgaaatagtgttataaatgggagctgtgttcttagagagaccccaaatggcctcatagatcataaagtaatagagaaaagttaaaataacgctttggcatgaacagctatcctcaaagataaccagtggccacacagtaatagtgcatgtaagccaaaggtctaacccaccagtgttttcttaccattccatacattgtactaaaatgtatgtttttaaatcactcacatatcaagctgcaggtctgtagtgtaagaatgctgtgttgctgcttccctgtgggtaatggcattccccatcagggtagcagtctgacagagagcagagattctctttctgcaccctacagaggactgtgagaagcctccagactgaatrcaataatggaaaaagtgactgaaagatttcacatctcctgagtgtggttaccaacatagcagtggggacctatctagacaggcacagcctatgcctgttcagagagcctctaggtcattgagagtcctgaaaatggtttataggagaaaatgacaccagagtcctgggggccaagagaccccctcatttccctccacccccttctgtaattttatctcaagggggacaacagaaacccataatatatactgtctgactttgtgccaggcatatctctcatgtcttgaataaattctaactagctctttaccaaagacccagaagacaaagactaaatttatttagtgttccagctgctgaaacaagtgtttgagacttggccacagcaaccgtggtcatctaaggatacagtactttccccacttcccccaaaaaaagcccataattgaaaatagaaatcctccctacaaaaaccaagagtgttcttcatggctgttcacagcaggacatcaaattcagagatttggcctgtctgctggtgagacatagggagtacagccttctcatgacttttataagggatttgaagtgtgcgatatcccatagctagctcagctcacatgcgcttacatttggaaaactgataatgtttagaatggagctcttagaagacattgttaaagatcagctgatactctgtgtgcagagataattcttctctgtttttttggcccctatgttttttttcatttccttctgttgagctgatagaaccatttgcatgaaaacaaggatgccttggatctctcatttgagttccttgttctccatgacaaataaagcagaggtctctatttgcagcagaagtcatttcctcaactgaatttaggggtctgaaggacccctaaattaagtcttccagtgagacagaaacagacacttgagataaagtccccacaaaagcgaagaggagaaagaattattctgaatctagctgagaatattttcaagaaactccagctgcctcatcgaaattcaaggaagcttgacctaaattaccgtcaagcaaagcccccttgtgcttacaagtgagcagtgccccagagtctcagaggagctcagtagctcagaatcccaaaatcactatcctcaagccccataccgaaacacttcgctgcctaacccctcttcagatgtggggtcccgagagactaaatcaaagctgtaaaattaatttgtgtgtggtagtttctcgtttgtgatcagtagcttccccctgcccccaccccacttctactgtacgtttattaacactggttcttggaccgggtgcrgtggcttacgcctataatcccaacactttgggagaccgaggtggccggatcacctgasgtcgggagttcgagaccaccctgaccaacatggagaaaccccgtctctactaaaaatacaaaatgagccrggcgtagtggcgcctgcctgtaatcccagctactcgggaggctgaggcaggagaatcgcttgaacctgggaggcggaggttgtggtgagccgagattgtgccattgcactccagcctgggcaacaagagtgaaactccatctcaaaaaaaaaaaaaaaaaaaaaaaaaaaaaaaaaactggtttttgaggcttgccaagattagtttctttttaacctttgattaagattaattaaaataatatcacagaacctaggtttatttactgccaccatgcccagctaatttttgtatttttagtagggacagggtttcaccacattggccaggctggtcacgaactcctgacctcaggtagtccacctgcctcggcctcccaaagtgccaagattacaggcgtgagccaccacacccggccaagcctgttaaattaacaaatgctctggataatgagaccgggcacttggtaggcatcttaactcaaagataggatgtgttaagtaaaagaatgataattccaatctcaagaaccttctttaacatgcttaaaagaactaaccttttaagcgtttagaaaggtgaacacctgatatgctaattacagttcattcccatctattcctgaagccaggcctctagaatcaggcattatatagcccttctcaatagcatgtgaatacctgtaagtattaattcttcatttcatacacatttgctataatgtagacttcctaccttagagaggctctggcttggaactaataaactagcagataacctgcacgaaagtagcgtgctgtgtggcatactgagagcgtcaatagatgcttgttgttgaagggttggtgccacagagaaaattgaaccagatgctacccttgccaacaggtaggtgaagagactaactactctcattaatcaaagtatatgcagtagtttgagagtaacaaactaaggcagatcagtctgtgtcaagccagaccatggctgcctagacagctgtgaactcctgagaagcctttccagcrtcaccttctcctcttccaagaagccttcttttccgtgccacacaaaagagactatggtggtcgggcgtggtgtctcatgcctgtaatcccagcactgtgggaggccaaggcaggcagatcacctgaggtcaggagttcgagaccagcctggccaatatggtgaaaccctatctctactaaaaatacacagaattaaccaggcttggtggcccgtgcctgtaatcccagctactcaggattctgaggcaggagaattgcttgaacccaggaggcagaggttgcagtgagccaagatggcaccactgcacttcagcccgggcgacagaatgagactctatctcaaaaatacatacatacatacatacatacatacatacatacattttttwaaaaaaaaaaaaaagagagactatgggccgggcatggtggctcacacctgtaatcccagcactttgggaggytgaggcgggcggatcacgaggtcaggagatcgagaccatcctggctaacatggtaaaaccctgtctctactaaaaatacaaacaaaaattagccgggtgtggtggaggacgcctgtagtcccagctacttgggaggctgaggcaggagaatggcgtgaacccgggaagcggagcttgcagtgagccgagattgtgccacttctctccaacctgggccacagggtgagactccgtctcaaaaaaaaaaaaaaaaaaaagaagaagagagagactatagttcttcctcataaggcccaatcctgccccatacttgtctcatcctaacattgagccaatcttgctgattttcagagtcttcaactgaaaaataaggattaggtgtctaccttgcttagagagcatgaaataatgtctatgaaatgactggcacgtagtgagcattcagtaaatacaagtttgttcaatcctcctgcatgttttcagtttaacaaacattctgggcactggaaatgtaaagaagaaggaagaagtacctcccactctcagggctccagggaaagaggacacagtataatgtgcccctggggccactagggagtattcctggaggarcaggaaagagaagtgctgttcacagcttcagagagaggattagggaagtcttcaatgcactcttccagttaggagcagaactcctcaaggataagggctgtgaatgagctgcctttgcatccctggcacagagagtaggatgctcgtcagtactcgtcagatgcataaacaacagcagaaagaatcagtgaaagcatgtcccagaaataggtggccaggataaggaggggacatttataaaactaaaccagatgtccacaggtgtgatagttgacttgctgaaaatytaataaatgcagcagttgtgcccagacacagctgtgtatgcattttagacatttctccaactttccttggagatctgtggcagtagataggaagaagagtagaaagggtgaagacttgctcagtatrtgacagcacctgccaccatgaaagtacactactgcatgattcagactcgcatgggaaatattttcctatcagtggtgttattcatatattgatgactttacagtttcctgcggttttttatctcatgggaagacagtcattagagtagcttgatattaaagcttctcataggctgtcacccttgattcgtgttttgttttagggtgtttttttcatttgggtttggtttgcatttgggtttttggcctttttaaatcctttccccctgtcctttgtaaggcattgcacgtgaatcacctagtgctggcccagagtatcatctgtgatttttgccctgaatagtgaccttgactgaggctctctagctaagtcacctgactgccaggktgtggaaagggaagcagaggaaatccttgttgtgcctctggcattcaggggtggatgagttaattgttaaagaatcagccctaagtctctygaatcctggtactttcttcttaattatcagtgtcatagaaggaggtggaaggacagatggatagctaatgctgtttcctgtgtggaagtcagttgacagagcaatgtggcacatatcatgcccgggcaccagcctgtcctgtaatcctggccagccctgctgacttacactagtgtcccagcrcactctactccaccatgcctgtttctccatctgaatgtggagataacagctcctccgttctacactgagtccttctttgtataawtatacggttaattactttttaaagtarttaacttaagctttccactcttttaagctttatactatgaaaaccattagatcagttaggaggaataagttcaagagatctgttgtacaacctggtgcctgtagttaataacgtactgtattcttgaaaattgctaagagaatagattttaaatgttctcgctacaaagaaaaagatgcatacgtgaagtaatgcatctgttaattagctcaatttagcaatttcacaatgtacagttatcccatgccaaaactccaggaatgctcaagtgccttatataaaatggtgcagtatttgcatataacctacacgcattctcctgtgtactttaaatcacctctagattacttgttatacctactacaatgtaaatgctrtgtaaatggttgctatactatattgtttgtttgttgttattgttgttggattgttattttttattgtgagtttcttttttctgaatatatttaatccagggttggttgaacctgcagatgcagaactcccagatacaaaggtccaactgtatacatattttaaaacaatatgttatacataataaatatatatgttatcaattaaaaataaattgaaaaaagaaaactattagaaagtgataaaatcttcatgtatattgtcccaagttggatagatataacttttgtcattacccttcctatgtggcagcttagaatgtgtaaattatgtttctacagacaactttttcagaaactgtcaagataatttttaagccatcttctaggtctttttttttctttgaaacttcagttatacttttatttggtctcccagtgtaagagacttttggtttttctgtgtgtaactaaaaaccagatatacaaggatattgaaaaaacatcctcctgacttacatcatgaattatctttatagtcgttgtttgaaatgcttgtttcccagtgccataaagaaatagcacttgaacataaatttaattttttcagcaaggccgtttttatactttctgtagaaagggtatacttgccagcagttttgccacgagagtacactgaacaaatgagacaggatcatttataacctgacgtgtccatcctattgctgtgtccagtttccattggctgttttgtatttgtcctgattggctagtaacttagaactttttaaaagagttgcaaaggcagagaacaaaggacggaggaagtaacttgtggaatgctgagaaaggtaaaaacaccttcaaataaggaagaggaacaggccatgacctaatgcttgcttgaaccagtataagcatgccagggcaaagattcaggctaaattttgggaactaagaacataaagtacattgatttctttattatggctagcagagatttaaaaatgttagcacaggtctttgaataaattttacttctaagagaagttactatttattcctaattagatggggaggaaagtctttgaagaggaacctctactgtactttttcagttgtgtactgagtacccagagcatgccgggccctggcaggagagctgtggagacagtacagatcatgccctatggatgcacacagtctggaaaggaagagaaattgtagctgtaatgtatggtagagaatatccattaagccctggaagctcagagataagagtgggtattccagggaagaggggatggattagagaaggattctggatgaagttacatttgaactgacccttaaaaaaatgaagatgtaaccaaaacctgtgggatacagtaaaaacaatactaaaaaggaagttcatagcaataaatgcctacatagaaaaagaaaaacatcactaggtgcagtggcttacgcctgtaatcccagcactttgggaggccgaggcaggtggatcacctgagggaggtcaggaattcaagacccaagaccagcctggccaacatggtgaaaccccatctctactaaaaatacaaaaattagctgggcgtggtggcacacgcctataatcccagctactcgggaggctgaggcagaaaatcacttgaacccgggaggcagaggttgtagtgagccgagatcgcgtcactgcactccagcctgggtgacaagagcgaaactccatctcaaaaaaaataaaaaaataaaaatgtcaaataacctaatggtgcacctcaaggaactagaaaagcaaggacaaaccaaatccaaaattagtaaaaggaaagaaaaaagatcagagcagaaatatataaagttgcaactgaaaagacaatacagaaaagcagcaagtgttgtgtttttttgaaaagatgaaaaaaattgacaagcctttagctagacaagaaaagaagggagaagacccaaataaataagattagaaatgaaaaaggaggctgataccacaaaaatacaaaggtcattgtaggagactattataaataatgataggccagcaaattaggaaacctagaggaaatggacaaattcctggaaacaaccaccaagattgaaccaagaagaaatagaaaacctgagcarattaataataagtaacaacattgaatcagtaataaaaagcctcccaacaaagaaaactccaggaccagatggctttattacttgaattctgccaaatctttaaaaaacagacagctaggctggatgtggtggctcgtgcctgtaatcccaatgctttgggaggccaagtcaggaggctcacttgaggccagaagtttgagaccaatctgggcaacatggtgagaccctgtctctacaaaaaatataaataaaaaattacttgggcayggtggtacctacctgtggtgctaactatgtagaaggctgaagcaagatgatcacttgagcccaggaggtcaaagctgcagtgagtcaagatcacaccactgcactccagcctgggtgacagagcaagaccctgtctcaatcaatcaatcaaatagtaaagaaaaactagcaccaattcttaaactgttcyaaaaaaattgaagacaaaggaatttttcctaactcttccaatgaggccagyattgccctaataccaaaaccagacaaggacacaacaaaaaawgaaaactaccagccaatattcttgtggaacgtagatgcaaaaaatcctaaccaaatactaacaaactgaatccaacaacacatcaaaagataataaaccatgatgaagtgtgatttatcgcagggatgcaaggatgtttcaacatacgctaatcaataaatgagacacaccacatcaacagaatgaaggacaaaagccatatgatgacctaaatggatgcagaaaaagcatttgataaaattcaacatccattcataataaaaaccttcaataaattaggtatagaaggaacatatctcaaaataataaaggccgtatgtgacaaactcacatctaaatcatcctgaatgggggaaagctgaaagctttttctctaagaactggaagaagacaaggatgcctgctttgaccactcctgctcagatagtgctggaagtagtcctagccagagcagtcaggcaagagaatgcaataaagggcatccaaactggaaaagaggaagttaaattgttcctcttttcagatgacatgatcttctatatagaaaaacctaaagacgtcaccaaaaaacacatttagaactgatgaataaattcattaaagtgacaggatacaaaatcaacatacaaaaatcagtagtgtttctatacaccagtaacaaactagctttaaaaaatcaagaaaaagccgggtgtgatgcttcatgcctgtaatcccagcactttaggaggatgaggtgggtgcattgcttgagcttaggagttttgagaccagcctgggcaacatggtgaraccctatctctgcaaaaaaaaaaaaaaaaaaaattaaccaggtgtggtagcacatgcctgtagtccccagctagtagggaggctgaggtgaaaagatcgcttgagcataggaggctgcagtgagctgtgattacgctactgcactccagcctgggtgacagagaaagaccctgtctcagaaaaaaaaagaaaaattgagaaagcaatcccttttacgatagctaccccccaaaaaactaaaaaacccaggaataaatctaaccaaggaggtgaaagagctctgcaatgaaaacttataaaacagtgataaaagaaattgaaggggacaattaaaaatggaaagacatcacatgctcatgattggaagaattaatgcagttaaaatgatcatactaccaagagcaatctacagattcgatgcaatctctttcaaaatactaatgacattcctcatagaaacagaaaaaagcaatcctaaaattcatatggaaacacaaaagacttcaaatagccaaagtaatactaagccaaaagaaaaaagctggagtcattacactacttgacttcaaaatatactacaaagctatagtaaccagaayagctttgtattggtgtaaaaacaaatgcatagaccagtggaacagaacatagaacccagaaataaatccacatatttatagccaactgatttttgataagggtgcaaagaacatacattggggaaaggatccttctttaatttgctgagaaagctgggtatctctcaactcaagatgaattaargacttaaacataatacccgaaactataaaactactagaagagagcataagggaaacacttcaggacattagtctgggcaaaaattgtatgtgtagcacatcaaaagcacaggcaacaaaaaaatagacaaagcagacgatatcaaactaaaaagcttctgcacagcaaaagaaacaatcagagcaaagagacaacctgttgaatgcagaaactatctgcaaactattcatcttacaagggacttgtatatccggaatatacaaggaactcaattcagcagcaaaataataatgataatgtgattttaaaatgggcaaaggatctgaacagacatttctcaaaagaagaagtagaggccgggtgtggtggttcatgcctgtaatcccagcacgttgggaggccgaggtgggtagattgcctgaggtcagggcttcgagaccagcctggccaacatggtgaaaccccatctctactaaaaatacaaaattagctgggtgtggtagcatacacctgtaatcccagctactcgggaggctgaggcaggagaatcacccgaacctgggaggcggaggttgcagtgagccgagaacacaccattgcactccagcctgggcaacaagagtgaaactccgtctcaaaaaaaagaaagaaagaaagaaagaaagaaaacwcgacatataaatggctaataagtatatgaaaaaatgctcaacatcactaatcatgagagaaatgtaaatcaaaaccacaatgagatattatctatttccagttaaaatggctatcatcaaaaagacaagaaataacaaatcctgatgaggatgcagagaaaggggaactcttatataatgttggttggaatgtaaattagtacaggtactaatgaaaaacagtatggaggtttctcacaaaactgaaaatagcactgtcataccactgagcaattctactactgggtatttatccagtgcaaaggaaatcagtatattaaagggatacctgcaccccatgtttaytgcagtgctatttacagtagccaagatatggaatcagtctaaatgtccatcagcaggtgaatggatgaagaaaatgtgtatatatacatatggaatattattcccataaaaatgaatgaaatcctataggctgggcacaatgactcacatctgtaatcccagcactttgggaggccgaggcgggtggatcacctgaggtcaggttgcagtgagctgagatcatgccactgcactccagcctggacgacacagcaagactctgtctcaaaaaaaaaaaaaaaaaaagaatgaaatcctttcatgtgctacaacatgtatgaccctgaaggacattattttaagtgaaataagccaggcacagaaagataaatactgcatgttctcactcatgtgggagctaaaacaaaacaagaaaagctcaagcctggacaacatagcaaaaccccatctccacaaaaagtttttcttaaaaaattagctgggcctggccgggcgcagtggctcatgcctgtaatcccagcacttttggaggccacgatgggcggatcacgaggtcaggagatcgagaccatcctggctaacatggtgaaaccccgtctctactaaaaatacaaaaaaaattagccaggcgtggtggcaggcacctgtagtcccagctactcgggaggctgaggcaggagaatggcgtgaacctgggaggtggagcttgcagtgagccgagatctcgccactgcactccagcctgggcaacagagcgagactcagtccaccaaaaaaaaaaaaaattagctaggcctggtggcgtacacgtatagtcccagctactgggcagactgaggtaggaggatcacttccagagccccggaagttgaggctgcagtgaactgtgatcatactgcagcattccagcctgggcaacagagtgagactgtctcaaaaaaaaaaaaaaaaaagcttatattagtagagagtattgagcttatattagtagagagtataagagaggttattagagttctgggaaggggttgagcggaggatgaggctgattaatggatacaaaataacagctagatgggaaggataagttcctgtgttctgtaacactgtagagtgactgtggttaacagtaatttggtgtatattttcaaaatctacaagcaaggattttgaatgttcacaacacaaagaaatgataaatctttgagatgatggatattagctaccctgatttgatcattacacattatacacatgtattgaaatatcactatgtatcctataaatatgtacaattgtgtcaactaaaaagtttttaggcctggcaccgtggctcacacctgtaatctcggcactttgggaggccgaggcgggcggatcatgagatcaggggtttgagcccagcctaggtggccaacatggtgaaaccttgtctctactaaaaaaatacaaaaattagccgggcgtggtggcaggcacctgtaatcccagctacttcggaggctgagacaggagaatcgcttgaacccgggaggtggacattgcagtgagctaagatcatgccactgcactccagcctgggcaacaaagagcaaaacttcatctcaaaaaagtgtytaaagatgagaatgtggaagtgaagtgataactcagttatgtccctgaaagttctagccggaaaggatgtgatgccatttagaggaagggaagcaagctgttgtcaaggctgagagtctggccttgagtcagacagaatggggttctgcctggacgtagctgctcatttgctgtgacttgccaagttcctaaaccctctgagccttgggtctttttatccttcaaatggataatgtgacaataatgataatattttacaagataaattttaaatactgtgttttagctcaagcacataatactcagtaaatggtagctccagaaaatgcaagaagaggaggaagagatttgaaaagcatgctgattatgattttaggaattaattttcattttttaaggtatatttatatctatttaggtataagtgaatgaatttccaggacattttttctgggctaagtggagagattgccttgctgagtactgttkggggagatattctyaaaccaccttcatagtttaagaatatatcgatttcccataagggagcttcagtgagaagagaatgtcagttcctgggrgagtctcaggagatcgctgccactttttgagagactaaattgttgggcccaggaatgtgggacaagagctttggcctgaaaactgcccgtgggcctgccagggtgarcatagtcacttctgcaatacactgcctgggtgcacttcctgagccctggctgtatgccgggcacacttctgacatagacctcagacagaggcatccccgaggctaaggacgttgaggtgctctggcagcacatcaggtaggttcagcggcaaccacttgagttgaaggcacagcagaatgtccaaatggagtgaccaagaggctgttggagatgtgggaagggacccaggcatagccagggtcagggatggggatgctgtctgtgcagggagggccgttaacaagggaggacggtgaagaacagatcagaagacacatttagaacccctggagaacagggcaggtgaggagagaagccacagagcagagtgccttgaggacaggcctgtgtccagagcacagcacctgatacccaaaagaggacccagaagtgcctccagaatgaagggtggtgagaacaggcaccagtgggtgtccacaatacagttttcaaggactttttttttttttttttttttttttttttttttttggagactaactgtcactctgtctcctaggctggagtgcagtggcatgatctcggctcactgcaacctccatctcccgggttcaagcgattctcctgcctcagcctcccaagtagctgggattacaggtgcatgccaccatgcccagctaattttgtattttttagtggagacagggtttcattatgttggccaggctggtctcaagctcctggcctcaagtgaccctcacgcctcggcctcccaaagtgctgggattacagatgtgagccaccatgcccggcctcaaggactttttctgatcatggattatttaaaaataaatatgtggcttgccttctcaccctgcagaacactagtcctgtcatccatctctgtttaagggcagggaatgctttctcgtggaaaacacatgctcctagatgattcagcttctttgaatgtgacagctgatgctaaactaacatgtaaaccctcaggaagaatgaggtgtactctacttcctcttagaagatcttctaattatttaacctcagatttattcatagaagctttggaaggctagacccatgtttttaagaagatatagacattatttcacatggtagccaatattagtggcaagtgaggtttggggcactttcttgttacttccacaggcctctggcagagttcaggagagaaaattgcctcttagtcacctctgcatctctgtcaccactcactaatcttgcctccccacccttttttgtgttgcgtttgatgctgtgttccattttattttgtttcagctttctttatcttaccagaattgcttttttcctgactgaaccagtactcagatttattttgcataaaagatcccttttaatgctgtgggactggttactaattttggaagtcttctgagctctttaaatcttcaaacatttttttaagtctgcatttctggggtcttatatatagtatttttcaaccttattttacctcatgtcttcccagccaagattttgtagcatcttcctttctgtagcttctactacaagacaatagataggtctgtctgtgtgtttgttttccaagtgtaagattataaacttgaatatcccttttcacacttaacactgttccctcctgctaattctccccacttgtttctgatcagtcaacctaagtgaaacrtattggcctccttaagaattactggcctggccgggcactgtgactcacgcctgtaatcccagtactttgggagtctgaggtgggtggatcacctgaggtcaggagttcaagaccagcctggccaacatggtgaaaccccatctctactaaaaatacaaaacttagccgggtgtggcggcgtgcacctgtagtcccagctactcaggaggctgagacaggagaatcccttgaatctgggaggcagaagttgcagtgagccgagattacaccactgcactccaacctgggtgacagagtaaagctctgcctcaaaaaaaaaaaaaagacaaaagaatcactggccttaggccaggcatggtggctcacgcctgtaatccaagcactttgaaagactgaagcaggtgaatcacttgaggttgggagttcaagacctgcctggccaacatggcaaaaccccatctctactaaaaatacaaaaattagccagacgtggtggcacacatctgtagtcccagctacttgggaggctgaggcaggagaatcacttgaacccaggagggggaggtcacggtgagccaagatcacgccactgcactccagcctgggcgacagagtgaaactgcgtctcaaaaaaaaaaaaaaaaaaaaaatcactggcctaaaaagatagaagtagtggttgagtcttctatttattcagtaaatatttactctacacgaaaccagagaaaagcctggccctaatacaactctcccagtcttatgggagagtcaggtaacaagtaagtaaacaaagacttaattagagattatactcagcaatatgaaggaagtcagaagtatataagggcatgggacgcacaattacttaatttttgaaatgattcaggaggttggattttacatggtttatggttacaggatgcctctttggtgtaatctctcctacagtctcatacatatataatgcagcgttgctcagagacatggctccattagcattttgtctttgacaatttttgtttcctagcagggaactgcatctgcatcagaaagtccctagatggcgataaagatgaaattgctagagaacctcrccattgtctattatctattatccatttatttccaaaaggaaagttacacttcctgatactgagcatttgttgttgttttcctcatatgccaagcacaggaaatgctgctctggctttcaggaaccagcagcatcatttgatggggtgagtgcctcgccagtcctggacacctgccttatcccagctctgcccctcatggcttgtgactttaatcatgcctctgagttctcggctgcaaaatggggacaatactacctgacccacatacttcacagagttagtatgaaaatgaagaggtacaactattcgtatccataaacattttttttttttaaatttagactaggcgtggtgactcacgcctataattctagcactttgggagggtcgcttcagctcaggagttcaaggccagcctggacaacagagtgagactctgtctctactaaaaatttaaaaatttttaaaaattagctggatgttatgatacatgcctgtagtcccagctactcaggaggctgaggagggaagattgcttgagcccaggagatcagggctgcagtgagctgtgatcttgccactgcactccaagcaggatgacaaagcaagaccttgtctcaaaaaaaattttttttaacgataaacctagggaagaagctgaggaatagcatatataaacacattttgaaaactacaaagcattatacagatgcaaggccataataacaatctctgtattgttacaaaaataaaatagtttctgaaaactgctgtgactgacaccctaattaagtgttgatttggggtaagcatcaggcttccattgtgtaatagaattacgcaatgggacaaagatgtaaattatatagcctggcaatttaaacctaaagcagatgataattttactgagattaacagtatttactttcagaactagcctatcttatagaaataatggtttaagtcaatattggtagggactagtaattgacaatgggaaataggaaagcttactttgtaccaaggaaagaggccagcagtaattagacttttttttttaatatgaagagtgtataaagctcttttggagcccttctggattactaggtatctactaatctgtgttaaacattcagtgtggcagtgttcttagctttctttcttttytttttttttttttttttttgagacggagtctcgctgtgacagccaggcaggaatgcagtggcatgatctcagctcattgcaaccgccacttcctgggttcaagcgattctccagcctcagcctcccgagcagctgggactacaggcgtgcaccgccacacctggctaatttttgtatttttagtagagacagagtttcaccatgttggccaggctggtcttgaactcctgacctcaagtgatctgcccacctcggcctctcaaagtgctggagttacaggcgagagccaccgtgcctggtcctagcttttttttcttaacgtttacagaagcagtttgccatgaacacagttaaaccatataccttaaataaagcaatagtagtgaaagtgcccagcatggaatacctggcacacaccagccacttcaatgtcactttgaataaacaaaactaagatcaaatacactactcccttaacagcttttaaaaacgaaccccatttttgtgtgtatgtggartattactatcattcctgctgtcttgtctttagctctggagaaagttgagtcttttttttagtctataaaaatcagtgtctatataaatgttgttcaggcttccaatataacagatggtttggtttctagagcaaagggtttttggatttctcttttttctaggtaatgctttacgtccagttctttcttcattatttagaaaagccttaattttttttttttttttttttaagaaaagcgtcaggcagtttgctgactagaagaaaaagttgtagaaagaaaaattctattatatgaatcatttcatgtttcagcttgtggcccagtgaaggcttagcctgtactctgttctttctctgttgattttgytggtagtggtgtgtgatttctccttcagtaggttctgtgatggttataaggagttattgttttaagatgtgtgtgtgtgtttgtttttcccattgtacctaaatgatctaaactcagtagcattctgtgttgactggcattttgttcctaaaagcacacactcttcttacctttgttgtaaatttttctctgttgcctaggctggagcgcagtggcataatcatagctcagtgtatcctcgaactcctgacttcaagtgatcctcctacctcagtcttccaagtagctgagactacaagcacacaccaccacacctggctaattttttaaatttttatagagatggcgtcttgctgtgttacccaggctggtctcaaactcttggcctcaagcaatcctcccacctcagctttytacagtgcaggggattacaggcatgagccactgcacctggccaattttattttttttttaaccaaatttttgaaaccctacttgtgagttattaggttgatggagttagccatatccagccttttgcttttgtctctgtgtgtcataccacattctgatgtgtggaagtgatttcatactggctgttttgtatctgtgagactgggattaatcttcctgcccccattcaatttcctttctaggtccaactggcccaccttcaacactccctctaagcacccagacctctagtggcagctccaccctatccaagaagaggcctcctcccccaccacccggacacaagagaaccctatccgaccctcccagcccactacctcatgggcccccaaacaaaggcgcagttccttggggtaagttatcctaaagtcagggccaaagctgctggggccaggcagcgtgtggggctccactgggcagtggcctgttagcacattcagaaagtgtgccaaaatgcacacacatgctgggtgctgactygggtatatatgacatgattctacctgtctcttaagggaaaggaacattttgaaaaatatttaggccattaaaaactaaaaggtgctgagcacttcctaaatcttactcaattataatagcaactctgtgaggtaggtattattagtctcgtttatatataaggaaacagaggctcagaaaagcaaagtaatccattttcctcacaacagccagaatggttttcttataaagtgtaaatcagctcatggtcacttttctccttaacacccttttgagatttccttttgagcttcagataaatgcaagctccctatatcaaggcccacagggccctgcatgatcrggctcttatctcctagaccctctcctgccactctatcttcagggctggccttctttcacttcttggatacaccatcctctgcctcctgagggccctcccactccctggaactctgtcatgctttttgaacagctgcttccctttcatccttgagttctcagccagcatgtctatctcccccgccctccaacgcagcttcctccctacctgttttcccccaaacaccttatcacagaatgtaagccgccccactaaaatgtaagctccatgagagccagaaccttgtcttggtcttgttctcaccagtgtttactggaaccacrcctggcatacagtgaatattcaggaatcacttgagaatgaataaatttgcccagagtcagcttgttaatcatttcagtgacattgactgcacatgacaaattcccatctacaagggacataattcccatctttactactagcctgctagcgacttaggggtcaccccatcacgaaacagggtcttggcccgtgacagacactcacagaagctttgctgaataaatttgttagtttgtgtgtctcacctcttcctgctgtggagtttcattgtggctttcttcatattttttgtgttttgagttttgggggaaagttatattgtcccgttgctgattgtcacctgttcaccatctggcccagacaccccgggttatgtgtgtgcaagcatgtgtgtgcatttagccgttcattctctgactctgtttgcttacttgaggcacttactatgccccttgcttgggccttctcagtccatatgctcgtggagttcatggtctaatgcaggacacacgtgggtaagtcattagagcacatgttctttactatcaggatagacatgttgtctaaacactagaaatgccagaaaactgaatgtcagactttagaggaaagccagggaaggtttagagaagaggagacattggagtttggtgttaatgaattagttcccmcaagccaggcaagaacaattgaggtgtgctagcacatatgtacataaagactaaggatgtccgtgacattttcagaggctgctgtgtaaggccttcgggatccccagatttcatcaaaaaggcctttcccccaaataacattccatgaaagtcacaagtttcacatcagcrtttcatatcacaaattaacctcctttccaaatttctctttaagttttaatcctcttgtttaagtggctttatttcttaaggtttgaagtgcctttattcmcattgtatagactcgaacattcctcaaataaatttaccaaatttctgctttctggcttgaaaatcatcacttttttagattttcacatcactcaagagcaagactagcagctggccgtttttccccccattgttgatgggtcagggagcattttttattaaacaaaatttactttaaaagagtgcctgacagtgagctgggagccttataaccttttccagatgaggacgctgttctgtctgtcagtttctcaccagctaagagcctctcacctacaaccagccttgaaggacaaaaatcatcatctgtcctcggccacagtgacagttcgccacatggcatggacttttgattgttgaaatcaaaattttaaatttaaaaaacaatttaaatttttttttaaattttgattttagaaagcatatgttggtgtacatgcatgtatgtgagatatactgtctacagacacaggtcagtaatgggcatgtatgtgtgggtgcattcatacacggctggacttctccttagaaaggttatagttgctctgctcctagtgcttgaggtctgtgttgtattattactgcttggttttatcccttccccgcctcctgctgacattgtattgtagaagccaaaggcagggcccagacaggtcatcagcaaggcacttaggggatcaaccttctaggcaaccttcctctctgatgcctgcagctttcgtctgtggacgcacctttccaacgctcttatgttcccctaaacctctcatctctcctcagcccatgaggatcagggcctttgaactgtgagagatcaggactgggaggtagacaccaggcaygagcaggtagtaaaagaacagccccttagctctcaccaggccttacctctccacccccaaagctgaacatgtctgccatcttgaggtacaccacattccccaaagttctatttttttctctcagatctgagcctttgcttacagtatgccctcaacctagaatcttcttccctctacttctttatgttaatgtttagtcatctttcaagatctgctgtcctgggatctacttaaaaggccttttgcagtccagtaaaactccccactccccacccttttgtccccactggtgtagtgggtatcacagtggctgtttccttgcctgtctttcctagtacatgaactccttctgagggcatgtgctgcttctctcagcagagcaaagtgctctaaggtgaactcaagtgtcatactgtctggattctcattccatctctactactcaatagccttgtgattttcagcaagtatctttgaaatgttcagtgccaaagcttctccaactataatatggggctagtaatagtgtctgtattgcatatggagttatgaagattaaatgagaagaacacataaaaagcaaccaaaaccataggcagcacccaataaatgatagctactgttaccattattctcagcctagcattttgctggatagctagagatgggagaaacctgcattmgtttcctgaggctcctgtaacgcataccgcaaactggatgttgtaaaatgacaaatttattctttcagtattagaagctagaggtccaaaatccagcagggttttgctccctccagaggccctgtgggaagaatctgtttcttgcctctctcagcttctggtgactccaggtgatccrtggagtggtgcagcctctgccttcatggtcatctccccactgccgccgcctctctgtgttctcagaactgcctttgcctctctctcataagtgtacgtgtgattgtatataggacccacatgaattttctgtgataatcttgtctcgggaggccaaggcgggcggatcacttgaggtctggagttcaagaccagtctgactaacatggagaaaccccatctctactaaaaatacaaaattagctgggcatggtggcgcatgcctgtaatcccagctactcgggaggctaagacaggagaatcgcttgaattcgggaggcggaggttgtggtgagccgagattgcaccattgcaccccagcctgtgcaacaagagcgaaactccdtctcaaaaaaaataatctccttgtctcaagatccttaacttaattatatttacaaagaccctttttcctagtcaggtcacatttacaaattccagggatcaggactcgataactttgggtggccattattcagcctaccacagcttgtcctctgacccccaaagagtcacatccaacccacatgcaaaatatgttcacccatcccagcaacctcaaaagtctcaaacccctgtcttggccattgttttttctagtcttcagagaagatgtgagctgtcatgtactcctctccccactgtgcctaggatttcctcctccagattcacaggggagatttgggggtaatagttgttgtcagcagctctctattttttagatcaatgggttcacgctgatcgcttgcctaacattaaatrtggaatcaaacttgtaaagtaggcaagactcgaggcctcctgtcccaatctgttttaggccacctgttcacaccaccactctgttgtacccaccagtctcactagccatccatacagcagcactggcatcactcccatgacccctccctgcagcacattagcctctttcctcagccaggtggaggtttccacctgtcaagttctcttttttttatttcgaaacagactcactctgttgcccaggctggaatgcagtggtgcagtcccagctcactgtaacctccaccttatgggttcaagcaattctcctgcctcagtctcccgaatagctgggattgcaggcacccgccacmatgtccagctgatttttgtatttttaatagagacggggtttcaccatgttggccaggctggtctcaaactcctgacctcaagtgatccacccatctcggcctctcaaagtgctgggattatagtcatgagccaccgaacttggcccacctgtcaagtgtgaagcctatacccctctttggttccccgacatttgtgtttctggtctcaggggcacctctgacattcagctcctttgcagagtagccatggctgacaggtcttggctctgctgatgatcacactttctatgctgatgattagccccgcccagtcccccatgctgacctttaagaaggaggtagaaggtggtttaagaaggaagtagatgttgcatttagccttggaagatgartggaataggcaggaggaaataagcaaggcagctgatgttgagtgttttgtgagaacgagggccagagatcataacctttaatgcatctacttcacagaaggccacacttccttcattacaaagagtctgtctttccccctctcaaattccatttcatgccttcataaactcctttttctttgtttttgagrcagggtcttattctgtcacccaggctggagtgcagtggcktgatcatagctcactgcagcctccacctcacaggctcaagctatcttccyacctcagtctcctgagtagctgggactacaggtgtgcaccaccatgcccagctaatttttgtattttttgtggagacggggtttcaccatattgcccaggctggtctcaaactcctgagttatgtgatccacctgccttggcctcccaaagtgctggagactaccggcatgagccaccacacccagcccatraattcttaatacaggtttatggcttgtaagacaaaagaaaatgacaattcattattttagaatcttcggataaaaaactacgtacgtaatattttataaggccatcacttgtaagtgcctcacagagtgctgggcattgtgttgagcacttcgcatrtgttaacgtacctcattcttaaccatggttacacagagagaaaatgctattatctcaacttcggggcgcagaaaggttaagtgatttacactgtttctcacagctagtacgksggggccaggattcacctgcagcctgtgtggctgagagccagccctcctcaccctctccacgcaccactctgtgctcgcaaaatgcaggcccactggccatttctcctcacagcagtggtttctgtgcccatgaagctgaagtgtggagaaggcgatcaacttagcatggttctcctggcaagcagcacaagctctgctggctgtgcctccttatccatctgcagcatggcaccctggtatgcagctcctgcgctgcccaggctgggagggccaccccaggctttttccctgccagaaccacaacatccacagtgcccaaaatagccccagcrttacattactgaagtcctgcttctgtgatgaatccagccatctgtctcaggagacttctaaggcaggcttttgatagcaaaacaaatagtcctgtggacagatttgggttttgtagggaatttatgatttttgaagttgcatttcattgaacctctttcctttttttttttttttttttyttaaagacaacgtcttgttctgtcgcttaggctggagtacagtggcacaatcatggcttattgtagcctcaacctcccgggcccaagtgatcctcccatctcagcctcccaagtaacttgggactctgggtgcgtcacaccacacccagctgattttttaatttttgtagagacaaggtcttactatgttgcccaggctggtctcgaactcctgggctcaggtgatcctcctgccttgacctcccaaagtgctgggattacaggcgtgagcctcttcacccggtcctcctctttctttaataacctactttataacagactaacacatattttaacacaatttaaataataagaaatgaggacaaagggagaataaaggtagcaaagtaaggtgaattccaggagtgtgatttctccacaaaatgagtaacaaaaagtcacatacagtgtctggaagtgggccacggatttgaccctaagattcttacaggcaagagcaaagagagaaatacaactaattgttaggttcatggtagccttaagactgacactattctaacactcttgaattaatacctrataacaatttcccccctcccctggccctccatcctttggcatttagagaagtgtctgcagtgcacgtgggaaaccataacatgcactgaaagaacattccagaagcccaggttctgatccaggttctaccaatccctgacaaagtgacctctgggaatcacttacattcctcatctttggtcactgggagttagaattgtacttttatttaatatagagcaaataatggatgaaaaactataccaaaaattggtttactgcttatatttcaggcctgggacttccaggtaaaaaagctccatagatgaaatgtctgagacatgcatatttacttattttcttttcttttcctttgtttttttgttttttcttgttgtttgtttgttttattacatatctacttattggaagtgggactgtcattgtcccagttactgatgaggaaattaggcacagagaagtcaaatgacttgcttaagatctcaaatccaggaactgcagaagtgagatttgaacccatttccaactccaaggcctgtatagtaattcactattccagaatactcctgtagcaacctggccattcgctgctgagccaatgccccctctctttccacaaactcttctcctgtagcttcgaagctatggtaggtgaccaggagtcttggccacacttcttccattgcctgcccaggaggtatctccaactttctcttacacacatctgtatgatacactaagacctttttccaaattgcacagagagagaaaaagggattgagttgcttccatatttttgctgctcattgtcctcttttcagtactattttattttcagaattttttctagccacacttttcttctcaagcacagcaggtagcctttgcatagctatgagagtgacaggattcttgtcaaccagaccatagacgcctacccagccaggtgtaagaaggtccgctgtgggcagagaagttgatgagccagcacggtcagtcctgtctttcgctagcagggactattgactgctctgtgccagacattttgttaaaaagtggtgttatcggcctggcgcagtggctcacgcctgtaatcccagcactttgagagaccgaggcaggtggatcactcgaggtcaggagttcaagaccagcctggccaacatggcgaaaccccatctccactaaaaatacaaaaattagccagacrtggtggcgcatgcctgtaatcctagctacttgggaggctgaggcaggagaatcagtgaacctaggaggcagaggttgcagtgagctgagaygatgccgttgtactccagcctgggcaacaagagcaaaactccatctcagaaaaaataaaaataaaaataatggtgttaccaagacatagaaggtggggtccattctttgaagtgaccactcattgagtaaattaacatcatttctgtttcatgccattgaagagctgtgaataataatacccttgtgtcaggcttcctgtggtctagcactgtgtcccgtactttatagtttatttcctttaatactcatgcccatctagggtagtaggtaccatggttgttcccagttgatatatgacggaatcgaggcttagcagaataagaagtcacccaaactcatacccactggtcagcagtacagctagaattcaaagccacacttgtctaggtccaaaatctgcacccctaattaaccactcctggtaagaagctggttataagggctggtcaagtcagctatggaagaattctcagaaagtgactctaaaggtgttctttgaaggttgtgtaggaattcaccaaaactggaaggagacaggccttccttgcagggaaaaggaacgtaaggggcaaagttacagagacataaaaactcacaccatctttggaaaaaggagactcattttgagaagccaaagagtaaggttaagtgagaactctggacatttgggcctgtgggtattgggcagcagcccctgacatgatgactcgtctgtgtgacagcagaatgaatgaccacagcagagccagagggcctttgcagccctgttggtctcaaatttactcatgtatagcacatgcaacctgcattaataatcacttctttggaatgttttctacctggaaagggaattagtggatgtaacagttcattccccaaacataaaattttccttgacgttttgattgttataactcatttaagtgggaaagtataagatttgatatctagccctgaagactcatcattgagcacagtgctagaaagaaatgcctaccaggctaggtgcagtggctcacacctgtaatcccagcactttgggaggccaagacaggaggatcacttgaggccaagtatttgagaccagcctgggaaatacagtgagaccttgtctytaccaaaaaaaaaaaaaaaaaaaaaaattagtaatgagaccttgtctctacaaaaaaaataaaaattaaaattaaccaggcatggtgggtcatgcatgtagtcctagctacttgggaggctgaggcggkaggatcatttgagcccaggagtttaaggctgcagtgagctatgattatgccactgcactcccacctgggtgacagagcaagamcttgtctcttaaaaaaaaaaaaaaaaaaggccacgtgtggtggctcacacctgtaatcctaacactttgggaggccaaggtgggaggatcagttggtctcaggagtccaagaccagcctgggcaacttagaccccatcttgaaaaaataaataaataaaaaataagaaaaaaaataaatgccctaccttgaagaacatcacagctctgaggattttatgagttaccaaagaagtccttaaatattaagttatatgggctcatgaacatatactgatggttagtttaattaaaattaaataaaactaaatttgaaagcctttggttcytctagtaatgccagtttatctcatttcttcttgtatcaatatcatagaattacagaacattctgtccaggaggtgagcaccctgccagcctctccctcttcagtaggtgcagtcagaccaggaggtgataggtgctagagtgtggtgattcacagtacagaccctggaagagggctgctggctttccatcccagctttgacccttaccagtgacctgaccttgggcaattgactttacttctctgtgtgcttcttcatatataaaatgaggggtgattatactatttatctcataagcataattactatgagtatgtagcacagtatgttgctcacagtaagtgctcagtaaacggtcgttgctgttaataatgttactatcagggcgtcttgatgggtaatgaagagcacattgatttgyggtcaggactcccaggtacaccatttccccacgggacctgcagccatttattcatttagtctcatttccttatcttatgatgccagtctcatgctgtgaggaaggaaggctggatgaatataaaagcatgtgggcaatcggtggtgctattgagcagatgtgcagtgtagtgaggatcagttagtttttttttcagccctgccctcttcatctgccctcctggtgctcagcctcctcagccagcccattcccagtgccacctaggcagtattatagtcttctaggtagaggaggagaggaggctgctgaaagaagagaacaagagtttccagagcagtcataggaagaaaggacaaggaaatgaactagagccccagagacagggtgcccatgcagggtcccggggaatcctcctgggtgcctgcagcttggggctccacaactgccctgcactctgcccaccacaaaatggatcatagaagagccctcatttattgtcttgtgaccctctcctggacatagcacacttacctccacctgtgtgcctctggttttgctgctcacccgctagaaagttcttcacctgtccaggtgctatgtcttccccagacagcattccctactccctcttccccactcctgccagcagtcagagtttagaaactattctcctcaattgacagcaactgatgttcatctcattacacattattagtgtatttcctatgtcttaagtctcacaggccagagcataagctctgtgagagcagtgaagttttatttgtttttgtgccttctgcttcacatttatgccttgcacatagtagatgcttaataaatgttaatacttggccgggtatggtggcttatgcctgtaatcccagcactttgggaggccgaggcaggtggatcaccggaggccaggaattttagaccagcctggctaacatggtgaaaccctgtttctactaaaaatacaaaaattagctgggcgtggtggtatatgcctgtagtcccagctactcaggaggctgaggcaggagaatcacttgaacccaggaggccgatgctgcagtgagctgagattgcaccactacactccagtctaggcaacagagtgagactccatctcaaaaaaaaaaagttaatatttgaatgaatgcccctgtagtcccagctacttgggatgctggacaggaggaacacttgaactctggagttcaaggctacagtgagccatgattgcaccactgcactctagcctgggtgacagagtgagactgtctcaaaaaaaaaaaaaaaaragagaatgaatgacgagtcagtaagtgcctgagggcctggcccaacagatgaccacttatccaccaccctgctaatggtgttcacatgcacattccacttgtgagttgtgtgtttcttctgagtttggatactagagggtagtctcctagcatgaggcctcttggtgaacttgaaatttattcttctttctctaccctcaaactaaggacaagatcctgagccagtgggaacatcaccaagtttctatgctctttgaggccttgccacagagcagctgctcacctctttgatacactcctttaccagarataaaaaaccgcaaagcccaaaacagtgctcagttttgttttggtcttaggccagaaatgcatgccgttttggcttgggtcttttaaatgccgttctggaacctgagcaatgcctgtctacaggccaaacccatgtattctcattgcatttccccatctaaagacataccttttcaccttcggttttccttgtaggtaacgatgggggtccatcctcttcaagtaagactacaaacaagtttgagggactatcccagcagtcgaggtaagccatctcagcgcttcatttcccctgttggatccattgatgcaatggacagaattctagaaatgagttttcatgaatttcccagcgctgctcaaagctgtggtcagccaagtggggcwggccacaacaagaaaccagacgttcactcttggtttgcatgcacatcttgtgactggactgggcacaggtctgcagaccgttctctgagcagcaacgctgtctacccagttcacagacaggagctaacctcacttcccggtggtcgcagggttgtgcagtggtcttgaacaaaattcctgtcagaatgagtttttatttttgatattttaatcaagtaactttgttacttttccacttgactccttttgcagatttggaaatgaaaagataatccttagggaaatctgattgcctggagattttcaaacataaaaatagcactctttcaagttctgtttctaatatttttttttttaggctaggctgacagcagtgttcttttcttcccttttttcactgaaattgtatacttgaggagatctcttacgggcartttttatccagccttaccctaaagtgttttctctggaggtgccatccaaggaaaggacagagagccacttccagacccaaacttcagggaaaaagagtcagctcttatccagagtttctgaaagatgagaaaacaaaatctctctttttttgagatagggcctttctctgtcacccrgactggagtgcagtggtatgagcacagctcactgtagcctcaacctcctgggctcaagagatggtcctgcctcagcctcccgagtagctggaaccagaggcatgcatcactgtactcagctgatttttttatttttttgtagagacaaggcctcagcatgttgcccaagctggtcttgaacttctgggctcaagcaatcctcctgcttcagcctcccaaagtgctaggattacaagtgggagccaccatatccagccttttttttaataccactatcttatgtactctttataaccctgtgagataggcccaattactattatcctcagttttgcaggtgaggagagcgaggcccagagtggttaggtggtgggtgcagatgtcagagccagctctccagcctacttgttctcccaactccacattccacaccccttccttgcccttgtgccctgcctttcattcctcactcaccttccttcaaccctaatttgggggaccctgtaaaactaaagttctggtgttctttttccagagtgaggagaatatctgacactccaaaagcactcataaaaggtttttaaaggctggacacagtggctcacctgtaatcccagcactttgggaggccaaggtgtgaggattgcttgagccccgaagtttgaggccagcctgggcaacatagcaagaccttgcttcctaaaaataaaaaaaatcagccgggtatggtggtacatacctggctatacgggaggctgaggcaagaggaccgcctgagcccaggaaattgaggctgcagtgagtcatgatcgcacctctgcactccatccggggcgacagcaagaccctgtctcaaaaaaaaagttttggcagggcacagtggctctcgccactttgggagaaccaatcccagcactttgggaggccaaggcaggtggatcacttgaggtcaggagttcaggaccagcctggccaacatggtgaaaccccgtctgtacgaaaaatacaaaaattagccgggcatagtggggtgcgcctgtagtcccagctactcaggaggctaaggcaggagaatcacttgaacctgggaagtggaggttgcagtgaaccgagatcacgccactgcactccagcctaggtgacagcgagacttcgtctcaaaaaaaaaaaaaaaaagtttttaaacaaaatcaagctgattgtgaactagagcctttggcaactcgttaagtttgtttgtttgcttttgagatggagtctctttcaagagaaacaaagccctctcatgtttactgtttcttgtttagtggtggctttatctcagcaatattcccccgttgcccagagacaggaggatttcaagtgagctgaggaaagagcagtgaagatcaaggatggccaagagccaggacagaaaggagcacacacctttcatcttctctctttgactactttttgttttgttggttggtttggctttttcttttcttttaaaygcagttagctgaggcacaagaatcgcttgatcccgggaagcagaggttgcagtgagctgagatcgtgccactgcactcyagcctggtgacagagcaagactgtgtctcaaaaaaaaaaaaaaaaaaaaaaaaagcagcagcarcagcaaccaactcttaggacatcaggggacagaaatggagagatgagataataaaggggttcttggcagatggggctcaggcacttggctactgctgcttctcaggcatgcaggcctcctggtgtcctctgagaatcgccaaaacctcttgttaaagaaaaatagtggcttccacctaatgtagaccactgatggcactggggtttcagttgcagaggttaacgtttgatgatttagacaatgtggtatggacctgtattccagggacttgggcctttgtcaccctcatttacctgtcctccaaaaggaaagcaaggcctaggagagcctggaggcccgagaaccaagctctttgctatagtggaggaagtgagggctctggaggcccaggggagctagggccgaatttccacttctacctctgacccacgtgagaccttctgccagccgccaacacccccattcccttccatttccttgtctggaaacacagagctgctttgtgggatcatgtgggaagagttacttctgtgcactacattggggtcaccacttagagtgtgccaggtgccttcataaatgctttgaagtggaggagttgggctttatcattaagagggacttttttttcatccttttactgtgcctcctcagccaggcaaactgaaatatggaaaatagactaatcttttgttaaagacattttgaggctgggcacagtggctcatgcctgtaatcccagcactttggaaggctgaggtgggtggatccacgagctcaggagtacaagaccagcttggccaagatggtgaaaccccatttctactaaaaatacaaaaattagccgggtgtggtggtgggcacctgtaatcccagctactcaggaggctgaggcagggaattgcttgaacccaggaggccgaggttgcagtgagcagagatcgcgccactacactccagcctgggcaacagagggagactccatctcaaaaaaaaaggaaattttgaaagcattctttagatgattatgtaaatacctttgatttgatttacttgaataatattttgctattgatattctagcacttttagatcctaaatgattcttatttgttgattagcaccagttctgcaaagactgcccttggcccaagagttcttcctaaactacctcagaaaggtaagatctatcatttttacatttacatgtaattaaagtgtcactaccccctccaaggggcccaaggtttttatctcccttgttcattgatccatcccaaatgcctagagcagcacctggcatgtagtggatgcctagtaaatacacattaaatgacgaaaggtatttataaactcaaatttggtgattagcaaagcaccatacttttccagaatacataataattttgtagacattacattattataatccccaggaaccattctttctccccttataaacataatcagagagacttgggaaccaacaccagctctaccacttagtagctgtgtggccttgggcaggtgacgtagtagcttcactaaacctgagattcctcatctgtaaaatggggaaaataatacttcgtgaggttttgtaaggacaaaatgaagtcatgtttcagaaagtccccagcaagtgggtggcaaaggaatccttccctaggatggcatctgttgtgcagagtagagatacccatgctctgcaaagtacaagaaagcagtgtctataaatactgtttttttgccaagctaagacactcagctctttgactgagtcttctttaatgctgacaaggttttcatttgtgaaaccaaaatttcagtcttcttattacaacacaagtgatagttatgccttttttgttgtcgttgttgttaccataccttacctttaaagctgcaaaatacctttaggagcatctagatcattccatccttctataagcctgcaaggccagcagggcccaccttggatacagacggaagctcsgaggagctcagggcctgctccttggattttcagtgccagcagcaagatttgtgaccccagtctagtgctccgttgcctagtttgagcagaagtcaaactgggggttagtattgggaagctgaaattcaccactctctagagttcttcagtgaagtaacacactttgaagagcactgactggtcaggccaggctcctgtgtagtaagatgaggggactcccaaatgactgctgattcactttccgtagaacagatgcaagacttcccctgggtttgctgagtctttatctagggttggtttttgttgtcttttatttttaaactctgcccaacgggctgttttgatctcagaagagtttgaaacaagtttcccaggcatgtatccccatttacagtgtgcccagattccgtcctagatcgctcacatatcaccctacctctccagcctgctttctctagcagcagaccccagcacttcccagtgcccatggggctttaccgcaactgccgccagctcttccctgcacccatcccctccatgccctcccttccctcgcagcatggcgtcagcccatcaccaaagtcactccctgatgtgctccctcagctcctgcccctcctgtgctgggttctgccactcaactgacttctgagaggcacagtcagtgtggcagtctggctctccctatgactgctgacctcacatggtcatctggggctgcccagcagtcccagcaccgcaacctttcagcccactcccctacactgtctctcctctccttaggagcaccttgtttctgttcctcattgagtcagcacaggagtccacccctactaccacctgcctggcatggtggccgtggtcctaaggtagaccttgtaccctcccaccccctcggggacagactccagcaggtgtccctccatcttttgcattgctgtttccttccatctgacttgccctatcagggcaggcctactgtcaatacccatgaagacctgtgtccctcctaccaccaccccgttgctctactctcgttctctctgtgtgtgtgtgtgtgtgtgtgtgtgtgtgtgtgtgtgtgtgtgtgtttactatttggaattttccgtaataaacatatacagaaatacaaaaaaagacacagaatagtatcctgcagcctcctccaccacacccacatacttatcacccattccagcacttaacagtttatacctgatcttctttcatctagttccctgcccagccactctcagtaattctgtagcgaatcccagccaatttcatacatacgcaattctattactacatcaaaaaattcatcatgtctaaaaaatcaaaaatttcttaatatcatcaaatacccagtgttaacatatccagctgtctcacaattgccccctttttttttttaaraacttgtttgtttgaataaggattaaaataaagtccacacagtagagttgattgatttgtctctaagtgtcttaggctaaagtttcccctgcatctctctttttatttgttgaagaaactgtgttattcgttctatagatttctccagtctagattccatcccctcgtgtttgttcatctaacgtgttcccctgcctgtcatatttcctattaattggaagttgattccagaaacctgatcagatagattgaggctttggcaaaaccacttcataggtggtagtgtgttctatcacgaggtgtacaccatcgcattgtctctgtgtgtgaagttcacagctgttaatgctcagagccaagattgatccatccatcctctctttccatccctctgcaagccgatgggccagcggttaagcttcagccctgtcttccttggccgtctgcagctcttggcacagtcactgcttctcccctgcctggaacgctatgtacttgtgttctggacactacctgtccactctcgctgcactgtcagttccttcccgacccccttaactgctttctcgtctcctccacctcagcatgttgagcaccacaggccgtggtcatggactgcttctgttctgcatcttcccttactccttaactcatccaaacagtcccacagctttacacccatctggaaagctccacatttgtatttgttttttttttttttgagacggagtttcactcttgttgcccaggctggagtgcaatggtgcgatctcagctccccgcaacctccgcctcccaggttcaagcgattctcctrcctcggcctcccaagtagctgggattacaggcatgtaccaccacgcccatcaaattttgtatttttagtagagacaggggtttctccgtgttggtcaggctggtcttgaactcctgacctcaggtgatccccccgcctcagcctcccaatgtggaaagctccacatttctatctcctaccaaagtattcgtccataatccgaattcaccaacaacagcctatttcacatcgccacttgatgcctgtgggggataattctctaactgtgtttttcctctgctctcacatcacaacaatcatcaacacagaagaagatttctgtgacaaacgtgtggggatttttccccacacaccaagcagcagacaccagttgggtgtcctcgaattcagttccgacactgtctacctgaagatagtgccagtcccaccgggtgagagctcagtccccaaaactgcccccccccgcgcgcgcgcgcgcgcacacacacacacacacacacacacacacacacacacacacacacacacayaccarttgcaagtccaggccttcagaacttctgactgactggctacaaggtggggctcctacaactccctctttggattcatttaatttgctgtagcagctcacagaactcagggaaacacatttaccagtttatcataaaggatactgcaaaggatacagataaagaaatgtgtagagagaagtatgggggaaggggtgctgagactgggtaatttataaagaaaaagaagtttaatggactcacagttccatgtggcaggggaggcctcgcaatcatggcagaaggcgaaaggcacgtcttacatggcagcaggcaagagaaaaatgagagccaagcaaaaggggaaaccccttataaaaccatcagatttcatgagacttattcactaccatgagaacagtatggggggaactgcccccatgattcaattatctcccatcagatccctcccacaacatgtagaaattatgggggctacaattcaaggtgaaatttgggtggggacacagccaagctatatcaggtgcagagcttccaagccctttctggaaactccaggagcctccacatggtcagctctccagaggctcactgaaccctgtcctcttggctttttatgaaagcttcatgatgtcagcattccttcccccagggtatagggtaggaccctctcatggaaggtgttttaagacccacaatcggaatagagtcctgccttgggataggtaataagagggcaagagaaggtcaggggcctgcctcagaggcctgacacacctaacataataacagatgactataacaagggttataagccagcaactgtggacgaaaactaatacatatcatagcaccacagcctactccctggttttctactgtggatcctttatatcaaaaaacatatatatacacaatcattaataattagtccagtccatcatagtgtatgaatgtctcccaggatgatgaggacactcaggtttgcaggtttcctctcaatattgtcaggttccacaagcaggagtggtctgggtaaatacacagcttcaccctctcaggcatgtggaatcattgagctaagaggcagtgtcatctcttgccctgagactcttttgagttgtctcatttgcccatttatttrtttactctcagctactatttctccttctctccattaatctccaaacttttttgaagggacattagaatcaccactgtgctggtctagattacaagcagcaatacaagtctagcaagtagctcctcagtccactcccattcagatagggtgaggctacatagatgcagaaccaatgagctatttttaccaccggccatattcactgttagccccaattttgttagaaggggtgaaggcacatctcacccccatgatgccctcaggaattttgacataatatttaaaaacatggttacagttttttacttagcattcctgctaaaaattttttgaagtgttgggcgcagtggctcatacctataatctaagctctgtggaaggatgggaggatggattgaagtcaggagttggagaccaacccaggcaatacagtgagaccccatagctaaaaaacaaaaatcatctttgctgtcccagcaactcctgtcctaggatcactgcatcgggtaggggagaaaaaatacttttttttcttagatgatttgggtaaactctgctttctctctctctctctctctctctctctctctctcccctcccctcctcgcacatccgcctagagttcctcaggtagcatgatcctctataaaccagttccactttattgtggaactcttctaggcactgcttccccattagaatgttcttggacatcacctgagacannnnnnnnnnnnnnnnnnnntgagtacagtgatgcatgcctctggttccagctacttgtctgtccccctctctctccctccctctctccctctctccctctctccctctctctccctctctccctctctctccctctctccctctctctccctctctccctctctcccctcaaggagtatctcctccttgagttcctcaggtagcatgatcctctataaaccatttccattttattgtggaactcttctaggcactgccttccccattagaatgttcttggacatcacctgagacagcatgggtatttcagatgtcataggggtaacttcaactaacatttcatagcaaggtcccttaagtggaaattctctattccaaagtcccagtagttgttgctgggaggtgctcaaaacacttttgccataagccccaggaactgctccacagggggttatcaagtggagagtttgtccctgccagcactctagcttctactctgcactctgcaggcttgggcatgtccaattaatattggagagcagatttacatgccttctgttttatagtaccaggtaggggaaacattctccagtgtgatactgtgttcattaccatgatacaatcaaataaaagagatgcagtcggccgggcacggtggctcacgcctgtaatcccagcactttgagaggccaaggtgggcagatcaggaggtcaggagatggagaccatcctggctaacacggtgaaaccccgtctctactaaaaaatagaaaaaattagccgggcatggtgacgggcgcctgtagtcccagctactcaggaggytgaggcaggagaatggcgtgaacccgggaggcggagcttgcagtgagccgagattgcgccactgcactccagcctgggcgacagagtgagactccgtctcaaaaacaaaaaaaaagagatgcagtcaattcacatgaagtgtgttcaaatataccaactttcatcatcctatcaacccttacatttttatattctagtttcaggaacttcttcacccccagaccattttactctctcttgcgcaaaaagctttgggtcttctgccaagggttgagccaaaggaccctggaccttttgtcaatctttattttgattagtctgccccatttttgccccaggcaatttcatatcatatgtttcattgtaatctctaccttgcaacttttaaaatttcttcaaactgcaagaaatacagtaaactgggttagggccgtttaatgttgggagagcggaggggtttggtccacccaagcttcgataatgttgtattaagatctttgttgtgctcacttcggcagcacatatgctaaaattggaaccatacagagaagattagcatggcccctgctcatgaatgacacgttattttttaacaacagcaaaaaaagacctttgttttggtaagcgcagtggctcatgcctgtaatcccagcactttgggaggctaaggcgagtggattgtttgagctcaggagtttgagaccagcctgggcagcatggcagaaccctgtctctacataaaatacacaaaattagccaggcgtggtgccacatgcctgtagtcccagctactcaggaggccgaagtgggaggattgcatgagcctgggaggcagagattgcaatgagctaagatcacgccactgcactccagcctgggtgacagagcaagaccctgcctcaaaaaacaaagacctttgttttaactgtatcaatttccattttattcattccatttcttaataaccatctaaagatttctaccctgctgggatgagtcccatgactctcccctttctttttcttcttagttttatcctatcagtgttttcttcaccttatttgttaataaccattttaaaatttccaccttcctgggaggagtcctttggctctcacttttgcctttccctgttctcttgttaattaacctaatatttttattagcatctataagacccatgaagggaagctgagacagcaaatttaataaggcttcttgaactgttcatttctgtaggagtaatatcacatggggtgcccatgtagaaggggccctcttaaccacacatttaccatgacttgggtaacaggcatgttcagcgtgtgaatagccctgtcatcataaagccagtcccacatgcatacagagcatatcagctactgcatctggggtgtcccacttgacatttgtaggtagagttggacagtcscccttctcagggtgaacagaccttacagtggcttttatctgttccaccaagctgccagttaccgcaggaatagcctcctgtgtgtctggatcatrtatacccatatgcagttgttcaatagtgagctgtgggtcccatcaatccaaacatgtacttctactctgtagtgtttaaaaccaaagatactgcccctaaattagtcactcttacagtgcgttttagtaaaggttcctcaggaagctgatgatactgatctacagaatgaaacagttctttcgcactataccctctagtttccatagttacttagttttgcccctccttcacattgactaccttcttggtaaccacaagtctcagaggtactttctgttgtccctgcgtaattttctcctttgtgggtaactttaaggctagtggactaagctcaggcagacccacatctgagcttagtcyagcctcaagtcctgacccagcaccctcttttattttagccattatagacaacaataaccagggattaaatatttcacttttttcttagtttgcatttctttrtgcatccagtgccccaactcmtggggagttggatccatctctgaattccactggtaacttttacctttagtaactgatctcagcacagctgtggcttcataccctgggtgaccacatggccacataggaatccaaagattcctgatcccccacccttttatcctttctcttctcaaaccacatgtttctgtgagtcagagctgttccaacaaatcctgcttcgctgataccaaatgtgtggtgtacggctcccagcagactgatttttatgtcgctattaatataaaccttgatgatcagatgctttgaaagatctttgggtgtaaaggacaaaatgtaatggcagcatacacaacatgccgcagtgtgctatgtacacttttatcaccgttccttttgtggatgaaaagctattaagcagaatacaggaaaacrctgggttcttaatgggattaaagcagtggggctgggcacggtggctcacacctgtaatccaagcactttgggaggcccaagctggaggatcacctgagtccagaagtttgagaccagcctgggcaacatgatgagatgagaccttgtctctacagaaatttgaaaaattagcagagtgtggtggtccgcacctgtggtcccagctatacaggaagttgaggctggaggatctcttggacccaagaggtcgaggtagtagtgagccatgtttgcaccactgcactccagcctaggtgacagagtgagaccctgtcaatcaatcaatcagtaaaatagtgggcatcacatagtggatctgagttcctttagggaatggtcccaccctgagacaaggaaagctgtaggaggccttgtggcacactcacactaaactacatgtagatgtgaccaccactcatctaactctagtatgggtcacccaacatttctgggtgcaaaacatatatcctaactgtactcaggcctttactacacactgcagcaacatgcatgttggatgaaacaacactgacccaccagacagaaaagggccttataggagataggtgcaggtctgggtatcctgggataagttgagtttgctttcaatgagcagcagaattcagaggaaaatgcagattagagggagttctcttccaggaggaaggcaaaaggatgggagtcagcttggaaagataaggaggctttggcagagtgagccaggccaactcaataaacagtgctgaagagaatgctaagatgcagctttgggaaagggcctgtacccagacccaacagggcctcttcacaattttaatacaaatagaggctgaaatggggggcagtggccctcagtcttggctgctgaggctcagggcacacctgtgggactcttatggccctctgaatttacggaagttctctgagggcacttgcagtttacatcaatgtgctatgactgcccatgcctttaggttagggcaaagtaaaacatgttctgcagtgtagttggtaggtakaggaactattctaaacacccatcaaatgaatgaatgaatgaatgaatgaaagaaaaagaaacaaggaaggaaggagagagagagaagraagaaagaaaaaagaaagaaagaatgagaaagaaaagaaagggaaggaaaggaagaaagaaaagaaagaaataggccaggtattgtggctcaagcctttaatcctagcactttgggaggctgaagcgggaggatcacttgagcccaggagttcaagaccagcctgggcaatgaagtgagaccctgtctctatttaattagtaaaattaacaccacccatgtactgtctgcaggaggcaggtgggctgtgctataactgatagcacccagtggaaaccagcagtacaagcctgtgagatgagacagggtgattggctctgcccctaattaatttcaaatccagaaatgactgagtcatggccattgtaacaacacctgtccttaataacatttggtatatgggcaaggggagattttattgggaaggcaaaggaaatacctctgtcattcttactaatctataatgaagctaaattgtaccacgattgtatcacaatatggtgtaatactgggggcattggtaaggttcagcttcctcatgtaaataagctttatgataatactgatacgatcagatgtattgggaggttgagttgaagctccctcaggatggaatgcctgtggaaaacggcccaagaaggaactggatctagctaaccatcagctgatctctgtgcgaaacagctctgcacaagtttatcctaaggtccaatagcggtagaccaaggcaggaaagaacagtgaggctagtacacgattatgaaagtgtttgtgtgacttcataggacaaattagtcatttctttaaattcatccctacccacactggcttctccagattttaggtggcggcattgctgtaactgttttataaatgctacaacaaatgttctgatagatacatttgttttggtataagggatctgtgattgaaaaccaaggaatggcctatggagctgtagatatatatgtattggtatccgtccacagttcctggtttatagtgtccacatcccttgttacagtctggttgtaatgctggatgtgttaggcctcaggaaacagaatctctcctgccctcctttatgtaccccaaggcaggactctaatcttttcccatcttgtgggtttgagatcctaccctataccctgggggaaggaatgctgacgtcatgaagctgccattaaaaaccctagaggactgggttcaaggagcttctagaaagctaaacccgtggaggccaacaggaaagtgaagaagaactcgctcacgtgccgggagggcgacacacccccaactcctcaggttcagaagctcctgtgctcaggacccttccagaccccgccctgtgtgtctgttcatctggctgtttatcctttaaaatatccttcttagagccaggagctgtggccctgagaaggctcagacctgtaatcccagcgcttagggaggctaaggtgggtagatcacttgagcccaggagtggagaccagccgggtaacataatgagaccttgtgtctacagataataataaaaacaaaaatagctgggcatggtgacacaggcctgtagtcctagctgcttgggaagctgaggtgggaggatagcttgagcctgggagaccgagactgcagtgagctgtgattcttacacacacacacacacacacacacacacacacacacacacattcttagtaaactgataaacttaggtaagtgtttctttgagttctgtgaaccactctagcaaatcagtcaaacccagaggggattgttggaaccccagttgaagccaactggtcagaaattccagaggcctgggcttgcgactggacaggaaggtgggaacattctgggggactgagcctcaagctgtgggatctaacgctgtctccaggtagatggtgtcagaattggattggaagacacctggctggtatccgctgcttggtggtggggtgagacccccacacatttggtcacagaagttttcttctgtgttgatgattgttgtggtgtgagagtagagggaaaagcacggttagaggagcaagttttccccacacagtgtctgacaggcttctctacttaaaactggaatacggactccggctccaytccagactgttccttcctcagtgtccccgtctgttaaaggcagtgtcattcttccaggtgttcaggccttaaagcctgagagaggtgcttagctcttccgtttctctcacacaccacatcctgtgcttgtacaaatactgtttcttcccccttccacatctatttaaaacccagtcacttctcatcatctccaccgttgtcagctaggatcaaatgagcatcatctcttgtctggacagttggagcctcctaccctgtctgcctggagccttctaacctggtcctgcagkctgttctcaacagaacactggagccttccacattcaatcatgtcactcctctgtcctgaaccatctggtggttcttctcgcaacccccaccagatatcagcatggctggtgtccaagcctcctgcacatttttgacgcactcttgccatatcagagtggccttccctgaccacaccctccttggtggtcactctcctcctccccacccagccagcactcttttctcccttcccctgcttacctgccctcaccctctggtaactccatgtttacttgtcaccctctcgtggaatgtgagctcccagcaggcagggccctagttctttccatcagctgtgtcccaagtgcctgaaagggtgctgggcacggcacatgcccagcaaataggggtggaatggtaacccttttcctgtaagtctgaactatccttgggctaggaatcgaccatctcttcttactcactttgtgatgtgggaggctccacggcctccctcggtatcttggaagatggggatgatggtgatatccacatcgcggggctcttaggaagatgaagctacrtcatgcagcaggtctcaagaaggccartctcctctctttccctgccctgtagtcccatctctctcctgcccagagttgagtcacctgggccagtgtaccctgaggccctggccagccttgcctcttcccctcaagggtctcagactggtgccaacagtcacattgtcacaccaaagccaggagtgcggagagaggatgtggaacagggtctaratacctgaagctggggacagcatggccctgcacgtctctactaaaaaattaaaaattagctgagtgcggtggtacatacctgtggtcctagctactcaggaggctgagacaggaagatcatttggagcctgggaggtcaaggttgcagtgagccctgattgcaccactgcactccagcctcagtaacagagggagaccctgtctcaatagaactaaaaagaaaaataaaatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtatatctttcatcttttttttctctgctcttctttaaagtttctgtttaagctaatatttttcacataataaaaacatttttcatgctattaattatacaacagtataatttttattggctacatatcattgttgtttgttggtttattgagacagagtctcactctgtcacccaggctggagtgcaatggcaccgtcatagttcactgtagccttggacccygggctcaagcaatcctccagtctcagtctcccgagtagctaggactgcaggcatgtaccaccacacctggctaatttttatttattgtccatacaatcccctgcattcagatgggtggcatttttttcgttataagcagtactgtgccaaacactctagcacagacatctcagtgtatgactttgatcactgttttaggataaattcctagaattggagctgcaggtgaagagggtggggtattttgaaggttttccatgcctggcacttagagtttctcttgccccatcagtgtgactcacagccaaggcctttctagccccaccacctcagggattccccctagctttttccctcttgactgcctggctcagattgtttcttagccaatttcagacttccaagagaggaacgagattcatgtaaattaacttttagagccaagccacctcagcagaagcttagggaccagcctgtgagcagggtgccccttgattttgacttttttrgagatatgactagacaggtcatgagcagaaacagccctagtacagcctgtgacatttacaacatgaggtttatctgtttcttctccttctttaagaatgtctttctgaatacgttatatttttaggatcaaattcctaatgtgagtcactcagtgtgccttagtcagctgtttcctccctgagtgcaggctatgtccttggcccttgtgccaggagccaaagttacaaaaatgagtaaaacaggaatgtaatactgtaatagkgccttaaagaaccctaacagtgatggtagtactactgcataatgcttacagcctgccagggcttgtcagtaaattctttgcatatattaacccatgtaatctgcatgccaaccctttgaagtagggttttaagagatcagtaaattgcagcatagagaggttgtgtaatttgcccaaattcacacagctagtaagtggtggagctaaaattggagacatgtccatagttttctaagtaccaagagctgtacaaagagctatggaaatgggtcaacaaattgatacatttcctaagctgtgcatactgtgcagccattaaacagaataaaaaagaactgatttggagctytcctaaacatagtaagtgggagaaaagcaaagtttcagactatgtatcccttgtatggtttttaaaagacatagcacacgcgtgtgtatcaccaaaatgtaacagaggttaacccgagacaggggcacaaagtagaagaagccttttgctacctcgcttatatactgcatgaatcatgtaaaatggggagaaataataataaattatgatacagctatagaatggaatagaatgcaccattcaaaattacatacaactagtaaataatttttaataacatgacaaatactgttgctaaaatggtattagataaaagcaagtaaaagttatatctatagaaaatatataggaaaattaaaaggaactatataaaagaattttaaatggctacatttaggtgttaggcttaagaactctgtactttccgattctctgcaatctgtttctatttattttttttaattctggatgaatgtagacatcctgttcttatataattgaagcataaaatcatgaattgtaacactttccaggctttcaaactttgtctttgtaaaactgcctgggtgggcctggcccctgagttcatccatttcaagtgctcactataggtcagttcccttcatgatgatggtgcctcttttaggtgactgacaggaaagcagcccttcccaccaatgacctccttgtttttgattgcttccacagtggcactaaggaaaacagatcatctctccctagacaaagccaccatcccgcccgaaatctttcagaaatcatcacagttggcagagttgccacaaaagccaccacctggagacctgcccccaaagcccacagaactggcccccaagccccaaattggagatttgccgcctaagccaggagaactgccccccaaaccacagctgggggacctgccacccaaaccccaactctcagacttacctcccaaaccacagatgaaggacctgccccccaaaccacagctgggagacctgctagcaaaatcccagactggagatgtctcacccaaggctcagcaaccctctgaggtcacactgaagtcacacccattggatctatccccaaatgtgcagtccagagacgccatccaaaagcaagcatctgaagactccaacgacctcacgcctactctgccagagacgcccgtaccactgcccagaaaaatcaatacggtgggtgggacaatgttcaggcccttaggaaccctattccgcactttgcaagttggtgggagggcaggtgctccaacttacacaagaaaaagtgagagcttgctcacctgacccttatgtgctctggttcaagcatgatggtggattagagcctgtgggttacaaacccaggctttaggctccagcagacaggcttcaagacctggcttcagtgcctgacataactgcacaaccttggcaagttactttctctgagtcttactttcttcacatacaaaaaggagctaatacaatatttgagctcacagatgattaaatacagtgacaaatgagcagcacttggctggcacctagaccactgagcaagtagtcactattacctaggaaccttgaggatgaaacttttcctttcctgagggtcacgagaaaccaatttccctctcggggttctgggtattttctctctctctctattttttttttttttttttttttgagaagggctcgctctgtcgcccaggctggagtgcagtggtgcgatcacagctcactgcagcctcagtctcctaggctcaggtgatcctcttacctcagcctcctgagtagctgggaccaaggtacatatcactacgcctggcttttttttwatatttttggtagagatggggttttgccatgttgcccaggctggtcttgaactcatgggctcaagcactcctcccatcttggcctctcaaagtgctgggattacaggcgtgagccactgcacctggctccctgagttgctaagtcagactttctcgctgcatcttcctaaaggaattggagataaagctctcgatataatagaatagcatagaattttgtagaaatctcatattctgtcattttcatgaaatgtttcctactctatatccagaagttctcccattgcacatggcagctctacctgcctcacattctgttataaaatgttacagtacccagcactttgggaagaggcgagtggatcgcttgaggccaggagttcagggctgctgtgatcacaccactacactccagcctgggtaacagagcaagaccctgtctcaaaaaaattaaaatggggctgggtgcagtggctcacatctgtaatttcagcactttgggaggccaaagtgcgaggttcccttgagcccaggattcatgaccagcctgggcaacatacagagaaaccgtctctataaaaaataaaaattaattagctgggcatggtggtacatgcctgcgatcccagctacttgggaggctaaggcgggaagattgcttgagccctggagatcgaggctgcagtgagcgtaatcatgccactgcactctagcctgggcaacagagtgaaaccccgtctcaaaaaaaaaaaaaatttaaatgttgcagtaaaagtgtgtcatatcaatacttaaattaagaaaaataaaacccatcttcctgtaggttggaggctgccgtgtctgatggtggatacttctgctattcaaaagggaactctcccatgactcccaagcaccactgatgcaaaattttcatttcatgctacacactatatagttttattatgtcatttaatctctgtgttataaattaacacactacaggcctctcagttgctcacgcagtcactgccacagttctgccaggcttctccaacccacccgcacggcccagaagggagctcggaaagcagctggaactatcagggtgattaaaggagaaaccaggggacagagaggaagaggcactccacccaaaacatttaaagagacagcttgctttttttaaaattgccaattagccaggtgcaaaacaaaaacccatcatttagaaggtgatacctctattttcacttttctatttgcaaagaactggaagttcaacaaataaatgctcaaatcaaaactaatcaaaaattaaaactgttttaggaactgcatagacttctccgagccccaggccgatcctgctgtgtttaaccagcatgtactgacttgctgttttgcatgaggggactgacaaatttgtttatgctgcacattcattatgcagaagctgcagattttgctttacatcatgtttcctaaaaacatttttagactctgctgtcattctgcaagctgatgtgggttgggggtgcgtacagagtgcttgatggtttttggtgaagctcaattttgatccctacccatagtgtttgctttctggtgaaaataacttgatgatgcccaatcaccaatgcagggccaccctgatgatggggggagaggaagggcctgtagttaagagtacacagtatgctgggtgcctgacagacactcttcttcccgcccttcaagggtgaggaaatcaaggctcagcgaggttaagttactggccaaggtcaaccattttacaaagaaccgctgctctttttttccattcagtccattctttcaattaaaacccagtttctttctttaaggggaaaaataaagtgaggcgagtgaagaccatttatgactgccaggcagacaacgatgacgagctcacattcatcgagggagaagtgattatcgtcacaggggaagaggaccaggagtggtgggtacgtacgaatatccatccacttcatccgtacattcatacagcatgcctgggcaggcaccacattggagcctacagacagtgcagtaaaagagggctcttgagcacaaggaccctgtcagctgcatcactcacccaacagccattgcatttggtgtcttttctatgtcacacactattacatgctagaaaaacagccgtggagctggccgggcacagtggctcacgcctgtaatcccagcactttgggaggctgaggcggatggatctcgaggtcgggagttcgagaccagcctggccagcatggtgaaaccccgtgtctactaaaaatacaaaaaattaactgggcatggtggcacgcacctgtagtcccagctactcrggaggccaaggcaggagaatcgcttgaacccgggaggcacaggttgcagtgagatgagatcacaccactacactccagcctgggcaacagagcgagactccatctgaaaaaaaagaaaaacagccatggggcttygaagacaggtcaagagaattaacatttgtatgtactttacccatggtatcatgtaaccttgtgagttgtaggcattttctgatttttcatataaatactaaagcggaagaaagttgagcatgttgcctgtggtccctcagccagtaagcaggctaagtcaagattccagatcggccctgaccccagagcctatgtgctttgctcaccattccacactgtccccaggctgggaatcagaatgcccaagttcctgctcaggctgagcagttgacaagtcctcagactcaattcttaatccagtctgcagttctttctttgtcaaataggccaagacaccttctccacgtaattttaggaaaagattaaatgaaaatatctatgaaaactccttttacattaaaacctgcagctcaggcatcaggagggaaagacatcagcatcctcataggccctgctaggtacccaggctgtgagtgacctgcgagggcagtccacacatctattggttttcacgttgccagggagtaagtctcccgatgggaactgccaggccaaggtacagtgaataagccacctcttctgctctccttgttgatcatttcctgacatcagggtgaaaattccccttccttggcagcctgagccccgtcctgccaagagggactcagttctgtctgccaggaagggacctgaggctcgcagttgagccagcagtacctaagaatacccagaaatacatatgtatatacatgtgtgcacacacacataggcatgggcacacattcacctttgacttttcttccttcaggcctagacagtgacctcagattcttaatcacagctgtagggattttgtttggactcaactggggcaattttgccctccagggacatttacaatatctggaaatattgattgtcaggacctaggaagggggttgctaccaacaactagtagatggaagtttagtggccagggatgccactaaacatcctccagtactcagggagcccccacaagcaaggatgccagtagcaccatggttgagaaactggactgaagggatcagcctggggaggcccaggggtacctccagcctctgtcagcagagtggggccagcccctggcatgaagcctgtcagagagtccacttcatctcatgacgaggaggtgggctctgaagcccccccacgtgaatcagttactagctctatgggccttggataaagcatgtcccttctgtaagcctcactttcctctgaaaaataggacatgattaatcgtttctcacaaggatgttgaggaactcactttgtaatctgttaatattattataatcaagcagtgatcatgttctttgctaagcaactgatgactacagcagagatacctgcggggaatgggaagctgtcattggtgtccctagcatcattcctaggggacattgtgtgtgccaccattacgtgcctcgccagatgtaaagatggtgccacacacacatgctaactgtgatgtgaaattcacaaagacctcacacatgcatgatgccaactaagaccacacgcrgtgggtgggcaagccttcaggagagctgggcaggcctggttgactctgttccactcttaaaaccaccttcctctctatcgatttggcattggaagccaatatgcacgattttgttttttctattgaaggccyattacatgattctctttagtgcaatcaatactaatctaattgaggtaattagaaaatttttacaggtaactggcttacaggccaatgcagcagacaataaaattgccattcgccaccatcagtctcaaactttcacagtattcttcctccacggtaaccagaaaacaagtgatagtacatagcagccttttttttttttttttactggctagaacaacactttactcacaaagagaagagacagaacaagattagctttgatttgagtatggtacccygcagtgggtcttgccaggcagctgacacagcttaatggtctgtatgcatcctacctgggctgtgggcaaagaaaccccttccttcccaactaggaataggtaatagtactgggattggccaggtgccatagcagccttttcatttgcttttttttttttttttcttttttaaatgtatcacacaagcctggagagaagggattttctttagccccacttaacagagaaaaggcttagcaaggtttgtgtgaggtcacccagctgtaaaggcagccaggcgccctggttcagagcaaggactctagagccccacgcctgtgggagagcatgtcacctctctgggccactgtcccttcatctgtaaaatgaagattgtaaactgtataagaaatatccacctcagggggttgctgtgtgggtacagcaagatccatgtagaatgctgagcatattggaagttctgtcgtttgctctttccttatgtagtttatgaccgttaagctctctgtagttcactaaagggtgggaagaagggtaagcctgggattccaccgccaggtctgtgggcagactaggctgggctcttacccactgggtttgtcgtggggccactgcctgctgcctccatcctgaccactctcttttctccctgcagattggccacatcgaaggacagcctgaaaggaagggggtctttccagtgtcctttgttcatatcctgtctgactagcaaaacgcagaaccttaakattgtccacatccttcatsmaagactgctkccttcatgtaaccctgggcacagtgtgtatatagctgctgttacagagtaagaaactcatggaagggccacctcaggagsgggatataatgtgtgttgtaaatatcctgtggttttctgccttcaccagtatgagggtagcctcggacccggcgcgccttactggtttgccaaagccatccttggcatctagcacttacatctctctatgctgttctacaagcaaacaaacaaaaataggagtataggaactgctggctttgcaaatagaagtggtctccagcaaccgttgaaaggcatagaattgactctgttcctaacaatgcagtattctcaattgtgttactgaaaatgcaacattagcaaagaggtgggttctgttttccaggtgaaacttttagctccatgacagaccagcctgtagttatctgtgtacacagtttacagctacaaaaacctactttggtatttattacagaaaagtgctcagttaaatgtaagtgttattccttcagcaaaatattcactgacccaaaactctttatggcattttacaatgcacacagcctcatgcaagtttagacaagtggatttatactgtcttatgagtgcccgcccctgatatattacctcattatgcaaaaataacatatctttcatgactattttgacaaaagtttaaaacacatatgaagttcaaatttcaggaaccaaggactgccagaaaatattagcctctacattacgcatgcatttagaagcttacctgaaatctgccttttataaaggaatagtatggataagtggaattgtacattttttaaacttgattgccattaaagcagaaattataaggttgcaacaatatttgtttctaatcactggctttctcaagagtatggattgacatattgtgttatgaatgcacatctctcagatgtgttgaagcatccattgcatccattttttattattttcttagttttgttcttggacaaatttaaacttttaaaagattattcaagatgaatttaaaagtcaacccttcacacagtttccctactgtatgtagaatccaggtgctgaaaccaagtgtttcttttcccatgctctttgttaaaccccaattatagataatttttccagtcttaagctctgtccaccttcaagtcaattcataaccaagtttttgaacgctgctatgaattgcactgtgaaaagcactcttccctctcagttttcttttcatcccagccatgtttatcagatccttaagaacattgtatttcagtcttttacatcagtctgaattttggaaaagaatgcaatagttgtactccacagtcagtggaactgttccctgagtccgaggctcatgtgtcattctggcactacatttgcttaaattgctattttggcaacagcacagaaaactaatatttttaagcagagaatcttggcaatgagtgagagatgttaatttcacagaagcacaactcccaacccaacccttaggaaaagccctcttccatcgttacagtgctcagtgaatattaatttagttctgcttaagtggttgctatacaaactttgaatagccacctaataaataaaccttgcatgacaaacctgcaaaatattttatcagctgttattggaaagtgattttaagcaattgcttcctcagtgtcagggcacatgtgaatttccacaccaaacagagcatgaggaaccagttgacatgctgggttgtgactggcagctttagcagcctcrgtactgaagccacaccagtgtcmggatggaagtctgcatctgaggttgctcagtgtcccggtcattcatttacacattttaacttgcattaaagagctgttcttttctgtggcctagactcttttcactgatctcaaaataaactggtttttttcaaaaaaaaaaaaaaaacaaaaacaaaaaaaaaacacaaaagctgcatgtctaaaattacatggagttagtgtctattctttttccccttttgcagcaacttacacagcatttttaacaccttttttttctagtttttttgttcggttttgttttccatcaggaatttgagttctctctaacccagcttactgtgggacataggaaaactcagtagaaatacctttggtgatcttgttgagtttaagtctgatcttgatcttaaactcagtaagccactatctgcaattttgtacattatatagtattttgaagatatggaaccttatgaaaaaaaaatagcaaattagttctttttcccccagaggggaaagttatgttctgcaaatagtgtgtgtcttattttactgttgaacagcaattgctatttatttttttattgcctagaacttcaacatgttgtataggaatcctgtagtgccactagttaaatgccgaattctcatctggatgttaccatcaaacatcagtacacttgtcatttcacatgtgtttaatgtgacagtttttcagtactgtatgtgttaatttctactttttttaatatttaaaattgcttttaaataaacatattctcagttgatcccaaacttctgaaatcaggccattttgtgagttgttcactaccctgctgacaggaragaatcaaggcttcctctggctgtgctttcgggtatatagatgacacaggtcactccaacccttgtcagagatcactctggatacataaaaatatgtggcacttgccccggcttacaaactgtgggccttcggcccctttctgtcctccaccttccgcattccacctccaccacgtccacttgtgcgcccgttgatgtgaacagggcaagaagagggtggaggggcacgaggcttacatgttgtcgtgtggacagcacttctgtcacgtagctgtcacaactagtgctgccacgcagtggagcagacctggcccaggcactctgcctgcattaacccctgaatccttagcaagcccaggagaagcgtgagcccctcagctttacagagctgacaaatgaggctcagaggcattcattcacacacaggagacatgtggcttgtaaatcactaaggtgggagtgcacacaggtggttctggctccaaggccatccttgcaattcccactgcctggaagacactctcctttatggagaaccacagtggcggaaagcaggccgagactgcggcagggaggatcccgaagtgctggtctcagcattccttctgtcatctttcatggaagttggtagacatggctgggcacggtggctcacgcctgtgttcccagcactttgggagcctgaggcgggtggatcacctgaggtcaggagtttgggaccagcctggccaacatggtgaaaccctgtctctactaaaaatacaaaaaattagttgggtgtggtggctcacacctgtgattcccagctactcgggaggttgaggtgggagaattgcttgaacccgggaggcagaggttgcagtgagcgaagatcacgccactgcactccattctggatgacagagcaagactctgtcaaaaaaaaaaaagttggtagacataatgtgcctgttcatagtccaagacaaaccctttaaacaccgtgctaccggggaaaatgggcttgggcatggaagccagcggctttctatcgggatatttctgggaaaagctaacatagtgacctggataatccagggggaggygaagccagctttttatctgatgacaaaatgttctttcacatcggttgtatgtggttttaagcctggaacagtatctgtttggaactgacgtcccccttcaccaccccctgactccgttgaaagcagcccctccctttatccaccagcccccgacagcccagcctccaaggtgaggccaggagctggaggcttacccctgtctctccacctcaggtcctttgagggcttactgtgcttgggcccatgtttcctttacctgcgtttagtctttggcagggcgygtgacaccgttaggcacattaccacagttgagtgatgggcagccgtgtggacccaggtccttgtggccccagccacagccccctactctccacacccttgttcttctcccctcccctaaccttgtgcccacttttcgtatgtgtttttttctttttttgtttttttcttttttgtagacagggtcttactttgttgcccagtctggcctcgaactcctgggctcacatcatcttcccacctgagcctcccaaagtgctgggattacaggaatgagccaccatgcccagcctagccccccattggatactgtttcaggcttgaatgtgtgtgtgtgtgtggcaggggtgcagtggtggtggggatgatcattactgagatcattcaacctattctcctctgccccccatgtgttcccctcttccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtattcccctctgccccccatgtgttctcctctgccccccatgtgttcccctctgcccccatgtgttctcctctgccccccatgtgttcccctctgccccccatgtgttcccctctgcccccatgtgttctcctctgccctccatgtgttcccctctgccccccatgtgttctcctctgccccccatgtattcccctctgccccccatgtgttcccctctgcccccatgtgttctcctctgcccccatgtgttctcctctgccccccatgtgttcccctctgccccccatgtgttctcctctgccccccatgtattcccctctgccccccatgtgttctcctctgccccccatgtattctcctctgccccccatgtgttctcctctgccccccatgtattcccctctgccccccatgtgttcccctctgccccccatgtgttctcctctgccccccatgtgttctcctctgccccccatgtgttctcctctgccccccatgtgttctcctctgccccccatgtattcccctctgcccccatgtgttctcctctgccccccatgtattcccctctgcccccatgtgttctcctctgccccccatgtattcccctctgcccccatgtgttctcctctgccccccatgtgttctcctctgccccccatgtgttctcctctgccccccatgtgttccccctctgcccccatgtgttcccctctgcccccatgtgttctcctctgccctccatgtgttcccctctgcccccatgtgttcccctctgccccccatgtgttctcctctgccccccatgtgttctcctctgccccccatgtattcccctctgcccccatgtgttctcctctgccccccatgtgttcccctctgccctccatgtgttcccctctgcccccatgtgttccccctctgcccccatgtgttctcctctgccccccatgtgttcccctctgcccccatgtgttctcctctgccccccatgtgttcccctctgccccccatgtgttcccctctgcccccatgtgttctcctctgccccccatgtgttcccctctgccctccatgtgttcccctctgcccccatgtgttccccctctgccctccatgtgttctcctctgccccccatgtgttcccctctgcccccatgtgttctcctctgccccccatatgttcccctctgcccccatgtgttctcctctgccccccatgtgttcccctctgccccccatgtgttcccctctgcccccatgtgttctcatctgccccccgtgttctcttctgccccccatgtgttctctgcaccccatgtattctctgcccccccatgtattctcctctgcgccccccaatgtgttctcctctgcgcccccccagtgtgttctcctctgccccccatgtgttctcctctgcccccccatgtgttctccgaccccatggaaatctttgattctcctcattatgcagtctgtgggtaatttggagtgaatgggctcacatctctagcaggggtgtctgagcacgtgtccctcccacagaggcctggcctctccagccagctgcctgggatggaggtgaagtccactaaattaggtcaccttactcttacacacctgaggctcacatggtccacaagcattccatttttgtctagacagtgccaggcctttggttgcaaagacagccccatattctgtccctgagaagcggagaaacacaggtaagtaatgatgactgtagagttcacctggcagggagctgcctgaagaaaggagcgtagctcatcctaggagcctgcacagattgagctcctgcaaagctgctgggatggggtggcatccctgcaacagatggagcagacaggagaaggaaacggcagactgaaggcaggcaggaccagccccaaagtccctgtgctgtgctgaggagcactctgtgcaggcggatccgtggaccaccagcagctcatcatactgaggcctccacgggggctgagcaccaggccaagcgcttgagcagcacgattgcagttctctcagcagtactgagaggcagggactgttactttccccgttcacagattaggagactgatactcagagcagctgagccgtggcgtgccaaaaagtcaagtcactcatgaagggtggaggcaagaattttgagccctgacatcagggttcagccatggagctcctggccacaaccctctgctgcctcttggctgctgctggtcaaagctggcctgtcccggccctctaccattaggtcagcaccagggaggggtgaaccatgaagggcaatgaagttccggattcggaaattaaggcatttgccagagggccccacagcgagcatttctcataacatgtcatggacagccactgtgcacttgggagctagaggtggagctggcacacagggtgacttggtgcacgtacaatgtgagtgacwgagaagaaagcagagtgtgcatgtctgtgtgtgagcacagcagcccgtacacaaacacttgagctcctgaacaccagaattaaagctcagataaacagctgttttgcaaaatcttaccacatagcaaaccctggtctgaagctcaggaggccaaaactttcaccttctgcaaaaccgccaggggagaagccttatttgggttcactcttcaacagaacttaaaactttatagctctgagaaaatatgagggcacaagatggcaaatgtgtcacatgcacactggcctaaaatatattagggccaggttttcacattttggcagcatcacctgaggtccccagtgccgacggattcgcaagtctcaggaagtgcttgagaatctgcatttagccagcgtccctgggtggggtactcaggtcgctcctgggccaccttgaatccctgagactctggaactgacaccacaagggaggattacctggaatccatacaggggcaccttctaatagtggagagaaccctcatcctgggctcggtacttacagaactacagctctttttcctgctatgttaagatgcagtgaaaagaccacagaagccaggtaaagtggctcacgcctgtaatcccagcactttgggaagctgaggcggaaggctcacttgaccccagcatttgagaccagcctaggcaacatggtgagacctsatctctatggaaaacttaaaattagccgacgttctggtgcacacctgtgatcccagctactcaggaggctgaagtgggaggattgcttgagcctaggaagtcaaggctg

SEQ ID NO: 13260 - DNA, 12201 bp, Homo sapiens
  misc_feature (1)...(12201): n = A,T,C or G, or insertion/deletion polymorphism (see Tables 1-2)
acccagcggcctctgctggccacttggggaacctgcatggcctgacctctcacccacactctggaaaatagagtgaactgtgagccagctggggtctgacatgcaggccccataagccaaggtaaagatgtgggctgtgtggagggtgaggggcagccctgggacgggttgaagcaggggaggtgccagggccggatttgcatttctgggagatccctctgactgctaaatagaggctggatggcaggggtgggccccttacagtgaaataccagcctagcaaagacactcaggcactctgtgctaccggtatccatgggcacaggacactgggccactctcccaccctccttacctcacactgttccagcctgtgtgccgctagccccttgctgtcctctcttgagccactgttgggacgcccgctgtacaacctcccagccaaggtggcagctggaagggaaggagcaagtggcaggtgagtgacagggaggtgctgtggacagcagacagcagggcaggggtggggccgggacaggccacataccctcaatctcctgagcccgtacacggcggatggcagctcggatcagcttgcgctcctcatactcaccagcgcttcgcaactgtgggtaagagacaggtcgcgggtgttgggctgtggagtccaggtcttcacctgccctgcccccatcccctgccccagcctgggcctcaccagtgcagtcaattcctccacatcgttcatggactccagctgccctgccagccgtgccagggcagcccgctgctcagcttcccgctgctgagagctgcagagacatcatgactgtaaccaccactgccatggccaggtcgtggaggatgtgggctaagggtaggagccagaacagagtacccagaaccttggcagaagggcatgtggctgtgcacaccctctaactgcacactgatacacatatgcccatggacgtgggcactaataccacacactcagacgtgctggctacatcagcacggccgcgacgccacaatcagtacatgctccatgcccacaaacatctctgtttttccagaagcgtgtgtggacgtactgccattagcacatgcaatccacagatamacttgtgctcacgcctgcctgcacacatgagctgagccagggctcacactcaccttctcacccgcatgttccaccccccgctactcactgcagccagttctccttgttgtcctgccgctcggcacggaaacgcttggatgccagggcctcctcctcgcgctccagctcctgccgctgcagttcccggatggctgagcggatgcgccgccgctctgccagatctgctgtgacctccasctgcagtgggtgcgagrggcaggtcattttggctgccaggggcggagggctggcaccagctgcccacggctctgcctagggcacaatgtgtggcctgtgtccactccctgtgtcccaagctcttcacgtgcctgcctgcccacgcagggtcccgggggtagacccagcccactgtttcagggatcttgggtagtccactttgcattgtggttcacagagcacacaactgtgagtggacagccagaaactgcccacttgtgccaggtgccaagccaggcactcctttctacaactcgattcctgcctctcagagcccagatccccaaaagtcagggagctattgtaggaggaggagggaggccaccctgtgggtcactaacagggtccctagagggaaaggtgacagatgaagtccaccctctgagcaagggaggctccctggtctagtcaccaaacaccacagcccagctgggggttgactgcttcatccacagayggggaaactgaggacaggtgctcaggagtcctgcctggctgagggctaytgtccccactgcactggcctggacctagccaccatggaagaagccagggtgcagagtgggaggaccaatcccccagacatataaggtggctggcactaggggccaccccagggccttatagagggcatccctgggtgacagctgcttctaccggttctcaacccctcagttcccgggaaattgggggtgactggtctaaccaggttcaggaaagaacaccttctctggagtgagtcagccaatcctgttgcctcccccacacctccaccatgtagagycacctgctacatacagatcctccgtggctcaagggagagaggactggcccagkgttcccctggaagatagtggcagagataagcctccagtgtgggtctgataaccagacgggagccagtaaaggcggggtgatttcctctgtccccaccccccaaatcattcaggggtagggccaaagaaccctctatcatctccctttttagcgcccccccgtcattcctttctgcttagcgggaaggccaggtggcaagggtggggatgggatggagatagttttcagcagggagtgtgggctggcccaactcagccatgagccagcttgtcctagtctgaagagagcagggagagtcttgggggaagagccctccaggctccacattcctgaggaattatgagaagaccccctgaaactcaggccagagcccytagttggttccagccctagtccaatcctggctgggtgatcaagagcatatcccttaaactctctgtgtcttggttttttcatttgccagtgggtggggttgggaacagtgacttggcctctcctgtacatagytgcagttgcaataagcatcacccccatacttggttctagccagtcaggaggagggagagagacaagggggcaaatgggaagggcaggataccccgaggcatcagtaacatttatggagagcctgtgagtcaaaccctgtgctgagccccctacttgtcctaagcccacaaaaaccctagatactactgttattcccatttgacagatgaggagattgaagtccagggaggacatgtgatttgctcatggtcaaatgacctgagccaggatttgaacccaggtctctctgactccagggcctgccctaggctgaagatagctctgctactggggtctgtgtgtcatggtggggacctcagggatcctggcactgtgttggagacccctctagcctggactagagatgctctgaggcctaaggaggccttatagcagaggcggggggaatgaggctcactccccagcccccggtgctggctgtgtctcaggcctagagccttctgtggtacatttggaggctgggggctggaggggacagagggtccagccccttctgtacagagggtaaagaggcccagaggggcaagggstagccttttgtctcctaggtccccattctcagtgctctgggctcggagatggggtscttgtctctgacaaaagcctgatgtaggaacttggccacctctacagcacaacccccggagcttcagtgtccccatctggaaaatgggagcctccctctgatcccccaaagtgggtgggcaaggctgsagactgacaacctcattccactggtcaccctctggcacgacccttccctttgggcctggaggcaaaggttggaccacagtgtctcctctgtgtgtcccgagttccacccgcccaggccccaccgctgtgtaaggagggarctgtgggagggagggaaggaagtacaaagcgccattgtctaccgagggggaaggggaaggggatggggcggtttccgaaactgcccagtgaaattctcccgggaggaaagagggtgcttcctccccctggggagccggctctccgtgtactctctgccctcgctgttgggaacgcctggcaggccctgaggtctcactgggcctcagtctccccaacagcacaacggagggggctctccaggctttcagtcccagctcccccggttgcccatgggggtcccgccggcggtggagggaagcctcgccagggggcgctgaaggcccgcaggttctgcgaccgccctccctcgcagggcgccgccctcgcctcgcccaccctgcctcgcgctaggcgccgaaggggtagccaggtaggaagacacccgctaccgcctgcttcagtgtccggatctaaagggaagaaaccaaggtccccaggacacccagctgagtggcggaggtcgaactcgaactcgggaccgaggcagagggcgtcccggcgggtggtggaggggcacgcggcgtgcaagtccccaggcgtccccattcctcccatccccggcccaatcctcaagaatgtgcgggagccggggccggaagcgactgcccgcgtccccaaatcggccagacgctggggcgcakggcgggcggagcgggcctagcttttccttatatggcccggccccgcggggaggagcccggctcgggacgcccccgttcttgccacgaggccagcgggggccgggccggcgcgcggggcgcagtaatggcgggcgccgggtgctggaggagccgctcccggggtcggaaagacttcgagaggcaccgatcccgagaccggggcaggttctcatctgtcctttcccagagattcaaccactgctccagcttctctccaaaactcttttccagcgccgcccgagcctcgcttaagagagggaggtggcggctgaagaaccctgascctgcctgtggataccttgagatgaggatgtgcgggaaccaggcctggcattccctctttttggactgtgctgcctctacgacccccactgggacttggacttcctgagggaaggtcgaactgactggcgggcacctttggaaacctaacctcatcccctccaggctgcacacatcctgcggtgatagtggagaggcagacacccagagagtctaatgcgctggtccgagaacatacaggcagagtgccttggggaggtcatggcagcagctgggcactgcccagtggctgggctacgctggttggttccagcctctgcctgcgggggaaggtatgagagtggggtgggtcacttgtcttctaggtaaagtaaatctttaatttacccccatggacaagggtcagggactgaggagatggagctcctctggcccctcctccaggtcaggctgcctggcctttggggttggggaaggagccctgccccactgggttgccctacggcctctgtgcatggaggtagacagggctctcaggaagaggaacaagaaaggggatrgagtgggctcatctttcctccamctgagatctgggtccatgcctcattctgtccccatgccaactctaggacctagagcttgtgtgcaaacacatctccctccctcccttcattttacaggtagaggaactgagactcaagagtagaaaaatgagatgagaarccacagaatccataagggcccacaaaacctgtctctctcttatggcctcgtccagccttgactttcccaggactctggtcccccgtggcccactatggggttgggattttggcacagctccttcttagatgggtgtccttgagcaggtgattttaactctcttgagtcgcagtgcccaggctttcagagctgctgtgattattctgtgacatggtatacccagtacccagcctgccccctgccaggccttggcattattaatcattgctgctaccattatcactgggccagcttccaggggtgggcattgcccgagctattgctctggagaggcatatccagcctccccacacctgtggctgcatacgggcgagtctacagcagttactgtttaaacaggtggtggctgtggagggttgggagggactaggcttcagtaccaggcatggacaggcacatgccacaagggcctctgcatcagccacatggaactggcctacccctgttcccatgtccccctcctcctgacctttcccccatcacttcttcctgtcagctgagaggtaccctggattgaccctgcctctctggcttggctttyctgtccccacagtgggtgatggggccacttaccagcttccgaagggctccctcatccagcccagctaaggcctcgtccgccatctcgctggccyctagctccgtcggttcctttctggtgagatccccagtgcctgtggcacctgtcaccagctcagagaattctgcaggggacagacatgaatcaggcatgctggggcttccagaaaccacaggcacttaggctctgtgccttactttccctctctaacctaggagcgtccattactgtcccatcctataatgtggctcctggctggaagctgccctctgccctagggtggtttgctggaaaactcaccaaacccagggtagggggtctctggttccagccctgccagcttggcygccagtctgctgtgtggcctgggatggactctcatcctgtctaaacctcaaaacagggagggcagggacctggattgagaagccagggcctggcaagacccacccaagctgtgcttaccaccagggggtgcactccagtctccagtttcctgccccacccacccatccacagggcctacccagcccccacccactccgcaggctcagcttctggctgtgggctgaacccgtagttcttgctgccaccaccactgtcattcccccaggtataggaaggtacactgtgtcttccgattcttggagccagctctgctgtccagacctcctgaagccaggtgtccaggcacccagcacctcctgccaattcatacagaattcaattccccacctggaagggctttcagaagctgacctgcccaacccctggatttcaggcaaactgagaagattggagagggccaaggatttgtcactgagcaaggaggaagccaaagacttagagggcagagaaggatgtaatcaaaatcttcgtcatctccggcttccgaagctcccttccaaagtgccctcaagggcctggaacactctcagtgacagaggcaagagccccatcttgccccagtgctgcccatcaaaatggacccctaaatcctggcccagcctcccagcrcagatctctccttcctcctgtagccccaactaatgtctgtctggaatttgaggggccctggtctggcacactgtggatgcttagttaatgtatggtgactgactaatgtgtggccccaggcctgccccccacctcctgttgattcatctttcaatcatcccttccctctcttcagaacagtcacttgggaagtcaccccatacggtgcatgggtggggggtgagggttaccgctccacacagttggggtgtgtgggtcccagcctgttcaagtcactgcttgttccccctcccatcctggtaggctcagaggtgtcaacctcccaatctctgcctgttaggatccttgcctcttacctagttactctgtmtgggttaaacctcttcaagactgtccagtggtcaccagccttaggttctgcggacattctgattccccccatgtctgttcttctatggggcagctgaccctaatgcctaatctaggacacccatgggattataagaagatccctgccgctgctcttctccaatctccctgtcacacagtctggggtcgccggacattgtgaggggcctcaggattctgtggcagcttccccagggtttctgccgccacagactagcgcccctgtggggcgtggagtctcttaggaatccgggggcgtcttcccccaacagtctcataactttatcccatggcttagacytctcgtatgggtgggggctcccaggtctggacgttccasaactcctgtctagacatccgggttccacccccggacacgttggggcagcaccaggatcccccccgaggtccgcacacccacctctcagtccagcccacccgtccggcgcaggctcggcttagctctttcgggacccgacagacggattagacacgcgcaggcsggaggtgccgcgacccgctgtcccaggcccgctcagcaaccgtcccytggattctgcggagagctgcccgtccagccgcgccagcagcccggctggccccgccctgccccgacgcgccagccaaccctcgattgggtacctcccactctcgtgccccattgggaaaattcaatttgacggccacgccccgagrggaaggccccgcccctcgcgggccagggaggtcggaaattgggagtcttggggtcgtctgcctcggtggctttagcgagtcgggtgggcatcggcagggggacgcaggctctgcgccaagtcggggggggcgccccgagccgaggtaagtttcctggggtcgtaggagtctcagagccttcaggacagcccctctccgccctcctctttgttcctgagaccacgtcccctccctcgactccacccctttctcgcgtcagtgtttaagcttggccgccgtccctaggctgctttcgggacacctggtctgagccacctcagagcagggactgagtgactggcagcaccttgaccctgygttggagtgccgggaccatctcaggtggagcagaatcaatcacacagcacgcctcccccagcccacacacctttgaacagacattgccttcttgtagcatgcttctaccttccaagccctgagagtctgcctttaggagcgctggagtcctaaatagggaatatggagtccaggctgtcattcagcaaaagggggaaattgaggcccagagagagctgacatgtccaagaccaaacaaggaatcagccagggtacccaggaggtcagatccacaaggcaaagctattccatcttcagtgccagaggccctaaagccgcccttgggtctccatggagactaaagtgggtggagttgggaggatggggtctggagtcctgtcaaataaaaacaataacaaatcatttattttgtacttgccatgtaccaggcatataatgcccataacaagcacatgagaccatgactattgccccattttacagatgaggacaacagctgataagtagtaaagctgtgattcatacccagcaccttctgagtccagaccctgcttttaaccactataatgtgggattctggggaggtggtttcagcctgttaacccagaagagccccggttcaggtcctctgtgacaccccccagcccccatctaaggaaaggcccagtctccacactgagagtcttttccatgtgtcatttcatttcatccccacacccctgagaagtggtcccattttacacatcagaaaaccaaggcacgggccaggtgcggtggctcatgcctgtaatcccagcactttgggatgccaaggcaggtggatcacccaaggtcaggagttcgagaccagcctggccaacacggcaaaaaccccgtctctactaaaaatacaaaaattagtcgggcaagtggcatgcacctgtaatcccagctacttgggaggctgaggcagtagaatcacttgaacctggaggcagaggttgcagtgagccgagattgtgccactgcactccagcctaagcgacagagcaagattctgtctcaaaaaaagaaaaaagaaaatcaaggcacagaagaaagcgacttgtcaatgctacacagcaggagaggcaaacagagctcacttcggaggacatatttsaaggtcctaggctttctctacctgggcgagatgccatgttattatccagaacgagggtcaggcgccctctaagaccaattctgaatacttcaaaattcacgcgtcccttgggacctccccttcatgcagggcacacctaggccacctctgattttcagggcctgcctgaatggcggtcaccagctccaatgaatggcctgctttgtgctaatgccctcctttctccctgccctactgtaggctaggaggaatggtacaggtgagttcctccatgcttggatttactgtctggcacatgcgctcactagcccttggccctatggaagggatgtgtgggtcctgccccttcaagcccttagtgcytgggtccacctccagacatacccgcctgcctctgtcttcctctctgcaagggagtgggggtgatctagagatcaaagggcagtccggtacrgtgctagggaagtttacagctacagccgaggaaagagtaaacatcccgtgacgagggccccagcatttgctgaacacctgttgcatgtcagacgtggggctcccactactgccaggtgaccactgtgcaagataggtacactytgattcgacagaggaagctgaagctcagggaggtgaaggcaccttggcctagtaaaggcattcagactaaagtggaattctgcctgatgctgaagccccttccctccactttgctgccactaggatgggggaagctctggaagacttcttagggaagtggtgtataaactgtgtgtcacacttgtttttattttattttattttttttggagacagggtcttgctgtgtcccacaggctggagtgcagtcgcatgatcacagcttaccatggcctcaaactcctggctcaagcaatccttccatctcagcctcccaagaggctaggactacaggcacacaccaccacgcccagctaatttttaaaattcatcccayrtagaagagggggaaaggcatgaaagggcatttgtggcakaggaacagtgtgagcaaagaccaatagtctgggaaaaggaggaggataggctgtgggcggagcaggaaatgtgggtggttctctttgccaaggattctgaatrccagatgagcaggaygaatgtatcttgtgggcrccagagaggcctgggcctcascctgccccctgtaaaatgaggtgattagactggtctgcttcaagccttcctagggcaaggggctgtcacagaaagggtctactctaggttcttccaggttcaacccyrgaaaggcagaatgggaagtggctggagcagctcagaggctaggggtaatattttgctccagagcycaagtctgagaatgactattttaccaagctgtctgyrttgcatccctaagtcaccctggctaaccctccacccagtcagkgtccttcagagaaagcccaggccttgggtcaggaggcaagaagggtgatgggtgtcttacccctggctccaaccctaggtaagggttggccctcttggagcttcaacttgctcatatgcacaatggaggagctgtgccttgggctctctaagcctctctccccaggacagcactgtcattctggagacgggaacagcattagcaaaggaacggaagtaggattgtgacgaccttgytgggcaacagacaggcaggtgaggctggagaatggagcccctagaggtggatggttcttgttggggttggctggatccaaggggtatgaccttcctccttatgtgcagaactggrtgmrycctaggtcatggccagcagccctcggagtgggactgaggacctgytgggaaaccagtttggcaaggccatcatctccabgatgtcatccagccnctgtgttctctgggcaayagtgccaggcaaacttctggccctgcaggaggagaangggcctcagatgcccactgggcagcantgaattccaggagacccagcctcacagacaaaggagaggcaaggggctggaacaggaaggagagagttytggatgtgccagcctggacctctttagacttctgggagtccctgatgcctgggckcagggagtgggggtctaggctcatggtgggacactatgtaattgctacctgatgggttggacactggctcctgatcatgcttatactacatgtgtggcaattttgttaccactatgaccttcacagcttgagtcctgtgagrtargaccaccattatacagataaggagacaggctcagaaccctcgttcttttgttgttktttttttgttttgttttgtttttgagacagagtctcactctgtcrcccaggctggagtggagtggcacaaccatggctyactgcagccttgacctcccaggctcacagtgggactacagacacrtgccaccatgccyggctaatttttttattttttgtagagacaagggkctccctrtgttgccggggctagtctcgaactcctgggttcaagaaatccgcctgccttgaccttccaaagtgctaggattacaggcgtgagccactgcgcccggccaga

SEQ ID NO: 13261 - DNA, 22557 bp, Homo sapiens
gacttacctggctaggctgtcagcccatcgcttctattccctggtcagaggagagccgaaccccagctgtttgaatcattcctgctaaaccccggacattctgcagtcacatgctctgccccctgagctatacccccttcacctaaaccctagacattctggagcagagaccaataattcctaaagagtcctgcccaaagttcaggttcgtgagcaaaataaatgattactgttttaagccactaagttctgagaacttagtttgttaccaaagcaatggataactggaacatttgtatataaatatggcaatttaggtaagcacaatgaatattcatgaggtggtagttcacatatatgtatatgataagaatcacaagaatgaagtccaaagcaccttacaaatagaagaaattgttaattactaggatggctcatattcttcttattgttattctcatgacaaacacaagtagtttcctcagtcctagccaggacttcacgcttcttcagtaagaacttctggacaaaacaatcacagagagaaccttggttgggccataggtacttattactataattattattattttttgtttgcttgttttttgagattcagtcttgctcttgtcatccaggctggagtgcagtggcacgatctcagctckctgcaagctccgcgtcctgggttcaagtgattctcctgcctcagcctcccaagtagctgggactacaggtgcccgccaccacactcagctaatttttgtatttttagtagagatggggtttcaccatgttggccaggatggtctcgatgtcctgaccttgtgatctgcccgcctcagcctcccaaagtgctgggattacaggcgtgagccaccgcgcccggctaggtacttgctaagtgtgaacaggtttcgccaattatcttccatcatcaccctctccccaactggctgccgtttccacctrtgatagatcagtgttacacatgtgcattttccagaactcccagctgtgaggctgcaaacctggctccagggcctgagcaagggttccagggagggtctctgcattcggggccactgcagtgacctactttaattattctcttatgcagttcctttgactgcctataatatggtataggttctcctagactgaaaatcctttgaaggcaagaatttttaacttcagcgcctaatacggtccctgttacacagtagcagtttagtatatgtttatgggataactggatacacatacggtttccagacaatatgccttctgtttgactcattcagaatgtacttgggctggacccctaatttcatacaaagttccacgcgttgacagagcagctcagaggatggggaaccatgagctggtctttacaggcctgtacagtagaccctggcgaatgcagactcagattgtagtggcactgagagaagatatcccccatctcttcacacttggtccatggtcagctacttgcctctgacccacacttccctccactccgccccgcaccagtcctttcacatttcatataaaagaaagaaagaattttcccttttttggaaagaactttgtctttctctctcccacctatccttgaaaagtgataatttggaaactccccaaaagaaactaaagcaggccatgatatgtaagaatttttatttcttatttttatttatttatttttttgagagggagtttcgctcttgttgcacaggctgtaatgcagtggtatgatcttggttcactgcaacctccgcctcctgggttcaagtgattcttcttcctcagtctcctgagtagctgggattacagtcaccggccaccatgtctggctaatttttatagttttagtagagacagggtttcaccatactggtcaggctggtctcaaactcctcacctaaggtgattcgcctgccttggcctcccaaagtgctgggattaccaggtgtaagccactgcgcctagcccacaatatgtaagaatttttaaagcaactccttttggcatacagaagattagaaatataaagccctaggctgggtgtggtgactcatgcctataatcccagcactttgggaggctgaggcaggcggatcacttgaggtcagcagtttgacaccagtctggccaacatggtaaaaccccatctctactaaaaatacaaaaattagccagaagtgttcccaggcgcctgtaatcccagctacttgggaggctgaggcgggagaatcacttgaacccgggaagcagagattgccgygaacctagattacrccatcgcactccagcctgggcgacaagagcaaaactccgtctcaaaaaaacaaaaacargggtctatcttttttctatttccacccattgcccaagccaggacccagtgaaggcaggtagttgatctttgttgaataaatgaaatgcctagctaattattattatttttatttttatttttgagacagagtctccctctgttgcccaggctggagtgcagtggtgcaatctcagctcactgcaacctccacctcctgwrttcaaacgattgtcctgcctcagcctcccaaggagctgggactacaggtgcgtgccaccaagcccagctaatttttgtatttttagtagagacagggtttcaccatgttggccaggatggtctcgatctcttgacctcgtgatccacctgccttggcctcccaaagtgctgggattacaggcataaaccaccrtgcctggtcttatacttttttttttttataagtagagatggagtttcaccatgttggccaggctggtctcaaacttctgacctcaagtgatccacctgccttggcctcccaaagtgctgggattacaggcgtgagccaccacacccagccaaagatgcttgattgcaattttaaaaccacatgcttctattattattattattattattattttgaggggacaggatctcactctgttgcccagactggagtgcagtggcacaatctcagctcaccgcaacctctgcctcctgggttcaagtgattctcctgtctcagcctcccaagtagctgggattacaggcatgtgcctctactgcctgtatttttagtaaagacgggctttcaccatgttggccaggatggtcttgaactcctgacctcaaatgatccacccgccttgacctcccaaaggcgtgagccagcgggtccggctgcttctcttatttttaaagaaatattcagcaccaaggaaatgtaatgagagagagaaaactcaatcttcccatcctttccctggttcttatgatgctcaaagatgatttaaggaggtacagcagcctgctcttggctttgtgctcctgtgggccaacgggcacagtctaggaggcacgggagaactttcccaggggaattcctggagaagtggcttgacaacatatctgtatgctcctttgtgctctacaggtcctatatcagtctggatactccaagaaaatgtcatgaggggattagacgtctaacagatttactrgggtaaatgcctgtgagggaaaagagggagggaggcagaagagactacagagctgtcagactacaatgcaggactgacctctgcaaaggacagaaggaggaagatggggtaggaagtcttccatgactgtgcagtcgaaggaagtttcagcaaagcccatggggagtcattgaagcaaagttacctatcaaaggaagttgacttgcaggaaccgatcttaaggttcctgctttgctcagtcattggctgggaacagcctgtaggatgtgtggcctcagtgcaaagctgtggtagattcaaagcactgcggctggggcccttagtcaattaaaccaccacagtaggtctgaaagrtgcattttcatggctgccacgctattaacgagcattctaagcagcacctctcctttcctccttaaccctatggtgatagttcagaaatgcaggttatatatgaatcatttttcctatttgcagctggtcatagacaggataaaagactcaaagtcactccatatgtggatggaaaaaaaaagtgaattcaatttctccagcgaccatgagttatctcctttttcttccatccactgcaaaccttttctcaggattgctgccatagctaaatcaaatgagatttgcatttcacctatgaagttatatccttgataggtaaagagatgattgggaggccaaattcctcattagtccacaaaagaacaatgaggaactagctttgattaggcacgtacgttttaccaggcatggtgatagaggctttacataggtcatctctttgaacttcacctcaaccctctgaggtcaacatgtattgcctcattttacaaattaagcacagacccaaggtacatactgagtaaagaaagagagatttggctgggactgagtccaggccctctgactgtaagtccagtgctctttctggtcctgcaatttctaatccacacatcggatagtttacctgagttaaaaatgtgaattaagtcaggcttaaagcagaattttgttttctatcagaaattctagagtaggtggaaggtgaagaccaaagaaggtattttctttttctttttcttttttttttttttgagatggagtctcgctctgtcgcccaggctggagtgcagtggcacaatctcagctcactgcaagctccgcctcctgggttcaaaggattctcctgcctcagcctcccaagtagctgggactacaggtgcccgccaccatgcctggctaattttttgtatttttggtagagatggggtttcactgtgttagccaggatggtctcgatcttctgatctcgtgatccgctcgcctcagcctcccaaagtgctgggattacaggggtgagccaccgtgcctggcccaaagagggtatttttttcttccctctcggtatcatccttactcaattacaaatgatcaagggcggtactgccagagtcacctcgagaggccctgttctctgccacccaggctgttttgtagtctccattccaaattgtcgttactccggtttaccccgtggatggcgtttaagacttttcttaaatttgaaattcacagaaccattttaaagtgaacaattcagtggcatttagtaccttcgcagtgttgtgcaacttccacctctatctagctgcaaaacattttcttttctttttttttttggagacagagtctcgctctgttgcccagactggagtgcagtggcgtgatcttggctcactgcaacttctgtctcccgggttcaagcaattctcctgcctcagcctcccgagtagctgggattacaggcacacgccacccgcctggctaattttttgtattttagtacagacggggatttaccatattgcccaggctggtctcaaactcctgagctcaggcaatcygcccgccttgtcctcccaaagtgctaggattacaggcgtgagccaacgcggccggccttgtaaaacattttcatcacacaaaagaaaaccttctacccattaagcagttactccttcctcttctcagcccctgtcaaccaccaatttgctttctatcctatggatttaactgtctggatatttcatagaaatagaatcacataatgtatgaccttttctgtttggcttctttctattagcctaatgtttttgaggttcattcctgttgaagcatgtatcagttcttcattccttttttgggatgaataatgttccataatttatttatcctttcgtctgttgatgaacatttgagttgtgtccacatcttggctattgtgaatagtgctgccatgtacattcgtatgtaagtatttgagtatctgttgggtgtatacctatgaatggaattgctgggtcttttgacaattctgtatttaactttttgagaaactgccaacattttcacaggggttgtaccatttcacattcccaccagcaatctacaaggattctaatttctccacatcctgcatttaagacttgcaaagctgaattaatcacaggatgaggaagtggcttctctgaaacattttcctctttcacattttaaactttctctttcatacatgacatgaaacacagcctacgcacgaaagtgactaggaggaaggatattataaagtgatgcaaacagaaattccaccagcctccatgtatcatcatgtgtcataactcagtcaagctcagtgagcattctcagcacattgcctcaacagcttcaaggtgagccagctcaagactttgctctccaccaggcagaagatgacagactgtgaatttggatatatttacaggctggctcaggactatctgcagtrcgtcctacagataccacaacctggatcaggtccaagcaaaacrtccagagtgctacaaaakgttgcgttctcagtccaaaaagaagtggaaaagaatctgaagtcatgcttggacaatgttaatgttgtgtccgtagacactgccagaacactattcaaccaagtgatggaaaaggagtttgaagacgrcatcattaactggggaagaattgtaaccatatttgcatttgaaggtattctcatcaagaaacttctacgacagcaaattgccccggatgtggatacctataaggakatttcatattttgttgcggagttcataatgaataacacaggagaatggataaggcaaaacggaggctgggtatgtgtgatggaaaaattcttcattgttctttcctgtgaaatagaaattgagaatttccttgctagttaaaacaacaacaaaacactttacctaagaatactattttccttgggtggtttgttttaatttttaaaataaaaatatactttctggcttatttccaatgaatccttgaacttgaactttatagttggaaagcacttatgttttcagtttttattcttaacagtataaattacagtagtgagctttggggattaataaagcacctctctcatgcagcttcacaatcagctgtgcacacactctaatctagtacttagcttttgctagggttgtcatgacagtacagacagtacagaaatttctacaatcagcacagaaagttgctatcagatgctgttatttttaggtatttatgggttgcaaaagacaggtgtaaatttttgtaagttcatcgcttacaaattggtgtttttcagtttactaatacataataaatagtaacatatattaatatatagcaaattacattacatataatatataacacattattactaataataaattccgggctgttaaagtttgttgattaaaacataatatactgtatgaccagcaagaacctttattcaagaattttcaaataaaaatttactttattatcagtgcctaaaaaagccaagactatgtagaggcctgtgttgaaactcatgttggtaaaaagcctgacacagctggatgtatatggtttcctttatattccaatatacttaataattatttttttaaagcacttaagtgttcattgatcctctctccaacggccttcacctctcccaagaggtaaccactgttatcaattattttgcatgcaaaacatgcctactgaatctatccatagaaaataaacaatacttctttgtaaaacattttttgtaaaaaaagttttatataaaatgtatatgtatgcttatgtatatgttttacataacatatatgttataccatataacacataccttttttacatatacacatagattttttatgtatacatataaattttgcatacatatttttacatgtgtatatgtaaaaatagtacatggtactaatgctgccacttatttttttacccagaattatttaaaatagtattattaagagtgctgtgtatattctgttatatgtaagtgctgtagagtayctggccatttctagctgatagctgtttaggttatttcgagtttgctgtcacacacaatgcttcattgaatatcattttacgtaaatcttcccttgtgcgtgtgtgtagttttctagggtggatgttgggttgtagatgctgggtcatggtgtacatacattttttaatttgttaggtccttgccctccaaagtggctctaccaagttacactcccatcagcagctcgttaggrtatgccccgggattctcctaccccagctgactaacaktaggttgctgcaattcatcataattttcttaatttgttgggctaaaaatatagagtttatcttgtttcaattcttgttttcttgatttctagtaaggttaattttttttttacattttgagcatcttttcatatattaactgatcatttgtaaatgcagggaattgtctgtttacaccctttgcccattttccttttattttgtctttttcttattgatttgtaggaattctttgaatattctggatacaaattattatttttattattgtttaaattttttgagacagagttttcattcttgttgcccaggctggagtgcagtggtgtgatctcagctcactgcaacctctgcctcctggtttcgagcaattctcctgcctcatcctcccaagtagctgggattacaggcatgtgccaccacacccagctaattttgtatttttagtagagacagggtttcaccatgttagtcaggctggtctcgaactcctgacctcgggtgatcctccccctttggcctcccaaagtgatgggatcacaggcgtgagccatgcacccaaattatttttatgtatgtggcagatatcttttagtttgctgattaacgctaatgatgtctttggtcattawaaatgtttaaaagtttgttgcaatcaaatttattgatcttttacttgatgcctttttcattttgtttaaggccttcctgcatgatagagcttactgcagctactcccctttctcaatcaccttcttcctggaacttagttctttctaactgagcctgactgaggctgggcgaatcatgtgaaatgttttgtcatgttttcttccggttggctgtgggaggctatacttgaggactggtggaaattcagctgcactgtgtagatttcaggtgaaggcaaatgttctctggcacagaggaccacagatgagcctgcagagaaatactctactagtttgcaggctctatttgggtttggattgtatttccaaygcttagcataatacttggagcacacagacagtgaataaatgttagttaaaaatttaacttctccacaataaattttgtgagctcctggaactcactgttagcaagaggtgtggaattgtctctgagaatttctagtagtaccctcatctttcaagggtggtacagatgtaaacatgagtgtggccggatgaacctctcccgagtgtagatacaaatacacacattgcctgcacgtgcacacactcagcctttctaaagtttccaagctctttttttttwwwaaaaaaaacacctgaatagttcaagttgtagacatgaaataaatactcttggaaatgtcatttcaaagcaatctccatgccgctttcccagctcagatgagacattgattctgtcaacgataggcagtgcttttttgagtcagtgcaaactggcatggaaaactgttatcatcttttcatagtgatgttgacaaatctgcttaaatgaatgaatttactcttgaatgattcatttcaggggaaatggcacaatcacacrcctatgctggtagagtcagtggcccacaagaagaggtaagagtagagaargcacttacrgctttatcaagatgtgagcacatacaatctataatttaattaaatgttaaaattgcccagagactttatgaaaactttgaatcaacaatgcggtatgtgccgggtgcagtggctcatgcctgtaatcccagcgctttgggaggctgaggtgggtggattacctgaggtcaggagttcaagagcagcctagctaagatggtaaagccctgtctctactgaaaatacaaaattagcagggcctggtggcggatgcctataatcccagctacttaggaggctaaggcaggagaatcacttgaacctgggaggcggaggttgcagtgagccgggattgtgccactccagcctgggcaacagagtgactccatctcaaaaaaaaaaaaaaaaaaaagcggtatgtgagcacagcatagatgttcagagcaccaactcagaatcagacagacctggcttcatttctgggctcgagtgcttactacctgtgtgaattgtacaagttgcttaacttccctacgtcttgtttcctcatctgtaaaaacaggaaaatattgcaacctatgtcctgggactggtataaggatcaaattagttaatatatgcaaagcacttgaaacaattcctgaaaatgagtactcaatacaagtttaggatttttgtttaccatgtaaaacagatcccctaatgggaagaaacgagactggtctatcagtaataggactcataatctctttcgttattctctttctcctttttgtcagttgtctttccttccttcctgccttcctgccttcctgctttcctgccttcctgccttcttttgtttgtggcttctcatctctctttttgtcctcttccatatttaccatggtttcctcctgtcygctctcctaattggaagtgctgagaggatgtgctctcacaagatctgacaggagagctagtgccatttggctgcctccagcattcataaggaaaggatggttcttaaaaaccattagaatgttcatgagatgaaactcatgtctcttctcttgggatcacccttccttttgaaccagatgggtcttcttacttcctcccccttcaatgaagcattctcctctgcatatgctgggggagtagaaagaatgcttggcactcagctccacatgggagaaattgtgtctacttaatgcatcactgtgtacctcatgcctagcatagaaggtaacaatatttgctgatgggatgattcaacgaaccaacactgaaactgaatatttgaactctggttttctcactcactagaggtataaccttgggtaaattactgaggtactctgagactcagattccttatataatgtatataataatatgacatgacatatgataatttattatatatgtaatatttaatgaaaacaatcttacctacctttaaaggaaagctaaaggattataaaacactttttgtaaaacagtgctttccaagctgtcaaatactgtgcaactacgagagtcgtgggaaattccaggaagtttagataggtaattctttgcccttctgaagtaggatgtacagtcagagttggtgctttcccagtaaccaccattttaaaggttgggtcatacagttrggtcaagaggttttttttcttttttttttttttctttgtcatcctcttactctaaataatagtccggtcaatttgaggccaaataaatgggcacacagagacatgtatagatgattaactaagtgttcactttggcaaaggcatttccaaaaggtataaagatctagcagcaaggtgatactatctcaagtgttcatatatatcctttgattaaataagttttggggcaaaattttctatgtcttttgaatttttacttgagactctaaaatcatttagtgaaaaataaaagaccctcaagtcaggcagaaatgtatgacacttaagtgctagttctctaaccttgggagtcagcctggactcctgtctctcatagcccacatccatccatcagcaaatccccctggctgcccctttgaaatgctgtaataccctgtgcatctaggccgccttcctctctcacttgactctgtcagtagcctcctgccagactccatggttccatcctttatctgctagaatttgttttccacatagcccccacagcgatatttttaaaacttgaggggccgggcgcattggctcaagtctgtattcccagcactttgggaggccgaggcgggcggatcacgaggtcaggagatcgagaccatcctggctaacacagtgaaaccccgtctctactaaaaatacaaaaaattagctgggcgtggtggcgcatgcctgtaatcccagctacttggtaggctgaggcaggagaattgcttgaacccaggaggcggaggttgcagtgaggtgagatcgtgccactgcactccagcctgggtaacagagtgagactctgtctcaaaaaaataaaataaaataaaaacttgaattagatcatgtcttggcctaatcataaccctccaagctgcccttttaccctgggaacaaaagcacaaaatcctgactgtggtcctcaaagccctacatgacctrgcctctaaccgcctctcaaatctcatctgtgaatccctccgtgctctcatagctccagcctccttggataagctaagcacattccaccctcaaggcctttgcacttgctgctccctctgcctggaataattttccgccagaagtttgcctggcttacttcttccctttgctcaggcctctgttccaaggttgcctcctcagagaagtcttccttgatcaccccaactgagaaagtactactgccactctctgtctccctacccaactttattgccttcataatagttttcatgactggacatcccattgcatatttacttgcttatctgtttattgtctgtgtctgccgtgaaaatgtaagcttagtgagggcagggatcctgtatgctttcttcaccactgtgtttccagtgctttaaatggtacctggcatgtggccaatgctcaatgaatatttcctgaatgaataaatgaataataatgtttagagaagtgggagtaacataatggtgtttgcgtgtattttgtttgtttgtttgtttttttgaaacagggtcttgctgtcacccaggctggagtgcagtggcgcaatcttggctaactgcagcctcgacctccagggctcaagcaatcctcccatctcagcctcccaaagtgctaggattacaggcttgagtcactgcgcccggctgcctgtatctttaaaaattctgagattttgattttctttggactattgatactgtatattattttatgctttaggttttcttgtaaccaaggtagctgaatttaacaaactatcaccattcccagaaataataaggcctgaactattcttatttactactacattactgataggatattgaatccttgtttgtatatttatttttatataatggttttaagatacaaatagcatcattaaagaaaatatatttgaaaataacatttttgaaaggaagaaaagtcactcccatcaccctaacatatccacatgcagacattgtatgcaattataattagggtgcacaagagttttttcctgtgacatattgtagatattttcaacactgtctcacatatttcatgttaacattaggcattaatttctaatgtctacagaatatttcattaatttgttatatcataatttacttaaccaattcccaattgttagacaatttggttttttcgagttttccccttttagatataatgcttcaatactgaagcatgggtatgcttttctggtgccccctaccctccaatattttagaagactgcctcatgataaatttctaacactggaatgactggttcataagatgtgtgtataattacaatactctagcatattggaaaacatattttctttccaaaagtattatatcaatggaacaatgtcacaacaaacttaatgatgtgggtggtactattaataattttgaggtttgctaggcataaaataacaaagccaatttaataggtctaaaaaacaataagactgtgttaaaagtacatttttaactgctattagtgtttttcccatatacttgttaataatttatatttctctctttaatggtctttcccttttaaactattaagggcctgaggattttctgttacatttgaatgaactctttcatgctatatgtaaatattttcctagtctattgttcttttaattttaatttttcatagtttaaaaaaattttaggctaggcacggtggctcatgcctgtaaccccagcactttgggaggccgaggcgggtggatcatgaggtcaagagatcgagactatcctggccaacatggtgaaacccggtttctactaaaaatacaaaaattagctgggtgtggtggcgtgtgcctgtatagtcctagctacttgggaggctgaggcagaggcagaagaatcgcttgaacacaggaggcagaggttgcggccagctgagatcgcgccattgcactccagcctgggtggcagagcaagactttgactcaaaaaataataataataaattttaatctctttctggctgaattcatcatttttttctttgttcactgtcctttcgacattgatgtatataaggtgatacattatgactgctcaatgataatagacaatgatcrttgtcataataataaaaatcatgctgggtgcggtggctcacacctgtaatcccagcactttgtgaggccgaggtgagtggatcatgaggtcaggagttcaagaccagcctggccaacatagtgaaaccccgtctctactaaaaatacaaaaattagccgggcatggtggtgcgcgtctgtagtcccagctactcaggaggctgaggcaggagaattgcttgaacccgggaggcagaggctgcagtgagctgagatcgcgccactgcactccagcctgggcaatagagcaagactccatctcaaataataataataataatttcagagggcctcattatacttgcgaaacatggggtttatgaaaattctaggaaggggagtaatgaagtggatacctcttgagagtgtataggaaactatgagtatgtactggcaggagggaaagaggaagaagagagagggccagtttccttcctctgtcaaggcatgacagcatgtctcagagcacgatgtacacttaacacgtaggcagaaaatggctttcttaggcagtctttcaaatgaaatccccctggctggtggtattcatctgctttgccagtgatgctcataaaatgattccaaggcaccgcagagctctcgagtcactcccaactatcaaagagttatgctcggtttacatttcaatattagttacactgggctctgagctacttgcaggcatttgtaaccccaaggttctgaaacctgtaaggtgaagacgtaaatgtytgccagatgaccatttgaaaaaattattttaacaattttctaattcttttggcacttgtttggaaatgtatggagtggaaagaagtarggtgttcacattctcatccaagtccaggcaccaacgggttggctaatcttagataacttatttttctgggcctcgatttcctcatttgttaaaataatggagggcttcaggctagatgatctcagagatagtttttggtgaggattatttgactacagattgtaaattaactaaataaaatgtccagttaattgggttatcctatatttttaaaactatgtctgatcacaaagagagtagattataaaataaactatcaaccttttcatagcttcaaaggtattagtttaatttggatttactgtgagttctcatgattttcaatacaatgcagtttacagtataatataattcatattacawatataagtgcattgaaatcaatgttggacaattgaacaagaacgagaaaaaaaaaggctttctatcctctagagctgtgcttgctgtccactatggaagtgaaatgtggctagtctgaattaagatgtactgttaagtactaaatactcattggatttcgaaggtttgttatgaaaaaagaatatctcattaatgattttatactgattacatattaaaataaaaataactctaaaactatcctaaaagttagttttatctatttttttactttgtaaaatatggctacaaaaaaatttaaattacagacgtaggtcacactgtatttctgttagatgctgctgcttaacaggggtagaaggggtagaagattaactatttgcactatttaaatgaaaatatttttgctttttattccagcatacttaatctccaatgatgtttaaagtgttaaatttattcktttataggaaaatggctttgtaaagaagtttgaacctaaatctggctggatgacttttctagaagttacaggaaagatctgtgaaatgctmtctctcctgaagcaatactgttgaccagaaaggacactccatattgtgaaaccggcctaatttttctgactgatatggaaacgattgccaacacatacttctacttttaaataaacaactttgatgatgtaacttgaccttccagagttatrgaaattttgtccccatgtaatgaataaattgtatgtatttttctctatatgccattttgtcttaatttcttgggtctggctggaaattcagccaaagggtaaagctcaacacaggagccaggcaattaattatgggatgatgaccaggaaggcggtgtcttttctgccccacggtagaccctttcaggtgtgcccattgcgcaaaagtccttctctgtgtcactaggctagactgagaagcagactcaggctagaagcagactcaggtcggcttccctcttccctccttccttccttctttcctatgctttctgcagtttccagtgcccctggctgcttagagtttccactgacgcctcctccgcagccttctctctctggcttgacatttggggttgatggatatggcaacccgacatgcaggatactcggggatattctgaacaaagaaaattaggtaaataatttaatgtggagctagtgtttaaaaaaatgggtttgtttttgtttttgttttgtaaaaatgaacagattaggaattacgtggtttgttagatcttgtgttctaatttttaggtcagcaaatctgattgcgatatgggaactccataccttgttctagaccttcctggccttcccttcctcttttttttaattttaattttaattttttaaatttttttgtttgtttgtttttgagacggagtctcgctctgtcgcctaggctggagtgcagtggtgcgatctcagctcactgcaaactccatctcccgggttcacgtcattctcccgccacagcctccctagtagctgggactacaggcgcccgccatgacgcccggctaatttttttttttttttttgtatttttagtagagacggggtttcaccgtgttagccaggatggtctcaatctcctgacctcgtgatccgcccgcctcggcctcccaaagtgctgggattacaggccaggccctcttgccttcctcttagaaacattcccccgggggcttacaaaattacctttccctggaagctgttgatagattgcataaagaagccggagctcgggccatatacattctcgccgggcactttagttaattaatgctttacctaggaggtgtgattctctctctttttttttttttttgagacagagtttcgctcttgttgcccaggctggagtgcaatggtgtgatcttggctcactgcaacctccgcctcccggattcaagcgattctcctgcttcagcctccagagtagctgggattacaggtgtcccctaccacgcccggctaatttttgtatttttagtagagacggggtttcaccatgttggtcaggctggtctcaaactcctgacctcaggtgatctgatcgcctcggcctcccaaagtgctaggatttcaggtgtgagacaacgcacctggccaggaagtgtgattcttaacggtggggattaggacacaggtgctgtcagtagggaagcgtttttggcagaggcagctttggtttacttaagaagtcacgtctgagaggcaaccatctatgccatctgaggcgcctgtcactcggagcagggtaagacttcacagtttcctttttccttctcttcctccaagtgcctcacccccacccyccccccaactgcttttagtgttcattctttttttatttttatttttgagacggagtcttgcttgctctgtcgcccaggctggagtgcagtggcgcgatctcggcttactgcaacttctgcctcctgggttcacgccattctcctgcctcagcctcctgagtagctgggactacaggtgcccaccaccactcccggctaattttttgtattttttttttttttttagtagagacggagtttcaccgtgttagccaggatggtctcaatctcctgacctcatgatccaccagcctcggccttccaaagtgctgggattacaagcatgagccaccgcgcccggcygkgttcattcatttttgtgtgttaatcagagctgagtggtgggaatgaacagtcactgatggttctaacaggaagtacatatatgggcactattacctggaatacattcacatgagcaaccacaaaatctggtttttacactgcagttgtttctttagcaatgtgacactgggaaatcagtgactatttctgatttggtctgtgacctggtcttttaaactgtaccttgctgtgtgttttgtttattaatttactttaaaaaaaggtttttatggctgggcgcagtggctcacgcctgtaatcccagcactttgggaggccgaggtgggtggatcacctgaggtcaggagttccagaccagcctggccaacatggtgaaacctcatctctactaaaaatacaaaaattagccgggtgtggtggcgtgcacytatagtcccagctatttgggaggctgaggcaggagaatcacttgaatccaggaggtggaggttgcagtgagctgagatcgcaccattgcactccaggctgggtgacaagagcgaaactccatctcaaaaagcaaacaaaaaaaaaaggtttttataaacctcaactcttacttcatgtggcacagaaaaattaaatggaaagagatcacaggcctaaatttatgtgaaaattatacaacgtctagaagaaaattaawtttttttaatttttactgttaaaaagacactttaagaactcaaacagaaggtatttgaattatacctcaataaagctatttaaaaaagctctcaaaaaggcaaaccacagaatgggagacaatctgtaccacactaatatctgataaaggacttgtgataggtgatactcttataattcaataacaagatcatcatcaacctaatactaagcatgggtaaaagatttgaacagacacttcacaaaagcagatacacaaatggccagtagacatggaaaagatgttctggagaacatgttgagcaccattagtcatcagagaaatgcatttaaaaccacagcaagagaccactacatatcctccagaacagctaaaatgaaaaagatagataatgccaagcttttgggaaaatgagcaactggaagtcttacacactactgatgataatataaaattgtactactactttggaaaacagcttggaaatttcttataaagttaaacatacacttattgtaggacccagaaattcctctcctggatatttaccccaaagaaataaaacatatgcctatattattcatagctttattcataatagtccaaactggaacccaaatgttcatcaacaggggagtgaataaacacactttggaatatccatgagacagaatgtcactcagcaataaaaaggaatgaactactggtacatgcaacagaatagataaatctctaaaacatgtcgagtgaaaaaagccagtcacaagagtacatagtgtattaactcctttatgtgaaactcaaaaaaggacaatacgtagtgtcagaaagcaggtcagttgttgcctgaggctgggatgtgagtattgactaagaactttgcctagggtgatagaaatattcttcatcttgattgtggtagtagttacatgggtgtataaatttgtcaaaactcatagagatgtacacttaaaactggtgcattttattgtagataaataatatctcaatgaagttgacttagaaaaaagtgtttctggccaggcacggttgctcatgcctgtaatctcaacactttgggaggccgaggtgggcggatcacaaggttagatcgagaccatcctggccaacatggtgaaaccctgtctctactaaaaatacaaaaattagccaggcgtggtggctggtgcctgcagtcccagctactcaggaggctgaggcaggagaattgcttgaacccgggaggcggaggttgcagtgagctgagactgcgccactgcactccagcctggtgtcagagcgagactccgtctcaaaaaaaaaaaaaaaaaaaagaaaagaaaagaaaaaagcggttttttgtgaaaaataataaacactcatcagaagcaatgtaaacaatacaaaatgagagaaataaaaatcactgcaactactaatttaaactggaaagttattaataccatgaataaagtcctgaagcaccattattttgtttgccttgtcatttaaaaggactttgtcattgtaaattagagccttgctgacaatctaccaggccctccctacgtggtttgttctctactgtgattgtcccacttcatttcagttgtgtcctcctccggagtctgtctcttctgcagctttgctgggctgttttcaggaccttctgccacagatgtttgcctgtgctgttccttctgcctctgcatctggttaatgcttacttgcctttcagagttcagctcaaagttcacttcttctggatgccttccctgactaggttaaattctgcaattatagtcttacaaaatgtcactgtctcaattacagggttatatttgtgtgatttttaaatcaatatatctgtttccccaatagatactaagttctgtacgggcaggaactatggctgtttttgtttaccatttcatttcagagctcagttcagaacttggtaagagttcaataatatttttgtttaaaaagaaatgggggccaggcacggtgactcacacctgtaatctcagcactttgggaggctgaggcaggtggatcccttgaggtctggagttcaagacaagcctggccaatatagtgaaacyccgtctctactaaaaatacaaaaattagctgggcgtggtggtgtgcacctgtaatcccatttactcagaaagctgaggcaggagaactgcttgaacccagaagacagagattgcagtgaaccaagattgtgccactgcactccagcctgggcgatagagtaagactctgtctcaacaacaagaacaacaaaaactacaacaacaaatgggaatgaacattaattggttttgattatgtcatttcatagcaaatgaggctggagtgaggctgaacatcatgttctcagtaatagyatgtgctatggtttgctccaaaactcatgttgaaacttaatccccaatgcaacagtgttgagaggctgggcctttaagagctaattcgatcatgagggctctgccctcacgaatgaattaatccatttacggattaataaattaatgggttaatggattaatgggttaacatgggaggggaactggtggctttataaggagaggaagagagacctgagctagcatgctcagccctcttgccatgtgataccctgcactgccttaggattccacagagtccccaccagcaagaaggccctcaccagggccaggcgcagtggctcactcctgtaatctcagcactttgggaggccgagatgggtggatcatgaggtcaggaattcaagaccagcctggccaatatggtgaaaccctgtctctctaaaaaaaatatatatatatacaaaaattagccaggcatggtggtgtgcacctgtagtcccagctgctcaggaggctgaggcaggacaatcgcttgaacccaggaggtggaggttgcagtgagccaagatcgcaccactgcaccccagcctgggtgacagagtgggactctgtctcaraaaaaaaaaaaaaaaaagaaggccctcaccagatgcacctcctcaaccttggacttcctgacttccatagcagtacaaaaatacatttctttcctttacaaattacccatttcaggtatttcgttataaacaacagaaaattgactaatgcagcatgggagagtgtaatggctgtttaatggttgttgtccatctgtgaagaactttagatacataatttttaatcttcatgatgwccctctgaagtagatattttccgtattttactgttgaagaaacaggcttaaaaccagtaagaaacatgcccaatgtcacagagttgggggcatctgacctcccagcagtcctcactggctctcagtcactgggcgtcctc

SEQ ID NO: 13262 - DNA, 141121 bp, Homo sapiens
  misc_feature (1)...(141121): n = A,T,C or G, or insertion/deletion polymorphism (see Tables 1-2)
gctaatttttatattttttgtggagacggggtttcgccatgttgcccaggcaggttgtaaactcctgagctcaagagatctgcccaccttggcctctgaaagtgctggggttacaggcatgagccaccgtgcctggccttgatgctgcacttttytaagcaataattcaagtattttttaactggggtagagggatgcccaccctatcaattttatgcacctgctgtttyttatatctcacaatttcaaatgcacacatttaaaatttgcctaagattggtcgcatttgtatgagttgttctyttcagccctttctttcaaaactgtcatggagatacttggctcattctcttggtgttcctgaatgcagtttcagaaatgaaaactttaaaaatcaaaattccagcttggttcaagacattggttggtgctcaatgtgtgtgcatatatatatatatmtatatatatatwtttttttcattttttcagcacacaggtttttttttttcatttgttttgttttgtttttttgagacaggatctcacttggttgcccaggctggagtgcattggtgccatcatggctcactgtagtcttgatgtcccaggctcaagtgagcctcccgccttggcctcccaaagtgttgggattacagacgtagccattgcccccagcttacacacagtttttgagctcttactctgtgccaagcaccaagctgggtacaaggatccaaaatgaatgacacttggtctatgtccccaagsaccacccagtcggtcagggagaacagacaaccgaacaagccacttccatgccatgttttctgtgtcatcatgatggaagtctgtacccaggcctcccaggccaggatggactgggcaaagagccccaagggagtggactgccgaatttctaaagcatttggccactgtggccagcagagggcatgagagggagtggccattcagcaggggtcaggtttagagggccccgtatgccctcctttcctggggaggatgtaggatttaatctgttgggcctctggggaagccgggatagcttttgcaacatttttggcaatgttctctggctgttgttaatttcaaaatttttcctgagggcatgtgtgagccagctgtttcaggactcggacctttcttgcagacaattttaaagattttcttgagaatttactatgcacaagagaaatagtaatagtatgaaatagactttgtccccagaggttcctagctcaccattcagaggcaaaaggagacgggaaggcaaggactaggcagaggagttgagaccagagattcacaaccaaagggcagttttgcctcccatgggacatttgtcaatgtctggagatgttttggttgtcccagctgatggaggtagatgctactggcatcaaacaggcagaggtcaagggtgttgctctacatactataatgcacaggacagcccccaccacaaagaattttccaaccctaaatatcagtagtgccatggttgagaaatcctggggtaagaacaaggcttgggcatcagaaagatacccatagtactgctatgtatttgtttgagtcgttgttttcaattcttttgggatatacctaggagtgagattgctggatcatatgataattctatgttcaactttttaaggaaccaccagacttttttccacaacggctacaacattttaaattcctactggcaatggttaagagttccaatttctgtacctcttcaccaacacttgttattctctctctctctcttttgggttatagccatcccagtgcatgtgaagtggtatctcactgtgattatatgatttgcattttcctgacacctaagcatgttgaatatcttttcatctatttattgaccatttgtatatcttcawtggagcaatgtctatccragtcttttgtccacttaaaaattgggttgtctttttgttgttgagttttaggagtwctttatacattctgggcactagactcttattagatatatggtttgcaagtggtcctcccattctgtaggttatcttttcactttcttgatagcatcctatgattcacgaaagcttttaatcttgatgaagtccaatttacctattttttcttatggtaaattggacttcatcaagaagcatccaatgcttgtggtgtcatatctaagaatcaattgacaaatccaaggtcatgatgaattacttctatgttttcttctaagaggtttgtggttttagcttttatatttaggtctttgatccattttgagttaatgattgtatgtggtatgaagtaggggtccaactttttattcttgtgcatgtggaaatccagttgttccagcaccatgtggtgttaaagaggtaatacttttttttttttttttttgagacggagtcttgctctgtcgcccaggctggagtgcagtggtgcgatctcggctcactgcaagctctgcctcccgggttcacgccattctccttcctcagtctcccaagtagctgggactacaggtgcctgccaccatgcctggctaaatttttttgtatttttagtagagatggggtttcaccatgttagccaggatagtcttgatctcctgacctcgtgatccacctgcttcagcctcccaaagtgctgggattacaggcatgagccaccatgcctggcctgaagagatcattctttctccattggatggtcttgatatccatgtcaaaaatagattgaccatagatgtataggtttctattccattgatctatatgtctatcttatgccaaataccatgctgttttgtttaccatagctttgtagtaagtttttaaattgggaaatgtgaatcttcaaacatattttttaagattgttttggctgattggggcctcttgaaattccatataaatctgtatattcctttggataatatggacatcttaacaataagtcttccaatccatgagcaaggtatgtctttccatttatttaattcttctttaatttcttttagtaatgttttgtagttttcagtgtgcaggtctttcacttctttggttaaatttattcctaggtaggaaacaagtgtgataggcaataatagaaaaaggaaacattgaaattaaacatatttatttctaggtkttttattcttttgaatgctattataaatggaattgttttcttaatttctttttcagattatttaccactggtgtatagaaacacaactatttttgtgtatttatcttgtatcctgcaactttgcttaattatttttattacctctacaataccaaggttttctgtgtgtgtattatctggcactttctacatataggaccatgtaatctgtgaataggggtggctttacttcttccttcctaatctctatgtcttttatttcattttattgtctaattggtttgtctagaacttccagtacagtgttgaatagcactggtgaaagtgggcatccttgtcttattcctggttaaagctatcagcctttccccatttagtatgatgttagctgtggatttttcataaatgtactttattaagttgcagttcccttctgttcctaattttctgaatgttgttatcatgaaagggtgttggattttgtcaaatgcttttcctgcatcaattgggatgatcatgtggtttttttccctttgttccattaatgtggcatgttacattgacattgagycacccttgactgacttttctttaaaaaaaacacatgatgatcttgaaaggaaaaaacccctctgaccctgtgtactacctagaaaatagccttggcaacatatcagcaaattctgctgctgaaagtgtgtaagaagtacttggattgtttagttctgggaaatattgagaacttttccacttcctttaaaaacattgtgttgaaatttaaaaagaaaaagctttatggcagggcrcagtgtctcacgcctgtaatcctagcactttgggaggcagaggtgggcggatcacttgaggtcaggagttagacaccagcctagccaacatggtgaaaccccatctttacaaaaaatacaaaaattagccgggcatggtggggggcacctgtaatcccagctactagggaggctgaggctcaagaatctcttgaacccaggaggcagaggttgcagtgagctgagattacgccactatgctcccacctgggcgacagggtcagattctgactcaaaaaaaaaaaaaggatttttagataccaaattgacctgctgagctttgtggtccacttttgtaatgcttctagtatataattgtggcaaaattggttcagaaatttcaacacatagagagaggtcccatttaaaaattttttttgaaatagggtctcactctgttgtccaggctggagtgcagtggtgccatcttagctcatttcaacctctgcctcctgggcttttcttttctttttctttttttttttgtttttgagaccaagtctcactctgttgcccgggctggaatgcagttgcatgatctcagctcactgcaacctccacctccaggttcaagtgattctcatgcctcagactccygagtagctggaattacaggcacccacctccatgcccagctaatttttgtatttttatttttagtacagacagggcttcaccatgttggccaggctggtctcaaactcccaacctcaggtgatctgcccgcctcagcctcccaaagtgctgggattacaggcatgagccaccgcactgggctcatttttaaaacaagatttccttcaaataacaatgatctactcattagtagggcagagttagggtgatagaaagaggtgtggcttagagattggaatacctgggttcattctttcaatacacacttgtaagccctcattgcataccaggcactggtctagaccctgcaacagaaaacagtctcccgaggcttgttgggcttctatgctagttgtaagcataccccacactggggatgatggcgcccttcctccctccagggccatgatggtgactgactatatgataataatactagaatgatgatgatgatgacagaagcaacaattccctttcatttataaagtggaatataattaagagtctttaaaaaaaaaaaataacagctttggctgggcgcggtgggtcacgtctgtaatcctagcactttgggaagccaaggtcaggagttagagagcaacctggtcaacatggtgaaattctgtctccacaaaaatacaaaaattagctaggcatggtggtgcatgcctgtagcccaagctactcaggaggctgaggcagaattgcttgaacccaggaggcggagtttgcagtgagcagagattgcggcactgcactccagcctgggcaacaaagggagactgcatctcaaaacaaaaaaacaaaaaaaccccagctttattgagagataattcacatggcatacaatccactcatgtaaaggacaagtcaatgttttttaactgtattcacagagctgtacaaccatcacctcaatctgctttagaacattttcatcatcccaaacagaaaccctacactctgtagccatcatccccatcccactaggtcctggcaaccactaatctgttttctgtctctcaagattggcctgttctgcacacttcatatacttggaatcgtataatatgtgaccttttgtgattggcttctttaacttagcagttttcaaggttcttccttgaaccttggcaggaaactaagatccagaggggtgaaggaatatgtccaagcctgtttcaggcagagcagggaggagaaccccatctctcccctcgtccagtatttcaggaatacacagcaccccaacagcctcctgccccactagcttctttaggagagaaatcacttgattatgtaaatcctaaaatgtctctccttttctccttacagattttctgaatggtcttgcttctttgtytatcttgtctgattttctcctgtctgaccttttcctggttaaaaatctgggggaaaatgacggactccaagccgatcaccaagagtaaatcagaagcaaacctcatcccgagccaggagccctttccagcctctgataactcaggggagacaccgcagagaaatggggagggccacactctgcccaagacacccagccaggccgagccagcctcccacaaaggccccaaagatgcyggtcggcggagaaactccctaccaccctcccaccagaagcccccaagaaaccccctttcttccagtgacgcagcaccctccccagagcttcaagccaacgggactgggacacaaggtctggaggccacagataccaatggcctgtcctcctcagccaggccccagggccagcaagctggctccccctccaaagaagacaagaagcaggcaaacatcaagaggcagctgatgaccaacttcatcctgggctcttttgatgactactcctcygacgaggactctgttgctggctcatctcgtgagtctacccggaagggcagccgggccagcttgggggccctgtccctggaggcttatctgaccacaggtgaagctgagacccgcgtccccactatgaggtaatgtgcattttctccttgtaactgaggagtgcagagttcaggtggggtccacacccttcccaacctgtgcccaccttgatcaagcygtttgctgatgccaaagcttcaagggtggctatgcacaaaaggagaagacacgagccttctcagaagtttccttccttccttcyttccttcyttccttccttccwtccatccwtcyttccttcyttcyttccttccttccttccttccttccttccttccttccttccttccttccttccttccttccttccttccttccttccctcctttcaaaatcattccttgaggctgggcacagtggctcatgcctgtaatcccagcactttgggaggccaaggcaggcagatcacttgaggtcgggagtttaagactagcctggccaacatggtgaaactccgtttctactaaaaatacaaaaattcaccaggcatgcaggcgtgtgcctgtaatcccagctgcttggaaggctgaggcgggagaatctcttgaacccaggaagtggaggttgcagtgagctgagatcacgtcactgcactccagcctgggtgacagggcgagaccttgtctcaaaaaaggaaaaaaggaaagaaatcattccttgtgcatctactgcatgcacagggctcgatgccatgaaactgactttctagaagrcctcagcctagttggggaagatgaccttgtgtttagttataatttaagctgaatgagccaaggctggcaagagccacaagtgatgatggtagtctagagggaggggcagttctctctgcctcctgaagagacattgattcattcattctttttttttttttttttttttttttttttgagacagggtcttactctgtcactctgttagctgagtgtactggtaggatcatagctcactacaacctcaaactcccgggctcaagcaatcctcccacctcagtgcactcctgggtagctgggactacaggtgtgcaccaccacacctagctaatttttaaattttttatagaaatgggaatctcaccatattgcccaggctggtctccaactcctggactcaagcgatcctcggtctcccaaagtgctgggattacaggcatgagccaccacacccagcccattcattcattcattcattcagcaggtaactgacaactgaaaaaccagccttcccccagtgatgcctgaaaagcagaaactcaaacactctaaaggtctccatcaatttgattgttggaaatgaatgcctgtaggttcataacaggtgggactatcccagcggctgcagtcagtggctttgttgttgatgttgttgttatccaccttctcctctgccatccccaaattacaaatggaatacagcacttccaggtagaaaatttgggaaatataggagaacagagagaagaaaagagccaccaaccaaaacttcaccagccagagggaaacctctgttctcattgttctacttcttccttctagtgtgtttttctcctctggagtgaagttttactggctaktcttttaagcatctcctgtactctctcccaaattagaaaaatctagaggtggtcttccatacatgtccatgttagcagtgagcttggttttaaccctggtagctggaagtagaagacagagaaaaaggaggaggaaagtattccatatactgaaacttttcaggggaagagtgtttgagtttctagaagggttaagggaagagaaagtctcagaatctagtacaaagagcacagtctgtggagtcagctggagtggggttcagtctttggctctgccaccccctactgtgtgaccttgggcatgacccttcacctctccaggccccagtacctctgtaaaatgtggaagggattaaatgggataatgtaggcaggcatggtggctcacacctgtaattccagcactttgggaggatgaggcaggaggatcgcttgaggccaggagttcaagaccagcctgggcaatatagtragacctcatctctaaaaaaaaaattaagaatttgccagacattgtggtgcatacctatagttctagctacttgagaggctgaagcaggagggtcacttgagcccagaagtttgtggttatagtgagctataattgtgccactgcactccagcctgggcaacagagcaagaytctgtctcaaaataaaaaaacaaaaaagaatgtatcaaaccaacaaacttataacatgattattattattactatttcctgagtcttggatgccaaaatagtcgtgaagattaaatgaactaatatttctcaggtacttggcaagagaataaagcatccrtatttggtagataataaatagaaaggggggcaagtctcccacctttccacccactgtcttcctgccaccattttgaggggtctttactggtttgagcttaaaccaaggtttttctgagctggtacatttataaaggygaaaactatctctctctttctctttctttcttctttttttatttttttggacagagtctcactctgtcacccaggctggagtgcagtggcatgatcttggctcacagcaacctctgcctcccgggttcaagcaattctcctgcttcagcctcccaagtagctggaattatgggcgtgtgccaccacacctggctaatttttgtatttttagtagagacggggtttcaccatgttggccagtctggtcttgaactcctgacctcaagtgatccacccgccttggcctcccaaagtgctggaattacaggcatgagccatcacrtctagcctacttaactatctttcatagggaaaatgaaaccaaaatgttgagtgaatttcctgccctcgtgtcttcatggcatagaaacctaacattgtagatcaatcttttatccttactttgtcccagcaaacagctggcaggagggacagagggatcttggaaaggcagtgaatgtggagctgaatgacattgtaggattgtgggcgattcaaaggctatgatatggtgaacgaaggagtgatgtgctgcatgaacttgggtgagtcccttcccctctctgagtctccaatttmtcatctttrgaatgaggaggctgaggctgggcctgatggctcatacctgtaattccagcactttgggtggccgaggtgggtggattgcttgagctcaggagttcaagaccagcctgggcaacatggcaaaacctcatctctacaaaaaaatataaaaattagccagttgtggtggtatgcacctatagtcccagctactagggaggctgaggtgggagaatcacttaagcccaggaggcagaggttgcagtgagctgagattgccccactgcatcccagcctgggtgacacaggcagaccctgtctcaaaaaaaaaaaaaaaaaaaaaatgaatgaggaggctgcaccagactcctgagatgtgacctgtggccctaaagctcactgacatacagttagttattttgtccccrgtatgtgtgcattttcagagttgagaatttagaattttagcacccaggggcaatgcgggtggttctgctggcacctcctgagacactggcacttcctcaaggaacattcccagccccagratcaggggcttctgacagagaagactcatgtgtgcttgttgtttctaatgaactgtagtgagaatcccacatcaaagaatcttcagggagtcaagccttagacatgtgtgctggtgcctgctgcctctggtgtttgactggatgaaaaaattatgtccaaacctggtgttccagcctgttggaaacaacgcatatcaaaatgaggctgaggtccagcatggtgactcacgcgtttggggagactgaggtgggaggatcccttgagcccagaagtttgagagcagcctgggcaacataatgagaccctgtctctacaaaaaataaaaataaaaaataaaatgaggccaggtaaggtggctcacacctgtaatcctagtactttgggaggctgaggtgggtggattgcctgagctcaggagttcaagaccagcctgggcaacatggtgaaaccccatctctattaaactacaaaaaattagccaggcatggtggtgcacgcctgtagtcccagctactcaggaggctgaagtgggagaatcgcctgaactcaggaggtggaggttgcagtgagctgagatcacgccactacactccagcatgggcaacagagtgagactctgtctcaataaataaataaataaataaaatgaggctgagcattttattatcttgtagagcttttggctttggattttggcatctttgggatccktggtagcctggtgtttgctggttacccattgactcttttgcacacatacaggcagggtagtaatacctcttccctggtgttcacaggtcaacacccaagcagttttgggtgtrggccatggaaggtggtgtcaaaagacaaaatcacagcaaatttgatttaaaactcgaattggcttttatttacaattctaggatcatgcagcacctcattctgtaaaatagaatgggtcttccgaagagctgagcagagaggagcttggctttataggcagaacagggctgaagaaagcagaaacaagggacaaaggggagcttcatagtttctttctttttctttttctttctttcttttyttttttttttttttttttgagacagagtcttgctctgtcacccaggctggaggctggagtgcaatggcacaatctcggctcactgcaacctctgcctcccgggttcaagtgattcttctgcttcagcctcctgagtatctgggactacaggcacatgccaccatgcctggctaattttttatatttttagtagagatggggtttcaccatattagctaggctggtctccatctcctgacgtcgtgatccacctgtctaggcctcccaaagtgctgggattacaggcgtgagccactgcgcccggcccgcttcatagtttcaaaatgactttcccttcagggttaaaacaaatgcaactttcttatcatgttggctcaggtacactggaccccttctgattggttgctattgttttytggaaaactggtcagtttcaaagttcagactgattgcgaggcagttggccaggagtgatccgtcgttttggtttggtctgtaggggctaagcacaggagctcagctcaaaatcatggcctcccatatattaaaattttgttttaattttttagatttggggggtacaagttcagttttgtcacttggatataattcccagtggtgaagcctgggcttttacgagccattgcttgcatagtgtacattgtatctattaggtaatttgtcattccttaccccttcccaccatgccacctttccaaatctccagtatctattattctactctttaggtccatgtgtacactttatttagctccacttataagtgagaacaagcataaattatatttaagggtggtgcatgcaggccagccagccagttgcctgtaaccagctggagcactgaggaaaggaagcctgacccaaaaaggcaaatacagtgagcaagaatccctgttagctgaatccaggaactccttctgaaaaaaaatattatttttcttgaggccaggcacggcaggtcatgcctgtaatcccagcactttgggaggccgaggggggcggatcacaaggtcaggagtttgagaccagcctggccaacacggcaaaaccccatctctactaaaaaaaaaaaaaaatagaaaaattagctgggcgtggtggcaggtgcctgtaatcccagctcttcaggaggctgagttaggagaatcrcttgaacctgggaggcagaggttgcagtgagccaagaccacgccactgcactccagcctgggcracagagtgagactctgactcgaaaaaaaaattattattattttttcttgataagttgctaaataatctgtatcctctggcaaatcttctaaccgtttgaggtcctgtttctgcaaaatggaagcaggggctagaggtttaagctagtccttccagacaggatccaacccttgccccatttccaagacaaacaactaaggcctgggagaagaggccaggggtatttatttgagggttctgactcacgtggaagccacagtgaagaagtgacttgtatttgtggatctgcttctgctctctgcagtttccttgggcagtcacttcactgctgctctgccctggaaggccacttcctacattcacctcttcctgccaggccagtagctgggagactggcaaggcaaggatggaaaatgcttgtgttaagtctgtgatttgggaggaagctctttctgaagcagtcttcaaggggctgtctccttcctgcagtgcccagagcatcccagagttctcacaactgtgttcctgttttgggagttcgcactgggttccctctgaactgraacactctctttctcccaacccctgaacccagacctcccaccagggccagcttcacaggcatgccctgtgcttcaagggaccccgtgcttgttttracgctttgttgtcgccgtcttgagattcttttttattttgttttttgagacatgatcttgctctgatacccaggctggagtgcagtagcatggtcatggctcactgcagctttgacttcctgggctcaagtgatcctcccgtctcagcctcctgactagctgggactacaggcacgtgccaccacagctggctaatttttttatttttggtaaagatgaggttttgccattttgctcaggctggtcggaatctcatgagctcaagcaatctgcccacctcggcctcccaaagtactgggattacaggaataagccactgcacccagccccaaattcacaataatttttcaacaaggggctctgtgttttcattttgcactgggtcctgcaaattctgtagccggtcctgcctctactgctagctctttgcccatcagagtcacttcctcaaagggccttccctgtccctttctcacatttaaaaaatctaccccccaattaccttcagtatctttatcaatcactctgattagttgtctytgcaacatttaattatttcttgagattatgtctgtttttgtttgtttgtttgtttgtttgttttgacacagtttcactctgtcacccaggctggagtgctgtggtgtgatctcagctcactgcaaccccacaggctcaagaaatcctcccacatcagcctcctgagaagctgggactacaggcatgcatcaccatgtctggctacttttttttttttttttttttttttagtatttttagtagacactgggtttcaccatgttggctaggctggtcttgaactcctgagttcaagcaatccacccacctcggcctcccaaagtgctgggattacaggtgtgaacctccacaaccggctcctaaaagattacgtcttttatttttttatgatctacttggttattacctgtctccctacactggaagcaagttccgtgaagccagggccatagttatagtggtctctgtttttccccactgcctaggctggtgctggctcatggtaggctttgaatatctgctaaatacatgaatgaaatgagctgcaacaagcttgccaaagacagaattctgcattacgggggaatgtaaaacatgtgatgaatgagtgtgggaatggatgaacgaatggatgaatgaatggatgaatgaatgaatggattaattaattaattaacaggtgaataggcattttrtagttgttgctctttagcagcagtaaatttttgttttcataaaattctttctccttgtatcttgtgactttggagactagttctggggtgaaactccaattttaaatttttcttctgtctttgataggatcatgcaaactcagcctttctctcctttctcccagctggcaagggctggctgagaatatgaatccaacaacctcrttaagctctctcctcccatctcctcccctttgggttgatctcagggcagggattagaacttggcctttccttggacttggaaacagtccctgaggtttggaaatcccatgcaacacttagaaacagagctaatgagaacattacatgatgtggcaaaatcrctgcttacatgctctgaaatgagcacggttacaagaacctcctgttctgtgtgatcccattttgttggacaaacagcatgtggttagtagtgcatagtgggcctatgatgagacactcaggttcaaagctacctcttcctagcttgtaccccgacttagtatgaccctgtggggtgcgcatgtggactgaatggaatgggacaggttcaggattgctgagattgcagctggaatcctgaaacttaaagctatgaaattgaagttcataaattagtggtgaactcatttggcagcaaaacctgtcctgaattgatgtgaggttatgtatagtaattatttatcctattctgctgctgaaatattaatatgataatgtggaacagaaagttttaccttcctaaaaacaataatttccaagttccaaaacrtatcaggccctgggaatttcagataagggattatggactatatataacatgcttagaatagttcctggcatatagtaagcacaaaaaatgcttctgcttagtaaatgtgcctaataaatgtgtgtgtgtrtatgcgtatgtgtttgtatgtgtgtgtcttagagggactgtaaagagtgtctccaaatagtaaataatcattttatgtggtatgattatgagtgatttaaattttcttctgcattttctaactttctgctctaaatgtcattttataatgcattttracaatgtataataataaaacagtataaaaatattgggagaaagagtaaaccaatcatctcacttcctagataggaagctgaagcccagagacattccaggcctctcagcaaggtaatcagaggcccagagcaccatttgaacccagaccctcgttagatgtggatgtgaaatcagtcaacgaactgctagtattagtgtcactgcctaaccttcccccagcgggtaagaggcttggactccaggacgggcacctccgtcctcctcctaacttgttctttctattagtgggaagggttgggagattagggtagtttatggataacctttaagtcgtatgagcttgaggacatcatctaccttctcaggggccagactggacactctgaggttctttgtggctctaacagttggtggctttgttcctttatatgtggaggaatggacagcagggagggggctgggagatagagaaggagagtagctggaaaatggcagaaaagtttgttaatttacaggcaggctgaagcrggaggatcgtttgagcccaggagtttgaggctgcagtgagctatgattgtgccagtgtaccccagcctgagcaacagagcaagaccctatctctcttaaggaaattgttaatttagaaccattttctccctggtaaatgaccacagatagtctgggttctaggcaagagagaggacacactaagggatgaaatggtaggtggggaagtcaaggtttgtcccatccattcgttggcccaggagcagttattgcaacccctctgggtgccaggcagtcagttggcactacagatgcaaagatggtgagatacagcctctgtccttagggagaccagggcaaggggtctgagagcccacaggccagggcattccccatcatttttacagagagagctgtggaatagttaagagcacaacacrctggtggctgaggctggrggctggtgtgctggcttctccacctagccatcatgtgacttggggccaagttctgtgattttctgtgcctcagtttcctctgaaatgaagtcatcgtgttacctccctcacagggttgggatcaggcttcattgagttgctgtaagtacagcactcgaagcagcacccatggtgcgatcatggtcattagatccagtgcacggcataagagcccaggacccacaatcaggtctggattcagacctctcctgttacctgtctgagctgcaatttcctgctctgttgaggcaggataatactagtgcctactttaggagattgttgagatcgagtgggagcaagtgctgggggtggacggcccagaggtggttcagtagccattagttgggtgggcttcttccaaagttcttgcctgtgcgcatggttattcccaagccctggccgggcttacatcttaaaggtgtagcaacctgtgtccacggaggaggaagaggattgaaaaggcaggtgaagtgtcccgataaaaggataaagtccaaaacagcagatgggtgctgaagtgttccttcccgccaccatttacgaccatgttgggatcactgaggtaagaacagtttagcaaggcagaccttggatcccaggaaggcaaatgaggctctgtggggtctggacatacagagggggccctgcaggcaaaggtaggtgaaggaataccaggaaagggagctgacaccagggacctggcatcgcccccactttcccagatagcagactgggtgggcttgcagtgcagcctcccagctgcttgttcgtcatcccagcccacatctcttatcggctccaagcaaggaacaggtcaggaaactaaattgtctatgcatatttttatgcgcccctgagtgaaatgcyaaggatcttcctgtaatgtttaatttattcatttattgacttaggaaggggctgggagaaactctsktttcaagtctctttagctcctaaaatgtttactttttctttttctttttctttttttcttttcttttcttttttctttcttttttttttttttgagacggagtctcgctctgtagctcaggctggagtgcagtggcacaatttcagctcactgcaacctctaccgcccgggtcccggttcaagcaattctcctgcctcagcctcccgagtagctgggattacaggcatgcaccaccatgcccagctaatttttgtatttttaatagagacagggtttcaccatgttgtccaggctggtcttgaactcctgacctcrtgatctgccctccttggcctcccaaagtgctgggattacaggtgtgagccactgcgcccggcctcctaaaatgttttctaggagcttgggggaaagaggatccctgtctttgagttgttcttgtattaagttaatacaaggtacagagcaactaaccattcatacattcccctcccccttaagcatcattgccctattttagaaaaattattcacttctgctctatacttaatgtaacacagtcccccccaccccatatattgaaagagattatttcattttgcttttctgcaaaaatgaaggcaaattgtatgtggataattttatagttgaggaagtggagagacgggatttacttaaggtcatccgtgaggggaagkgtaagttcaagcccatggatggcacagtctttctaccacgctgctggccacatgcatgcrgattttcttgttgattttgtgtgtgtattgttcattgacctgggttttccctctgcaataccagtaagtaaaattgagcttctagtaagtctgagaggaagggcttaatgcatgagacagcaactaccrccatgcttgaactgtttcatcaaaaagcacaacaatggatgtttgtataaaggtggtgttgtgcttgkaggtggatattaggttggtgcaaaagtaatcgtggtttttgcaatcccttttaatggcagaaactgcaattagttttgcaccgactgaatattattcatttctttccgtcttctattccctaataatgcaattagagaaaaatgcaaggtcatgatcactgtgatgaaatgatgagcccacccatctaaatgaaatcccttatttgagaccctgggtcatagtgagatgtgtgaggctgtctttcaggctgtattagcagagaagtgagaatatctatacagtgtttaagtagtgttggggtttttgcaatagagaataaaaatctagagcaatacaagtatgctggcaagcagttctcttctgcatgatcctaactgactttggtagggttggggtattttgaaatatcttcatttcttgattttcattgctttccctattttgaggtggttacatttacactggggatatttgggggatgaatacttgttggttttggtttgaatctctaaaaatcaggatacagtgggttacttttttggaggaggtgaagrcaaggctgtgaacaccttcccagaaacttgaagaactgagaattttgtttatctgttttttttcttaaacctgttgttgaaatgttatttaatatatggtcagrgcatagctatccactgctgtcaggcatggctgcttaaacaggggcccagggtgtttatgttgtggccaagtacttggcacccccgggaagtgtggccctgcctgtgccttttctttcttyctttctttctttytttttttttttttttttttttgagaaagggtcttgctctattccccaggctggagtgtagcgagatcatggctcactgcagcctcagctacctgggctcaggtaatcttcccgcctcagcctcctgagtagctggaattacaggtatgcaccaccacgctggctaattttcatatttttagtagagatggggtttcactatgttggtcaggttggtcttgaactgctggcctcaagtgatctgcctgcctcggcctcccaaagtgctgggattacaggtgtgagccactgcacgtggccttcctgtgaagtgaatttttaattgtattttaaaatttgttttcatgtttttgtttgttttgagacagagtcttgcaatgttgcccaggctggaatgcagtggcctgatctcggctcacttaaacctctgcctcgtgggttcaagtgattctcctgcctcagcctctggagtagctgggacttcaggccaccccgccaccacacccagctaatttttgtagttttagtagagacgaaatttcaccatgttggccaggctggtcttgaactcctgacctcaagtgatctgcccacctcggccccccaaagtgctgggattacaggcatgagccaccatgcctggcctgttttcatgattctgatacattatatttttacacatttataggatacatgtaaaattttgttacatgcatagaatgcataatgattgtagggaccaagggaatatcttctgctttgccctctgaagtttcgytgaaaaattaacttgtaaaaaggcagattagttggagaaaagacacacaaatttaattaatgtgtacactgggagaaccgcagagtgattacccagaagggaatttactggccagcatttacattatttttggttggtttgtkggctatgaaagtaggctacctttattattactgcgatgacttctaggtagtgttttggttctttgcatttattacattacttgaagaagcattcattcatttatttttgattttttgagatggagtctcactctgtcactcaggctggaatgcagtaccgccatctgggctcacttcaacctccgcctctcgggttttagtgattctctctcctcagtctctcgagtagctgggactacaggtgtgcaccaccatgcccggctaatttttgtattattagtagagacagggtgtcaccatgttggccaggcyggcctcaaactcctgacctcaagcgcctgcctcagcctcccaaagtgctggtattacaggcatgagctaccaggcccggcctcattcgtttattctaactggaatcggtttgtctgagttcaagaccctgggctctggcacttcagataacatgcatctctgggccccagtttccttatctgtattatagggataaaaacaataagattgccacgaggattaagtgacacagaggaacaaaggagcacttagtaaatgttagtcttaccagaagtttatttcggatcaccgggctgctggggtcctccctgtcctggaggcactcgcttcagtagcggacccaggtggtgcaaagtgcgtgctagaagcacactgggtgattgcgcagccacctgtcccagggagtggaggtgaaaagatgagagaaaccaggactttgggaaataaaagtcgacttgacaacagggacttttaacgggcacagtggcgacctctgactcacattttaaatttcccatattttccaccgcttccctatcgtgtgtgtattcaagcatatcaattgctgccaatatgtaggggtgtcccatattggggagcaaagcagaagagaggctttaaaaatatatatctccgcagctcatttcggctgccgaagctcagcggcgggtcggaggtaggccggcccgggggcggggctccgtccggaaggcggggccctcctggggcggggtcggtgtgggggcggggcctgggtggggcctaggcgggcgcgatggcccgggactctggcgcgcagggygcatttcgggatggagcaagcgcagcgcgaagttgggcgcccgccggctgcagcagaaccccgcccgcggcgctstaggactgcatctcggcctccgggtcgcgacctggctgtcctgctgggtcccgggcctcgggtcggcttcaggcggttaaggggtgcatgctctgcacccctgcgggagcccggtgggattggcctgcggggtggtcaacatgagtcctgccaagtgcaagatctgtttccctgatcgcgaagtaaagtaagtaagcctgcaattgtaatgaccatgatcttttacaaacttacgcagtcttccttccccttgaagtcaagctgtgtgtcctcttagcaccgccccctttaccsccacccccatccaaagaaacacgggcttgagttggctgctggggagatgatgcccgccttggaaactctagctggccttggcgggaggggaggaaggaggctggacgttgggggtgacgttgcttggaggaggtcgcttcggagcacacaggtgcctaaagatcagcccttgcgcaggggcacgccttccccgctttctctccttcgcctccagaagctgatggttgtggaaggcaggtctcttttgaagctgaagcctgggcaaatcgacgtgaacttgagcaggctctcattgagggtcattttctgagcagatgagcgtaggcatctcagtgcctgagtgctttgtagctctacctacttggttttgtttctttccttttttgtcctcattttattgcacttaaaaagaattaccaaattgatggtgtgtctgttgttgacaattcagaaaattatagataagcaaaaaagaggaacaaaaatcacccataattccacccctgtgatgtttgttaacagttgtatattcttcagcttttttttttttccggtgcagatatgttttaatttataaacttgaatcatgcagaacgttctgtaactcactttttcattcaacattaagtatttttctaccactgggcttggcaaactatgacccactgcctgttttgggatggcctgcaagcagagaatggttttttcatgtttaagtgattgaaaaaaaaatcaaaagaagattgttttgtgacacgtgaaaattacatgaaattcaaatttcagtgtctacgaaaaaagttttattggactgcagcctgctcatcgatttatgatttatgcctagttcatggctgcttttgtgcctcactggaggatttgagtggtgggacagagactgaccagatctaaagtacttactgcctgacccttgacagacaatgtttgccaatccctgcctacaacatgcttttactggattcatagtgttcctttaaatgggtgcaccttaaaatgtatgaataatcctcgccaggcagggtggtgcaagcctgtagtcccaaatactcaggaggctgaggagggaggatgcttttgcccaggagttggaggctgcagtgtgctatgatcgttcctgtgaacagccactgcactctagcctgggcaacatagcaagaccccatctctgaaaaaaaatgtgcccaggtgtggtggctcatgcctgtaatcctagcgctttgggaggccaaggcaggagaactgcttgaactcgggagttcgagaccagcttgggcaacatagtgagacccccatctctacttaaaaaaaaattagctgaggatggtgatgcatgcctggagtttcagctactggaaagactaagggaagaggattgcttgagcctgggagatcgaggctgtagtgagcaatggttgtgctattgcactccagcctgggcaacagagcaagaccctgtctcttaaaaaaaaagtataagtaatcccctataagtagcggatattcaggctgtttctctctgtttttttttttttttkkggggggggctattatcaacagcacagtgaggartacccctgtagctgaatctctgcctccatcctttattttcttaggatatgtttacctggtccataaacattcatgcacacctcccatgcataaggcctgcaactggtagcaggaagggtcgcaaaaatggttggaaaccgtgacctccgccctccaggaacttcggttccattgtggaaggcagatgtcttctcagtaactccaattcgaggctgatgggtgcaacagtaatagccactaccactcatggggtgctttcagtatgccaggccaagtgctttgtaggtgtggtctcatgccatcttcaaaataccactgtgggggcactaagtggagrstgttgtacccatttcacaaaccactttaatggaaaaaaaraaaaacctcacacaaatttggaattgtcccagcaagtccaggacgtggggtccccctatttataataatatggacatactttgttgggggactacattgttcctctcttagcttagagtggctaaaaagatggatttggacgatctaactttgccaccaagctgtgtgatcttctggagcaggtaccatcaagccttggaacctcagtttccacatctgtccaagggactagccctcataggcctttctagagttgttattattattattattattattattattattattacagacagggtcttgctctgttgcccagacagtggcatgatcatggctcattacagcctcagcctccgggctcaagcagtcctctcacctcagccttccaagtagtgggaccacaggcatgcgccaccacacccagctaatttttgtattttttagagagacagggtttcaccatgtttcccaggctggtcttgaactcttgagctaagcaatcctcacaactcagcttcccaaagtgctgggattacaggcatgagccaccatgcccggctctttcttggtycgttgagaytctgtgtggaagtcgctggtcttgagtactgccctgggtcagcacaaacattgatgaaaactaataagtaaagacagagttcggttatgaaagagccctctggagttgggaggcatttgggatcttgtgctgaaggctcgggccatctaagaagccagaactcctgagaaggtgaggtcgsaaatgatgactgatttttcatggcatgagaacggggtcacagttcagagagtagagaaatgattgtggatcagagtgcagaagggcttgaaataaagttggggatgaggaggcagaagttgttttttaatgagtcccatttcactgccatgcaattctgctctgaaaggccagctgcctgcatgcaaatattggctgtagacctatcaggggttttcactcttggctacacattagaatttcctggtggggagatttttgaaaaatctggatgcyggggaccccacctctaccccctagacatgctgatgggaccccgacatcagaatcttataaagtttttcatgtcagggttgaaaactcgtgcctagcttggggtcagcagactgctattataaacggccagacagtaaatatttttggctttgtggccatgtggtctctgttrtaactactcaactctgctgtttcctgcaccagaagccatagttatgtaattgaacaggcctggctgtgtttcaatcagacattatttatagatggggaaattcaaagttcatataatttttatgtgtcacaaaacaggattcttttgattttttttttttttcgatgacttaaaaatgttggctgggcatggtggcttatgtctatagtcccagcactttagaagaccaagacaggagggttgcttgaggagtttgagaccagtctgggcaacatgatgaaaccccgtctctacaaaaataaaccaattagttgggcatggtggtgcacacctgcagtcccagctactcaggaggctgaggtgggaggatcacttgagcccaggagtttgaggctgcagtgaactatttttgcaccactgcactgtagtcctggcaacagagggagaccctgtctctataaaaaacaaataaggctgggtgyggtggctcacacttgtggtcccagcactttgggaggccaaggtgggcagatcgccctgaggtcaggagttcaagaccagcctggccaacatggtaaaaccctgtctctaataaaaatacaaaaattagcagagcgtggtagcacacatctgtagtcccagctactcgggaggctgaggcaggagaatcacttgaacctgagaggtggargtagcagtgagctgagatcacaccgctgcactccagcctgggcgacagagcaagactccctttcgaaacaaacaaacgaaacaaaacaaaaaacaatctaaaaagttaaaaccgctcttagcctgtgggagatacaaaaacaggtggccgagtggatttgacccatgggtcctagtttgcccactcacccctggcctagccaaggtagtcatcccagggggtactgatggggcaggtggcttgagaaatttccaagggtccatttctggagagcgtggttttgtgctgtttgaacgatatcaacctttactgggctacacagtgttctttcttgctttcttgtttggaagtagttgtaattacagaattgcctggctcagaatcagctcttagcagtgcgggtagccgttaccatctctattttatagaagaaaagagagggaagraattgaaggtctgattaatgccggggccctagcctaatggcccagcctgggctcctgtaatgctatcctgcagacgtacatggtagctaaagtgttgcaagctgtttactttggctaggtccagggataaactgttaattccatcatgtgaggaaactgaggcagggagtattgaagtaactttcccaggattacacaggttataagcggtagattctggcttcaaagcctaggaggatggccgcagtctaccagagtttctaaactgcggctctgttgacacttggggctgtccagttctttgtggggctgtcctgtgcattgcagggtgttgagcagcatccctgrtctccacccactagatgccagtagcgcatcccccaagttgtgacaatcaaagatgtctccaggtattgctccccggggagcaaaatttcccccagttaagcactcagggctgggcgcggtggctcacccctgtaatcccagcactttgggaggccaaggtgggcagatcacctgaggtcaggagttcgagaccagcctggccaacatagtgaaaccccatttctactaaaaatacaaaaattagccaggcatggtggcaggcacctatagtcccagctactcgggaggctgagacaggagaatcgcttgaatctgggaggcagaggttgcagtgagccgagatggtgccacttcactccagcctgggtgacagagctagactctgtctcaaaaaaaaaaaaaaaaccaaccaamcaaacaaaaamcctcagcattatacatgtttgtctcttatttgagaggaatataagaggccatatgtgtaatgcatgttttaaaagtccagttaatagaggggcttccatttatctcagattgtctttctgcctagaagttagattctgaggtcagctagagttggatttgaaacggggctctgccacttgccagctgtgaaactggaggtaaatggtcctctctgaacctcggtttcctcatcgtgaacctggagatgacagactcctccatacagggctgtggagattcactgagaggccccctgtgcccagtccatagtgggcagccgagaatgtttatttcctccattcctgatactattctgcctggtcttgtgctccggcagctgactgcatttggtgtttggctgacacctctgctgttgattgtacctgaagtcatttccaaagtcaccttgaaacatttcagctctcacccttgccgtgctgtataaggacagggcttctcactggacaatggcacttaggatgatcctccttcagtggaagcaaatgctggccgaaggtcagctctctagagccaatgttggttggcttccagctttatcaaaaagaattaaaatagccmcttgccyggagattgggcctgaaacaaggccagtccggcagctttgtgtgttcgcttgcctagcctgcggtaatgggcttgtggcctgcctgatggaggggctctgtcaccagtttcgaaatcaacatggtggccaagaatggtttttttgccccctaggccacaaatgaagtttttctttgttgtgctttaggtcaaattgctagagttttaatgtttgtgtgtgtagaaatgggatgtctcagactttctgaagctgaaccatcaagccagccagtcagggaaggtcgtggacagaatgaggggtgcggctgtgtgtgggaatgtcgattagtacaayctctgtggaaaacagtttggagagttctcaaggaactaaaatagatctgccagtctctccagcaatcccactactgggtatgtacacaaaggaaaagaaatcactcagtcagattcgcttttcattgggaggatcttaacatgattggttgaaaacaataaataaaattagcaaggagtccagttgtggggtctcacgcctgtaatcccagcactttgggaggctgaggcaggcagatcacttgaggtcaggagttcaagaccactctggccaacgtgtaaaaccccgtctctactaaaaatacaaaatttagccggacatggtggcgggcacctgtaaccctagttgctcgggaggctgagggaggaaaattgcttgaacctgggaggtggaggttgcagagagccgagattatgccactgctctccagcctgggcgacagagtgagackcagtctcagaaaaataaaataaaataaaataaagaaataattatatcaaaagacacctgtacttgtatagttatcacagcactattcacagtagcaaagatatggaatcaacctaagtgtccaccaacagatgactagatacagaaaatttggtgtatatatatatataattttttatggctcagtagtattcttttktgtgtrtgtgtgtgtgtggtgtgtgtgtgtgtgtatacctacatgtatacatgggtgttcctcttacaaaattaatagcttttttcttattgaaaataacacatcattgcagaacattttttaaaayatagcaaagagataacggctcttaatactttagcatttttttcccccagatcaggggtctgtctacaaatgatgtcccttgggttgcatctacctttttttgtaaataaatgaagttctctttttttttttttttaggtagagtttcactctgttgcccaggctggagtgcagtggtgtgatctcagctcactgcaacctcygcctcccgggttcaagtgatttttgtgcctcagcctccccagtagctgagactacaggcgtgcgccaccatgcccagctactttttgtgtttttttagttgggatggggtttcatcatgttggccaggctggtctcaaactcttgccctcaagttatctgcccatcttcgcctcccaaagtgctgggattacaggcgtgagccaccgtgcccagcgtagcattaaccttttagaagctagaaagcagatgaatgagtggtcactggcttaaggctgagtcctaatggagcagtgaggaaagttggggacccctggccatctgtaccacagaacccccaaaaggcatrgtgtctggcagcaagggatgcccctggagctgaggggtaaggagggtaccaaaatgagaaggacagggtggaagactcccaggtcccctcccctgtctcctgcggcaggggctgtccacttcgaccccaacagaaggcagcagttcaaaggtacatatagagggtcttgggagaggggatcgacaggcacagttgagggcatggggcctgtatcccaaataggaagataagggtctgaataggtgctgaattcttagaacttccccgttccccccggggctccaggctgacctttactgtccaggcagaagactggaaaacttctccctggggaatctggccagcgagagagaaagacacraagatactgactcaggggatccccaacgcactcctacctcaccctacattgagctcagggtcaaccaggtccaccacagtctcagaaattctgttctcactcatagtcacaaggttggaaccaaggcttccctgacatttgggttcagtttctttttctttttcttttttgagatggagttttgctcttgttgcccaggctggagtgtaatggcacaatctcagctcactgcaacctccgcctctcaggttcaagcgattctcctgcctcagcctcccatgtaggggggattacaggtgcacgccaccaagcccggctaattttttgtatttttagtagagatggggtttcaccatgttgtccatgctgctctcaaactcctgaactcaggtgattcacctgcctcggcctcccatagtgctgrgattacaggcgtgagccactgcacccggccctgaggtccagtttctcatrtgtaagtcaaggtccaaaccagtagacacaggaagcttggaagaaacagaaaccacgctggagaagagaagtttaaaaagctctcattaatatcatcgttgaggtcagacaggatgttgcactcataggaagaggatgctataacaaagggaacatttgtaggccaaaaacaggctcgtagacatcaaaaacatgatagcagaaatgaagaactccactgaatgtttagaagatgaggctgagaaaaatcaaccagcaagtagaagaagagagagaataggagaggggaaaaatgcataaaccagtaggccagtgtaggaatttcaacatccagataataggacttcrggaaaaaatagagaaaaaaagaggcaaggacatcatcaaggargtatttgtttcttgttgttgttgttgttgtttgagatggagtctcactctattgcccaggctggagcgcagtggcacaatcttggctcactacaacatccgcctcctgggttcaagtgattctcctgcttcagcctctcaagtagctgggattacagaygcacaccaccatgcccggctaatttttgtatttttagtagagacggggtttcaccatgttggccaagctggtctctaactcctgaccttaagtgatcttcccacttcagcttccaaaagtgctgggatcacaggcgtaagccaccatgttcagcccatcarggaagtatttgaagacaaattcccaggatggaagtttccagattgagagggcctgagagatgtgcagcctcattggtggaagcagacacatacttgagcycatcactgtgaaatcatagagttctggggacagagggacgctcctataagcatctggatatgaaaaaacaggtcacctacaaaggatcaaggatcagaattactcttgttctagcagccttggaagccacaacacaatggcacaaggcttctaaaacttgaagaaggttttccttcctgaaatttctttttgtttgagatagagtctcactctgtcgcccaggctggagtccagtggcgcgatctcggcttactgcaacctccattctctgggttcaagcaattctcctgcctcagtctcccaagtagctgggattacaggtgcacaactctgtgtctggataacttctgtatttttagtagagatggggttcaccatattggccgggctggtctcaaactcctgacctcaagtgatctacccacctcagcctcccaaagtgctaggattacaggcatgagccaccatgcctggcccttcctagcatttcacacacagccaagtggtaaggttgaatgtgagggcaggagaaaggctgaagtgcaatggtgcaatcctagctcactgcagccttgacttcctgggctcaagtgatccttctaccttagcctcctgagtagctaggactacaggcaggtgccaccatgcctagctaatttaaatttttttttttttttttttgagatggagtctgaccctgttgcccagtctggagtgcagtggtgcaatctcggctcactgcaacctccacctcctgggttcaagcaattctccctcctcggctttccaaggtgctgggattacaggtgtgagccaccacgcctggccctgaatagcctttcttagaaagctacttgaggatgycttccactgaaamcagagggtaaaccaaggaagagcaacacacaggagacaggaaacaggagattcaacatagactgaaagggagtctccagggtgatggtgataaggaagcccagtcaggaatagggcagggaaattgagggcatcattgtcatgcgccttgccattctaccatcttcttaagtggatgaaactactggaggatatgccccagcaaaacaagggagtctaccaagaaagacgagccacccattcccccaaattaggaatccaaccccaaggaaaggcaaagggaattctagggatgtcagcaaagggaagccccaaaacaatggtgatgtaggggcctagaggacagccagtacctacggaaggagaacagaggccttcaggagagatgtcaccagtggaaaaaaacagaactgatmaattatttattattattatttttaatgagatggggtcttgctacattgcccaggctggtctcgaactcctggtctcaagcagtcctcctgccttggcctcccgaagtgctgggattacaggtatgagccactgcatgtggcctgatcaattatcttatgtgtactgggaatctattaggaggagtggggtgatttagcaacaggtacaaggaacactaagtaaaggaaaaaaatcattaactccaggaaaaggcaaaaagaaaggaactaaaatctggtacactgcagctctcatatgtgaataatgatcacaaacttcatatgtgaataatgatcacaaacwagtaaaacattgaatacccagtttgctaaattacagtagacttctatggtattgaccagctggtggaggggagccgatggggtggccttgtgagataactaaattcacatctctcaggatgggaaggccatagatgctgtctcacatggatgactcacaagattgcatacacttgttgtttaggactatggagatgtgtaattgctagaaaaaatcagcatcagtttcctctggtgtggagggacagagcaggwaacctgttttgttgttaaacatttaaaaaattgttttcagttttctaaagaaattttgtgggctgggcgtggtggctcatgcctgtattttggaaggccgaggtgggaggatcacttgaagccaggagttcaagaccagcctgggcaacaaagtgagacccctgtctctacaaaaaagaaaayttaaaaacttctgaaatacaaatgtagaaaagtacatgaaagatattaataccatgtaacaagtcggaacgattagaatgtgtggacttcttccctgatcataaaactctcacccttgttatargttttttagtattattcaggttcctaaacaatgggcatgtaawgtaaaaattaacttaggattaaaaatctaaacatccmccttgggacaggtagaagaaactgctccttctagttcatgtgctggtaccttagctggcctcttaaggtgctttcagttgggtacagtggttcacgcctrtaatcccaatgctttgaaaggctttgacgtcacttgacatcaagagtttggacgagcctgggcaacatagtgagaccccatctctacaaaaatgtttaaaagtcggctgggcttggtagtgccctctgtggtcccagctacccaaggaggtcgaggctgcagcgagccacgattgcaccactgcrtactagcctaggtgacagaatgagatcccgtctcaaaaaaaaaaaaaaaaaaaaaaaaaaaaccgarggtgcttcctgmccttgagcctccttgtaaattgcttcaggggctctggagagcaagtgcaaagcaggggggctctggtgcagtttggctcctctgctccactggctttacaggtgccgagctctgagtcccaggcttcttccctcatgcacgtctgtccctcattcttattctgcaggccgagcatgtcgggactccacctggtgaagaggggacgggaacacaagaagctggacctgcacagagactttaccgtggcttctcccgctgagtttgtcacacgctttgggggggatcgggtcatcgagaaggtacagatgggtctcggcactctgggtggggtccgattggggtgcaggggcccctcctctcagctggaggtgggagattcgggttcaggctcattctgcctgctgcagagagggggtgagggccacgctcctctgagttttaatagtttaaccctcaaatagaaataatagtgaagcctctttcaaagggctattgtgaggatgaaatgaaataagacaggtaaaacacattgtactgtaaaacactcaaaaagtgttaagggtgatcacaatgacaccaaaggaataaaaaaaaaatcattcactgggctcggcacagtggctcatgcctgtaatcccagcactttgggaggrtgaggtgggcagatcatttgggcccagcctgggtttgtgttcaagttcaagaccagcatggacracatgacaaaatcctgtctctgcaaaaaaattaaaaaattascaggatgtggtggtgtacacctgtagtcccagctactcgggaggctgaggtgggaggatcacttgaagctggaaggtcgaagctgcagtgagctgtgattgcaccactgtactccagcctgggtgacagagcaagactctgtctcaaaaaaaaaaatatatrtatgtgtryatatatatatatatatatatatatatatatatttcagacaaacagccatccatccatccatccatttgatgatccattcatgtggatggcagactttgagctcctgctctgtgctggggtgtgtgccatggaaatacatagaaataccaagaggaatgatgtgctgcgggggctgcaggaggctctgcagctgtgaggtggactcggggtagcacgtggcccccagcgcaggtagatgtgcatctacagctccttccttgtcttcccatgcaggtgcttattgccaacaacgggattgccgcygtgaagtgcatgcgctccatccgcaggtgggcctatgagatgttccgcaacgagcgggccatccggtttgttgtgatggtgacccccgaggaccttaaggccaacgcaggtacctgggccttgaccctctcctcccatcacgctccatccttgcctgccctcgcctcyttcccctgtgcctaggcaagtccatcctggactcccgatggtcaggacctctcatgagtctgtatttatttgtccttccttctttatttaattaaaaygtctgctgacatcaagaacaactcatgtgccttacaaaaatgcagatggttaacatgcagagaggaaattcgatctttgagaaatgtctgtgttctagcagattgggggctgtttctcctgcaggtgtatgtaattgtatttcaatcatttgttcattcttccgttcatttgcctaagtttattataatgaatcattctataaacaactgttggatgatttacttttttcctgaacagtcttatccttttataggccctactccccacagcagccaaagtgaccttttaaaagcataacttcttctgctgtattttctgaaggttgttaaaaacaaaaacctcagccagagcgctggctcacccctgtaatcccagcactttgggaggctaaggtgggaggattgcttgagcccttgagtttgagagcagcctgggtaacataataagaccctgtctctacaaaaawtaaaaataaaaaaattaactgggtatagtggcacgcacctgtagtctcagctactcaggaagctgaggtgggaggatcgcttcagcccagggggtctaggctgcagtgagctgtgattacaccgctgcattccagcctgggaaacagactgmgactctgtctcarataaaacaacataaacctaaaagcrtaactcaggtccgagcacagtggctcacgcctgtaatcccagcactttgggaggccaagatgggsgaatcacttgaggccaggagttttgagatcagcctgcccaatgtggtggaaccccatctctactaaaaatacctcccaaaaatttgccgggcatggtggcaggtgcctgtagtcccagctcttcaggaggctgaggcaggagaattgcttgaatccaggaggcggaggttgcagtaggctgagatcactccactgcactgcggcctgggcgacagagtgagactgtctcaaaaaaaaaaaaaaaaaaaagcaaaacaaaaaccaacataagtcaggtcttcaggtctttttgtgcttctccttaaaatgcatcagaggctgtgtgctgttcccartattagcaacctcagcaccatcccctaagccttcctgccccaagctcttcacagacatggcctcatttgttacttacagctctgttttacagatggcacagtcgaggcacagggatgtgaatttatcacttgtccagggtcacacaaccatcatgtgatgcgggtgggatgggaaccctggtctgggttcagagcatcayccagtgggtcctcccatcttggttagtctaaaattcaaaattgtcacccaggcctattaagtcccctcctggctccatctygaacctcttgccctccatcagccgggtaccagtcaccctgacctctggtagctcctgggcctgttgcagagtcttggcacctgctggaacctctattgaaggtgcttctcccagagccctttgtgcagtggactccctccccacccagcctgtaggtctcaacatgatcatcgcatytctctcagagaacctcatttattttcttcccagcactgacckgagtctgtagttattgtgtttattttcttgtttatcttctccaacataaaagaaaaactggacaaggaccaggaagcctgtctggccgctcacttcatcatctctggaatctccccgttggccgacacttctgtgtttgataaacataggaggcaggcaggccggaaggarcagctgctctgggatttctttctgtgtttgcatataaagtgccacattgttcaatttcaggatcttagcaattctatagtacagatgtcccaacccctgtgtttggattgagtctaacttttcctagtccaaaacactgctcagtggctgttctctgactttggcctcattgatgtgtgggtttttgtttgtttgtttgttgttgctttttttctgagatggagtcttgctctacctcccgggttcaagcaattcttgtgcctcagcctcccaagtagctgggacttcaggcatgtaccaccacgactggctaatttttgtatttttagtggagatggagtttcaccatgttggccaggctagtcttgaactcctgacttcaggtgatctgcccgcctcagcctcccaaagtgctgggattacaggtgtcagccaccgcgcccagccagcgtgtgtttttttaaggacatattcctagacatggaacttctggcttaaagagcatgagtattttaaaatcaaaacattgcgttatgttcagccttaaaaaggaaggaaatcccgtcatatgttacaacacagatgaaccttgaggacgttatgctggtcacaaaaagtgaaataagccagtcacaaaaagacaaatactgcatgattccatgtagaaggggtaactagagtagtgcaattcatagagagagagaagatcgttggttgccaaggacatgagggagggagagaaagggagttgttcatgagtatagagcttcagattcataaaatgaaaaagttstggacatctgtttcacaatataaatatacttcactattgaactgtacactcaaaaatggttaagatggtaaattttgtgtgtkttttttttttaccataatttaaaactctgkattgtatttttgtttgtttstttgttttttgagacagggccttgctctgtcacccaggctggagcgcagtgacatgatcacgactcattgtagcctcgaccttctaggctcaagtgatcctcctgccttggcctcccaagtagctgggactataggcatgcaccaccattcctggctactttttttggatttttttttttttttttttttgkggagacaaagtctctgtgtgttgcccaaactggtcttgaattcttggcctcaagtgatcctcctgcctctgcctcccaaagtgctgggatgtcaggcgtgcaccaccgtgcccagccctattatattatttaatggtaaaacaatattaagataaactttaaataggactttttttaaaaacccacctctaatcccagtctgttgacagattacttccttcttccttcgttcctttccaggccttccaggccttgtccagaaacatatctgtatcacataattaaaatcatatttcattttctttacattttctttcttttttttttttattagacagagtctcgttctgtcacccaggctggagtgcagtggtgtgatctcagctcactgctacctccgcctcctgggttcaagcgattctcctacctcagcctcctgagtaccttggattacaggtgcccaccaccacgcctggctaatttttgtatttttagtagagacagaatttcaccatgttgcccaggccggtttcgaactcctggcctcaggccatctgcctgcctyggcctcccaaagtgctgggattacaggcgtgagccaccacgcctggccttctctttacattttcatacatgtttgtccattgttaccatagaaatctgcatggttctgctttccatggctgyacatagtcacatcttgtaatgttctgccattgatgtcagtctgtcagcagttccttccttctccctcccatttaatttcagagtacatcaagatggcggatcattacgtccccgtcccaggagggcccaataacaacaactatgccaacgtggagctgattgtggacattgccaagagaatccccgtgcaggtagatggactggggtgcccaagtgtggcccctgagtgtgggatgatgcccctaggttctagttcaattccacagttcacaaggggtggagggtccagatcccacaaggctccaaattcctgggctgatgtaacacagaaaagagtgttcaagtgaggcgaagcacattctgtttttwaaaaaaaattttatagacaggatctcgccatgttggccaggctggtctcgaactcctgggctcaagtgatcctyctgccttggcctcccaaactgctggggttataggygtgagttactgcacctggctgggaggcatattcttgaaggaagattgttgctcacccctttctgtgtttgcaggcggtgtgggctggctggggccatgcttcagaaaaccctaaacttccggagctgctgtgcaagaatggagttgctttcttaggtagagtgtgtccccatcagatacatgggaattggggtattgctgggacactctgctgggtctgaccctctttctcctcctgtcctgtaaagcggaggtccgtttgatttcccacctcacacttctgtcgtgaggagtgagtgagtcccagggtggaagggcacatagctaatctgccaactcatggaattaggagctgcccgcttttcaaaggaagacacacaggcagccaacaagcatatgaaaaaaagctcaacatcactgatcattagagaaaggcaagtcaaaaccagagtgagataccatttcttgacagattctgagattgtggagaaaagggaacgcttatgcactgttggtgggagtgtaaactagttcacccattgtggaaaacagtgaggcaattcctcaaagagccaaaaatagaactaccgtttaacccagcaatcctgttactgggtatatacccagaggaatttaaaatcattcgaccataaagacgcatgaacacgaatgtttattgcagcactattcacagtagcaaaggcatggagtcawcytaaatgcccatcaataacagattggataaagaaaatgtggtacatatacaccatggaatactatgcagccatcaaaaatactgagattatgtcttttgtgggaacatggatggagctggaggccgttatccttagcaaactaacacaggaacagaaaaccaaatattaaatgttctcacttataagtgggagctaaatgatgagaacatatggacacaaagagggaacagcagacactacttgagggtgaaaggcgagaggagggagaaaagcagaaaaaataactattggatactaggcttggtacctgggtgatgaaataatctgtaccacaaacccctgtgacataagtttacctatataacaaatttgcacatgtaattatgtccatgtccttgtgtagtttaggggaatcatttactatcatgtaataaatccctgcttctccttaccggtgggtctgaaaacagtcttgcccaaatgtgaagcaactcagtgcggatcaatacatgatattcacctgaggtacagccgggagtcccatgcccattgacgttttctttgtctgtggactctgagtacatgtgggcatctgtcctgtctgacagttacccaggactctcattatcagtcttaattcctctggaggttgatgatccagcccactggacaaactacagctcataggccaaatccagcctatggcttgcctttgtaaataaagttttattaaaacatggtcgtgcttattcgtttatgtattgcctatggctgctttcacccaacactggcaaagttgagtcattgtgacagagacctgcaggctcgcacaactgaaagtatttcccatctggctctttatagaaagagtttgctaacctatggtccagctctttgagctcctagcttacctctttgatctagctttctgccttccctccaaagtgaattttgtatatgccactgtagcctaggttgtaactcacaacaggtttacartccacatacgttgaaagttgactgatgcaatagcagactaacagattatttttcttccctgacatgaggttaagctccttgagagctgggaccagagaattttctctgtcatctgctccttacctggccccaccaccgtgcactcggtcggccttcagcctcgagggtcttgtgactgacyggattctgcttcccttcttgtcccsgattcctcaggccctcccagtgaggccatgtgggccttaggagataagatcgcctccaccgttgtcgcccagacgctacaggtcccaaccctgccctggagtggaagcggtaagggaccccgagcttccctctgggggagcttctcagcccagtcttgataatgtgaacggtcagggtgacagaagtatgcttgtaacaattctttccattacaaatgttacttacttttattttttagtcattagcaaaatattttaaaattttaaattagtaaacaagtggtataatttattgtaggcaatttagaaaatacaagaagtacaaaaaagaaatggaaatcattcataatcctatgacccagtgttgaacatttattacattgtaggtatctacctttccaacctttttctggscatattytttgggaaaaaaaaaaaaaaaagacagatcttggccagtggctcatgtctgtaacccaaccccccaacccagtgctttcagaggctgagggaggaggatcacttgaagccaggagttcaagaccagcctgggcaacatagcaagaccccatctccagaaaaagtaaaaaaaaaaaaaattaactggttatggtggtgcatacctgtagtcccarctactgaggaggytgaggcaggagggtggcttgagcctaggaggtcgaggttacagtgaactatggtggcaccactgcactccagcctgggtgatgagaycctgtctttaaaaggaaacaacaacccatcttacatttcctagtttgtgactttttttttcctcactaatgaatatctttctatgtaaaaaatacactttacaccatttaagatgcctgcataggattatatcttatggatgtatcataatttacttaacagtcctcatggttaaacaatttaggttgtttccaatttattttttctaatttaaaaaatattcaaaggaatggagctttgataatcttacagctaaatttatgtgtgcattttaataattttcttaggataaattcctaacagtggagtttctaggacaaattaaaaaataaataggaccgtctcaaaagtttcctattaaatttgtttttttttccccccccaaaagttgaattttaaatttgggatggaaaatttgctttcatttgttaaatctttgcatggtgttgggaaataattattcacatataaatgactccataaggtagaattgggatttttttttggatttagattaatatggttgttgttggtcgactcagtctgagtttctttccttttttgttgttttgttttcgagacagggtctcactctgtcacccaggccaaactgtagtggcatgatcatagctcacagcagtcttgacctcctgagctcaagtgatcctcctgtatcagcctcccgagtagctgggactacaggcccatgccaccatgcctggctaattataaaattttttttgtaaagacaaggtctcactatgttgccagggttggtcttaaagtcctgggttcaagcgattccccccacctcagcctcccaaagtgctgggattataagcatgagccaccacgcctggcagttagtttcttaagcttgatttctcattcaaggttgggttagttcttgaggaaatgaaaagccattgtgagaagctgaagggagtgtctgtattccgctggtccagaagcccaggtctagcactatgtcagcagggagaggcgctgtggtttctgggttgtgtgtgtttctcctggatttgggaggaatcaggtttctttgtgactctccaggcctgacagtggagtggacagaagatgatctgcagcagggaaaaagaatcagtgtcccagaagatgtttatgacaagggttgcgtgaaagacgtaratgagggcttggaggtaaatgcagagcctgtgggggccaggggagccagaaccgaactgcctctgtcctggtagcagttggcaactggctaacctctaaagaggtctgtttgtcctttgcacccaggcagcagaaagaattggttttccattgatgatcaaagcttctgaaggtggcggagggaagggaatccggaaggctgagagtgcggaggacttcccgatccttttcagacaagtgagcagttcttgctgtgtcttttcgcatctgtctttgggaattgtttgtgggctgccagattatttctcttagcattattctgtgacagtcaagaagacatttgtaggagctggatgtatcgttgtatcgtattttgcaacaaacgcgtacatttttactcagaaaagcccatggttttgtgtcgatcttgacagaatcttttaggtagttcaagtctataaatcagtgtatctagaaatgatttcagagatacaggatcaaaatagctgtttgtgactatattggcctatagaggaatgggatattttataaatattagtactcttgttatttctaatgtttctagatggtctattttattttatttttgagacagagttcactctgtcacccaggctggagtgcagtggcacaatctcagctcactgcaacctctgccttccaggttcaaacaattctagtgcctcagcctcctgagtagctgggattayaggcgtgtgccaccacacgcrgctcatttttgtctttttagtagagacagagtttcaccatgttggctgggctggtctcaaactcttggccttgagtgatccacccgccctggcctcccaaagtgctgggattacaggtgtgatcygctgcrccctgcctgatcaattttaactgtaggaacgaattgcacatttacttactggtagctagttttcctcttttaaaaccttatgtccgttatcagcaatgtttagaaaacatttatactgacaatcttcccattcttaaagctattttaatatttctagcttttcttctagaccttcttcatatgtatattttaaagagctgtattcagtctacacgaaattttgctctgcatttaacacattccaaattgtagatcatgaatattattatgttattcctgccttggcaattattttgatgattactcaatattttatgtgtggcaatagccttatttatgaaacctttccttttttgttaaatgtttagcttatttctactttgttattatgaataataataccacagtataatgtgatatttagtactataaataacacttagctcttttttcttcttaattattttcttggataaagacttggggagaaagacttagttaaatagcacacactttacatgcactttgaaacacatatcagtacattgctttctaggagttttactaattataccactcttggtataatatgtgaatgttgtataaagcagcagtttcactaccattgtatcgctgttggggtgtacaagtgttttggggatttgggtggggggaagaattgatattaaaagggaagttgcagcagcagtacagaaagttcacatctatccttcgcccggtttcactcgttaacatttttcatataactttgcaactaagagattaacatgggcacttttctgtttggtaaactccagactagattgaatttcatctgtttttgcaccaatgtccctttcctgttgcaggattcagtcctggattccatattgcattaggggtcatacagattttaaagcttttttgctttttaaaaaatagactttatttattagagcagttttagggtcacagcaaaatggagcggaaagaatagagagttcccacataccccaggccctcaygtgcacacagatgcccaagcttttttattttacttatatgagtgcactatgaatatgttcttaatgtagagagtcagtcaagtcagccatgtgttaagaataaaaaaggaaaaacccttttccccattaccttccaactctcctttctcagatgtaaccactattagcagctgccgatggtggggggctcttttcagcactgtcactgtatatacttttacatagacattcatacagttgtttyattattttttgcatgacttcatcctatacattattgcaaatttgttaaacttaatttgtcttagaaatcattgcacgtgaatacttttcacattgtctttaagaatctctagaagacatgcctataaaacaatgcctttcagctcttaacaggatgaagtaagtttgtccttagattccacccgggagagctagctgagaaagtgcagtaagtggaagaaaaagacaaccacagattagkgtgttttggtcccattttcattcaaagaaactttctctgtatgtgttgctatatgcatagaagaaagccagtttggacaccaaactctttaacagtgcaatatctttaggggatgtgactgtgggagattttaccatttcacagagtttgacttaaaaaagagaatatgttgcaggtagtgactattgggctggcggtgcagctggtaaaggaatttaccaagacagctgtaggtaaagaaaggcagatttattggaggaagtatgaaaatatgttgcaagattgcaacaggcagcacagcagagarggatctgtctgcaaagaggcaagggctggtgggaggttttatagggtggtgctggaggaggggctgtgaggtcattacgtcctggggttgtttgtgattagccatctctcgagcagttgttcattgttcttccccacctggggccgtcccccacctggggcccctttctcctygttactgtggagtcgggactccacagaatattatgtctgtgagacaacaaaagtaaaagatcagcagagtcctggatgagtaccctaaacacatcactgcgtttgttttatgttctctcctgagaacttccagaagcttccagagctggtttycccatgaagatcaggctgctctgcttcccccgacaggtacagagtgagatcccaggctcgcccatctttctcatgaagctggcccagcacgcccgtcacctggaagttcagatcctcgctgaccagtatgggaatgctgtgtctctgtttggtcgcgactgctccatccagcggcggcatcagaagatcgtkgaggaagcaccggccaccatcgccccgctggccatattcgagttcatggagcaggtacacttctcagagcccagggggcagcttcagagagagccgtctcagctcagagtcaggaagaactttctacggtcagtgtggctgaatggtggcatgggtgcctaacaagagggatgagggcccattccagaggtgatttcagcatcacacaggtttattggattagccggtctgtgaactccccaaatatttcttttcttttttgagacagagtctcactgtgttgcccacgctggagtgcagtggtgcgatgatagttcacagcagcctgtaactcctgggctcaagtgatcctcccacctcagcctcccaagtagctgggactacaggaacctgtcaccatgtctggctaatttwaaaaaaaaatttttgtagagacagagtcttgctatgttgcccaggctggccttgaacttctggcctcaagtgatcctcccgccttggcctccttaagcgctagggtgataggcatgagccaccacacctggccagtcccaaaatatttcacatgtagcaggtgctcagtctgcatttggtgaaggaactgatagtcaccatttacagttccctgaaaagacctctggaacccccttggcctctttctgtttcttcacagtgtgccrtccgcctggccaagaccgtgggctatgtgagtgcagggacagtggaatacctctatagtcaggatggcagcttccacttcttggagctgaatcctcgcttgcaggtggaacatccctgcacagaaatgattgctgaygttaatctgccggccgcccagctacaggtgagaaaatgggcttggggccctgggacttctctgccctgggtcaggggtccatgtgctgctcccattagtccatcycgcccatctcttggccgactgtcccaggggaatgactggccaaagagcactttgagaaatctgtaaaagctatagttctccctgggaaaatatcttttatacaatttcaggacattcatagacctagagraatgtttcttaaccttgttatcattatcactccctgcaaggatcctttggacacattttatatcctaatccctgtcttgtgaaattttaatatcacaaatataccacatacctgtttggatattgtagatatatctgtgctttattcatgaaaagagtgagattttcttcactcccaagaacaaatatttgtctcttcagaggcaatatcatccctgttaagaatatgtgatccagagttgtaacctcttgggttaaagggaactctaaattttttttttatttttaattttgatgggtatatagtaagtctgtatatttatagggtgcaagagatttttgtttttgtttttgtttttttgagacggagtcttgctctgttgcccaggctggagtgcagtggcgcgatctcggctcactgcagcctccgcctcccaggcatacaatgtgtaataatcacatcagggtaaatgggtatccatccccctccagcgtttatcctttctttgtgttatggtgttatgaatattccaattatactcttttagttaattttaaaatgtacaataaattattgttgactgtagtcaccctgttgtactatatcaaatagcaggccgtattcattctcttaatcactacatttttgcrcccattaatcatcctcgctttccatgcccctacctcttcctttccagcctctggtaaccatcattctactctctgtgtctgtgagttccattgttttaatttttagctcccacaaatgagtgagaacatgcaaagtttgtttttctctgcctggtttatttcatttaacataatgttctccagttccatccacgttgttgcaaatcatggtctcattcttttttatgtctgaatagtactccattgtgtgtatgtaccacattttctttttcctttttcttttcttttttttttttttttgagatgcagtctcgctctgttgcccaggctggagtgtagtggtgcaatctcggctcactgcaacctccacctcttgggttcaagcaattatcctgcctcagcctccctagtagttgggattacaggtgcacactactatgcccagctaatttttgcatttttagtagagatggggtttcaccatattggccaggctggtctcaaactcctgacctcagawgatctgcccacctcaacttcccaaagtgctaggattacaggcatgagccactgcacctggcctgtaccacaytttctttatccaatcatctgttgatggacatttaggttgattccaaatcttggctattgtgaatagtgctacaataaacatgggagtacagatactcttcgatatactgatttcctttcttttgagtatatatttagcagtaggattgctagattggtagttctacttttagttttttaaggaacctccatattgtcctccatagtggttgtactaattttcagtcctaccaacagtgtatgaggggtcccttttctccacgtccttgctagcacttctttttctgttttctttttcctttcctttttttttttttttttttttttttgagagtgagtcttgctctgttgcccaggctggagtacagtggtgcgatcttggctcacagcaacctctgcctcacggttcgaacamttctcctrcctcagcctcctgagtagctgggactacaggcgtgtgccacgacgcccagctaattttttgtgtatttagtagagatggggtttcaccgtgttagccaggatagtcttgatctcctgacctcgtgatctacccacctcagcctcccaaagtgctgggattacaagcttgagccaccrcgcccagctgctagtatttcttattgcctgtcttttggataaaagccattttaactggagtgagacaatgtctcattgtggttttgatttgcatttctctgatgatcagwgatgttgggtgccttttcctatgcctgtttgccattcgtatgtcttcttttgggaaatgtctattcagatcttttgtctgtttttaattggattcatgagacttttttcctactcagttgttttagcttcttttttgtttttgagccagggccttgctctgttgcccaggcaggaatgcagtggcatgatcatggctcactgcagtcttgacctcctgggctcaagcgattctcccacatcaacctcctgagtagctgagactacaagtgtgcaacaccatgcccagctaactttttaaaattttttgtacagataaggtctcactatgttgwctaggctggtctcaaactcttgggttcaagcagccctcccacctcagcctcccaaagagctggtgttacaggcatgagtcaccatgctcatccttgagcttcttatgtattctggttattaatccctcgtcaggtggctagtttacaaatgttttctcccatgctgtggattgtctcttccctttgttgattgtttcctttgctgtgcagaagtttcttaacttgatgtgatcccatttgtcctttttttgctttagttgtctgtgcctttggggtattactcaataaatttttgcccagactgatgttcctgagagttcccccaatgttttcttctagtagtttcataatttcaggtcttagatttaagtctttagtctattttgatttgaagaatttgattcttcatttatgattctgcatatggatatccagttttcccagcaccatttatcgaagagactttttccccattgcatgttcttcgcaagtctgtcaaaaatcagttcactgtagatgtatggatttgtttctggattctctattctgtcccattgatctatgtgtttgtttttatgtcagtaccaccctgttttggttactgtagctctgtaatataactcatagtcaggtaattcaattcctccagtgtttgttcttttttttcaggatggtattggctattctgggtcttttgtgtttccatataaactttaggatttttttttctatttctgtgaagaatgtcattggtattttggtagggattgcactgaatctatagattgctttgggtaatatagccattttaacaatactgattcttccaaaccatgaacatggaatatctttccatttttgtgtgtcctcttcaatttctcacatcagtgttttatgctttttattatagagacctttcacttctttggttaagtttattccagggattttattttgtttgtagctatcataaatggaattactttcttgatttttttttccagaccattcgctcttggcatatagaaatgctactgatttttatatgttgattttgtatcctgtagatttactgaatttgtcaattcgaattgtttttttggtggattctttaggtttatccaattttaagattatatcatctgtaaacaaggataattggacttcttcctttccaatttggatgtcctttatttcttctctaaattgttttcattgttttcttccttccttccttctttcttcccataatggggtctcattacgttgcccaggctggtctccctcccttcctctttttcttccttcagcagaattttttaaaaagttttctttatttttttttcagtttgaaagatttcaaaaaagttgcaagaatgatacaattaatacccatacgccctgcatatagatccatcagttgccacatttgctttgtctctcttctgtctgtttgtataattttagggggctcaatcttttttttttttctttgagatggagtctcgccctttcacccaggctggagtgcagtggtgcgatsttggctcactgcaacctccacctcccaggttcaagcgattctcctgcctcagcctcccgagtagctgggattataggtgcctgccaccacacccagctaatttttatatttttagtagagacggggcttcaccatgttggccaggctggtctcgaactcctgacctcaactgatcagcccacctcggcctcccaaaatgctgggattacaggtatgcaccactgtgcccggccgtgggctcaatcttttgagcaatggtttgagtgaaccttcgtaacatatggcctctgaatacttcattctaaaggcctcctasaacaagagcattccggtccaatgccctagtgcaattatgacacttgagaaatagagcattgataccacatctatatctaatatataccattcacattaaatattttccctgttgttccaataatgtctttttgtagctgttttttgtctcttaaatccaggatccaacccaacccagggtgacacattccattttattttcatgtgtctttaatctctttaatctgaaagcatttcgtagtcttttttcatccttgacattggcattaaaatttttttttttttttttggtgatggagtctcgctctgtcactcaggctggaatgcagtggtgcaatcacgactcactacagattcaacctcccaggctcaagtgatcctcccacctcagcctcctgagtagctgggaccacaggtgcaagtcaccatgcctggctaatgtttttttaattttttctgtagagatcgggtctcattatgttgcccaggctggtctccaactcctaggctcaagcgatctgcctgcttcagcctcccaaagttctgggattacaggcmtggacactggcatttttgaggagctcaggcagaatgtccctcattggatttctctgattgtttcttcctggttcgattcctgctacacattttggcagaatactacacaggtgttgtgtccttaatacatctcatcatgaagcctgttaaatctgatcatttggttaagctggttccrtaattgtctactttttacccattcttcatgtccagtttccccttcgggtgccctttacaaaaacttcctttaactctgcagccaacatggttgcttctcaccttccctagctctaaaartctagtgcttttacttgatgcatgtattttcttgttgtgtgatgttgtttcataaatatttttccttttcccaactgtactatttgctccactgtgaaaagttcatgtcttatggctttttctttctttggctctctggccacagtagagcaccatgttgtctatagagtagtgtctgtatatcctaaatcattgactgaacctccgttgcatctaccactgtgcctggtgttttggggccrtgttctggtaggactgacagtctgtgggttggatctcttgattttagatcgccatgggcgtgccactgcaccggctgaaggatatccggcttctgtayggagagtcaccatggggagtgactcccatttcttttgaaaccccctcaaaccctcccctcgcccgaggccacgtcattgccrccagaatcaccagcgaaaacccagacgaggcaagttatgggggcccctgtgtttccaccatctcagatcycccagcatgtgggggaccctggatgttagcctgggaagagacacccacaagctatccaggcatctcagtttacaaatggggaaactgaggcatgggaagggacatcccatggtttatttgattattggatttattggatttttatttttatttatttttatttttttgagatggagtctcaccctgtcacccaggctggagtgtagtggcgcaatcttggctcactacaacctctgcctcccaggttcaagcgattctcctgcctcagtctcccaagtagttgggattacaggcgcccgccaccacgcctggctaatttttgtatttttagtagagacggggtttcaccatattggccaggctggtctggaactcctgaccttgagtgatccacccgcctcggcctcccaaagtgttgggattacaggcatgagccaccacacctggctggatttactggatttttggattattgccaggctctgggccgagccttcccatgtctcactgctcacttataggacactactgctgctggacatcgtcaccccacattacaggcaaagagcctggggtaacttgcttcctgtctcccacctgggacctgctgagacccatcagtggactccaaaagccatgcctatctttgggacaagcagccaggtttagaaccctagtccttggatttctggccccgtgtgctttttgcyacagtatgaagtctggctcattgtagagagtccctttgtgacttggccttacttgggtcttaaaaaacaaaccaactggcatcccttacagtttacatgcataccgaccgttgattgtcacaggactcatcaatctactacaacttaattgcttaattattaccctcaggaaactgggggtaagagagggtacacctccaccccttttaattaaataattttaagctagggtagctgtattcatttagggttcttggctgtgaaccaaacaccaactctggtggacaagcaaaaggggaattttttggagggatgatggctcgttcccaggttcctaggaggatggaggaccaggtatggtaacagcccaggcacttgggtcgctccatctctcacttctacatacctctycccaaatccttcatcccttagttcaggagccctaatcccagtgagaggtgccatgtccacccactcttaccaaaattgtacttagagggagacgggccgttctcccagagggaatcaggtgtgtgttggcagcagcctggccgatggggtgaggaaaagggggatggagggagggagggaggaaggggtaggaaaggaaggagggaagaggggagtgaggaaggacgaagggagagagggaaggagggagggaaggaggaaggaaggagagaagaaaggaaggaaataccaacgaaatggcctcttccctagcagcaagggccctgcccaggatgccctggatttcttcacctgcagaggttttcattatccagaattggaaatctaacctgtcttcacttctatttaaactttttattttcgaaatgtcaagcatataaagtcagaatgtcccttcactcagctccatcaatcatcaatgttcgcccatttaacacctgcactaccatctctgtcccaactcgcttattttatttatttatttatttatttatttatttatttatttatttatttgagacaggttcttgctctgtcacccaggcgggagtgcagtggcgtagtcatgcctcactgcagcctaatctcctgggctcaagagatccttctgcctcagccccacaagtagctgggactacaggtgtgtgccaccacacctggctaatattttaattttttgtagagatggggtctcctgatgttactctggctggttttgaactcctgggctcaagtgatcctcctacctctgcctcccaaagtgctgggattacagacatgagccactgcgactgaaccaacttcgttatttttttacagttaaaaaaaataagaattataggcattgaggagctcatatgggtacacccatgaatagatacatccatacctgtaacaagcgatatcagtgttctattgactaccctaagcttttggtcagcgtaggggttcttgggttttcccaggactgaattctgatgaaaatatatctggagtaatgatttcttccattttgcattttctgtccggactccagggttttaagccgagctccgggactgtccaggaactgaatttccggagcagcaagaacgtgtggggttacttcagcgtggccgctactggaggcctgcacgagtttgcggattcccaatttgggcactgcttctcctggggagagaaccgggaagaggccatttcgtcagtatctccttccttccttccttccttccttccttccttccttccttccttccttccttccttccttccctctctcccttcttcccctcttccttccctctttctcctcccttcctttcttcttccctccctctcagcctttctccttttttccttccttcccttccattgccttcctgccttcctttcttccttccttcctcccctcttctgccctcccctccccttccatcccttcccctcccttccttcctcccktccttyctcctccccttcccttctttcctcccttcctccctccttccttcttttcctgacttctctgctttcctccccctccctttcttcctccttctttccttccttccttctttccctcccttcccacttcctccttttcccaattccttcctttaagaaatgaaacggtcccctggggcttcagatacagtagcatttcaggagaccaagaaaagtaaatcacagggtaggccccatttwaaataccctgtgcttgaagttcaagatcaaagcctgccctttttttcctttattgaagatccacaaagtaaaataagtgcaccaaggtcatttggtcttgagcttataagagttctagcttgaaggagatctaaagattgttctaggagatacccaaagtgtaaaaggtgctaagtaccatagctgaagaaagggggagggaaactcctttacatttaaaccttatcagtagttccctaatgggttgtatttcacaccgaagactaaattttaaggagtgtgtcctgctgtgaaccacccaccacyctgaggcctgtgacagcagccccatgtccccagctcagccaagtcctcccatacttgtgatagtttctgcagagctgagaagcccacattgacagagggacccccaaattctgacacaccatctccgacacttctcctggcttgacatgggtgtggaaaggtataaaactagtttactttgtaattaaatgtttttgtgtgggtaactgcccttcggagtgaaaaaatcccaaaggccttagcattaaaatctgacgtggggcacttagccacgaattaaattgagttgggcagttttgatgatcaggttttctttgccagcttagaataattaattttaatcatgcttagtgaaaaatcaagatccttgaagtttatggaagattgcagcaaaaagggcttacttaataggagtaggcggaagacaggtcagccagcccagacccctccgagtgaagtgacctgtggcttgtcacatgctacgagtggaccaaccgcaacttcaacagaactcacaggcagaaattccagcttttcttattgctgttagtgagagtccagtagggggatcaactgtcctcgttttcctggcaccggtttctcaggttgaaggacttctcagtgctaaaatggggaccrccccaaggaaactgggacaagtcactcacccgtgagaccagcgggttaactctcatacccagcttccagacccacagctgacttttcatggcctatggatacccttgtatgaccttactgggtcttcattttctcacccccaaaatggggtcatcagtgtccttccccgttacctgctgacagcacacaggatgctgcaagacatgaaagcttactcggccaggcacagtggctcatgcctgtaatcccagcactttgrgaggccaaggcgggcagatcacttgaagccaggagttcaagaccagcctggccaacatgacgaaaccccgtgtctactaaaaatactgaaattagccgggcatcctggtggccatctgtaatcccagctactcgggaggctgaggcaggagaattgcttgaacctgggagatggaggttgcagtgagctgagatcgtgccatttcactccagcctgggcaacaagagtgaagctccgtctcaaaaaaacaaaaaaaagaaaaaaagaaagctttctctcccagaagaagaggtgttcagatacctgcccacactcaccatgaattcatagggctcagcttcccgagtagctgggactataggcgcgtcccaccacgcccggctagttttgtatttttagtagagacgggatttctccatgttggtcaggctggtctcgaactcctgacctcaagtgatccacccgccttggcctcacaaagtgttgggattacaggcgtgagccactgcacctggcctgaggtttagctatttgaactggtgctcttggagatttggagtctgtgtgttggggagaggcagccatggggcccaccaggcccctgagccgggtgacagtgccgtccatctgcaggtgcaccccacacacaccaggcagagcagctgtgtggaaggtgagagggtggcaccagctctggggacaggagatttgaataggtcaagggrgagacagaggcggtgaccgattttccctttgttttttttttcttcttttaagagatagcgtctcactgtgttgcccaggctggagtgcaatggtgtgatcatagctcactgcagcctcaaactcctgggctcaagcgatcctccccctttagcctcctgagtagctgggactacagtcacataccatcacgcttggctgattttaaaatttttgtagagatggcgtctcattatgttgcccaggctggtcttgaactcatgcctcaagcaatcctcccgcctcagactcccaaagcagtgggattacaggcatgaaccaccatgcctggctggttctttctctactaatcattaactattatagtcaataattataacaataataactaatcacrttcattgtagttaacatttattgatcagtgaccatgtgcattacatggattgtctcatttcaattctcgaacaccctcatgaagtcagggctatttccccattttccatatgaggaaactgaggcccagagttctcaagtcacttggccaagattagccaggcagtaaaccctggygctgattcaatgcactggctgtgtcagtcagagccctctcttaactcttctttttttttttttttggagacagagtcttgctctgtcgcccagcctggagtgcagtggtgtgatctcagctccctgcaacctctgcctcccagattcaagtgattctcctgcctcagcctcctgagtagctgagattacaggcgtcctccaccatgctgagctaagttttgtatttttggtagagatggggtttcgccatgttggccaggctggtcttgaactcctgacctcaagtaatacacctacctcagcctcccaaagtgctgggattacaggcgtgagccaccacacccggccactcctgtgcttttccagttctctgaatcacatcattgcagcaactctgttgatgtatgcatgaatttggaaaatgatccatgtgcctttcccttcaaggaacatggtggtggctttgaaggaactgtccatccgaggygactttaggactaccgtggaatacctcattaacctcctggagaccgagagcttccagaacaacgacatcgacaccgggtggttggactacctcattgctgagaaagtgcaggtagggagtgagctgcctgtgtctcccctctggatggccgagacctcggcttcctgaggatactgaagtgcattttctcctaggcggagaaaccggatatcatgcttggggtggtatgcggggccttgaacgtggccgatgcgatgttcagaacgtgcatgacagatttcttacactccctggaaaggtaggggctgtggcagttcccttctgcttttgtgatatgtgttagyggcttaggaggctgaatctgtctcctttatttgtgtggccagttagtcaccaggcaattggtgagtctctcctccggtcttgcctctgggaaattcctctacagatcaacctaggctacccttgaagaggctgtgggttagggaatgggattctcgaggccagggtggcagtcagtgaacaggctgttgtgtayggatccatgctgacttgtgtaaggtacatcataatagtcaggagttctgagttcaaggaggtggatttgggaagcaaagcggcttaaaggtcatctctacaagcgggtgcattcccagaccctcaccagaatcagagggtcatcatgaaatggaccagaatggaaagcaaccaggcgatctctgttaggataggccggggtttctcagcctcagcaccattaacattttgtgctggatgctttttttttgtttgggaacctgtcccgtgcatcataggatgttagcagcattcctggcctctacccactaaatgccaggagcagcccttccctctgagtcatgacaatcaaatatatctccagacattgcccaatgtcccagggttaggagtagaataatcacccccagttgagaactgctgcaagaggcaaaggaactatcaaaaagaaaataaaaggataawcttttttttttttgagacagagtcttgctctgtcatccaggctatcacccaggctagagtgcagtggtatgatcacagctcactgcagcctggacttcctgggctccagtgatctgcccacctcagcctcccaagtagttgggaccaccggtgcatgccatcatgcctggccaatttttttaactttttgcatagatggggtctcactatgttgccccccaggctggtctcaaactcatggcctcaagcaatcctcctgcctcaactctgaaagtgctgagattataggcgtgagccactgtgcctggtaagaaatgtttttagtgtttggttatgcttttgaacggtagtagaatcacagyccctgctctggtttctttcataagccgaaggcaggatcccatatgtgaaatttttccaagagaccgttatggattttgctcctgaaaagcctttgtaagatttcaaatccctcagcaagtgctgattccttaagttctaagcaatatcaggctgctcagggtgattcaggttctgtgcgtgacttttaatcagatttagcctttttttttttttttttgagacatagtctcgctctgtcacacaggctggagtgcaatggtgtgatctcagctcactgcaacctccgcctcctgcattcaagcaattcttgtgcctcagcctcccgagtagctgggatgacagctgcatgccaccacgcccggctaatttttgtatttttagtagagatggggttttgccatgttggccaggctggtctcgaactcttggcctcaagtgatgtgcctgcctcagcctcccaaggtgcagggattacaggcgtgagccattgcgcccagcccaggcttagcatttttagtgcagtcaggtttgctgatgcagagagttgcgtaatttttttaaatgcaagggatggctgtggagttctcagtccctcccaaggstgaccacaaccctgtcttttctttcaggggccaggtcctcccagcggattcactactgaacctcgtagatgtggaattaatttacggaggtgttaagtacattctcaaggtaaatgcccccgtgcytctccgatgtctccaacactctgcaagcttcagggagtttctttcttccatgaaccatccctggagtggatttgctcatgcttgggtttgagctcttgtgttcctcgggaatccccatgtagtccgtgaccttgacacctaaacactttggcttttagaacatgtagggctgtgcattctgcagagggcacaatggagcgtggataagtttcctgtagctgcggtaacaaggtaccacaaactggtttaaaccaacaaaaatktattgtktcccagttctggaagccaagtctaaaatcgaggtgttggcgggccgtggtctctctgaaggcgctggggcaggatctgttccgagcctccccagcttctggtgctgctggcagtccctggtgatttttggcttgtggatgccttgccccagtctctgtctctgttttttkttgttgttgttgttgttgttgttktttcaaacggagcctcactctgtcacccaggctggagtgcagtggctcaaccttggctcactgcaacctccatctcccaggttcaagcaattcttctgtctcagcctcctgagtagccgagattataggcatatgccaccatgcctggctaatttttgtatttttagtagaaatgggatttcaccatgttgcctaggctggtcttgaactcctgagctcaagtgatctgccctgccttggcctcccaaagtgctgggattacagkcatgagccaccccccggcctctgcctctgtgtgtgtgtgtgtgtgtgtgtgtgtgtgtgtgtgtgtgtgtgtgtgtgtgtgtgtgtgtgtgtgtgtgtgtgtgtgtgttcacattatcttccatgactgtgtctttgtgtctcttctcttgtaagaacaccagtcacattggatttagcgtccaccctaatccagtatgatttcatcttaattacatctgcagagacctcattccaaataaggtcacattccaaggttccaggaaggccatgaattttggaggatattattcaacccctatagaatgtgagctgggcctttgctgagacagaatagtgggcccgggtctgtttccaggggctctgaggctggttttgttctctgtctctgcaccacgtgtagattwctggcrtcttccctggtttactactggagtccctggggcttattccggttgctctcctctgtcagaagtgcctagttgccctttgtgggccatccaaggtcaattcaacagtgtcagaaatgtctctgagatgcacaggtagggggtgaggcttggtgtcctagccatggtgttctgggcccagggtccttgttggggtgagccggctgtggcatcagtgccccgggttccaatgcaatggcaggaggctgtgtcccctgtaagcccaggcctgcccagtacttcccagcctcacattgtcaggagggaaaagaggacagagtttgagtctgcttatgagacagaatttttgttttctttaattagtactttctatttaatattgatgagcatgagtagaactcacaactttggagatttgggggctttagttcaactaaacctgtgtgtcattgatcagggtatgctttcacaatcatcctcctttgcccctaatgcctcttggctacctttggggacctagctgcccccaacttgattttaaatgtcacatatgcacaatgnagaaaatttcaaaatttcaagcgagcataaaaaatcaggaaaacaaatccatcatgtgctaatgcctagaggtaatcctggtaaacattttagcaaatctttgttatatatttttttccttttgcattaattttacaaagttgagatcatggtgcaaatgcagttttacagctttgatatgatcatggcataaagttttccatgttattaacaagttttttttttaacacgagtctaaactcatgtctgtggcactgtctccctgaacttttaatagtgatgggaacattccctatcttctgtgtccaagatgctgcccttatgtggtgactgagagcttgaaagtggccagtgtgactgaggaactgaattttacattttatttcattttgatcartttaaatagctgtgtgtggttaggggtcaccgtatcagacagggcagatctaaagtgttccattgcaaggttgttggcytgctaattttgttctaatttttgttgttattacaaataatgctgcaatacacattcctctatttcttgctgccttgtgtcataaactgtgaattttataggttgaaggccctttagggtgtgtgttttctgagagaaaacygaactgaagtaccagatggggcaggcgctcttcctggagggagatgtagtgctggggccagggcttggctgtgtctctctcacgtgtcccaaagctcttgtgtgctcctgggcagagctgggtctgggaagcagagccctagtccatgtccaggtgtcttagtccatttgggctactgtcgtaaaataccaaagactgagtggcttctaaaccacacactgratttctcacaattctctaggctgggaaggtcaatatcaagatactggcagatttggtatctactgaggacccacctttcgtttcatagatgctgtcctttygctatgtccttagatgtcagaaatgggccacagagctctacaggggatcttttataagggcactaatctcttttacaagggccccaccttcatgatctcatcacctcccaaaggctccacctcctaaagccatcacattaggggttgggatttcaacttatgaattttgcggggacacaaacgtttagtccattgcacctggctgctggtggagtctccagggctgcctcacacagagtgagagctggagacaggaatcagaagggagtctctagccccagaggacatgcagttgccaacacggcttgacagggactatataagcggccattagcctacccacagggcaggtgtggctcgctactccaggcctcccccagccccatcagcagctgctcccttggcaggaattgtgagggctgggtccgagagacgggggtgttcatcttggccctctgtggtggacaaccagctcttgtttgttgttagcggggcccagcagtgctctgggagcacatcctgaacccaggcggtgacaaggggcttgtccccacaggtggcccggcagtctctgaccrtgttcgttctcatcatgaatggctgccacatcgagattgatgcccaccggctgaatgatggggggctcctgctctcctacaatgggaacagctacaccacctacatgaaggaagaggttgacaggtgcgtgggggtgcgagtcccactgtgggctgggcatgcacagctctctgtcctaggcatggaaaacacagcrctggcctgtgtgcaggtccaagggtcttagagaaggtgcctttcyggtaaattctgggggtgtgcagagaagttaatctcttggttggaattctgtgcaactggcagatatttaggggaggatcctaggaggcccttttctagtaacctggttggtggggattcagagctgaacgggacatgactcccagctctgtggcctgcgaggtgtgtgaycaggtgcctgctgcctgtgcatctgggctcyggcatccacccagttagtgcggcagtgacctactaagctcctccgtaccaggcgctgtgctgggtgttgggatagcattctgggtgtgactcgtggagcttccagcccattcgggaagatgacacactgaacaaacagatagtggcaggaaagggtgtcgtgtacctgacgggtaacacacaagatgccctggaagctcttagcacaggggcttgtgagatagtgagataggccccaaagatgccccgcctccagtgtgtctgatcaccccgagatcacgcaatgaaacagaccccagccaaggtgatgaaaggggaggggatgtctgaaaagctccagttagagagtggagactctcttctcaatcctcaatgttttggaagaaggaagactaggtttatgccagagtaatattttgttatctccttttttttctttttgagagagggtctcgctctgtcacccaggcaggagtgcagtggcaccatcatgactcactgcagcctcaacttccctgggctccgagatgatccccccacctcagtcccccaagttgctgggactacgggcaygtgccaccacgcctggctaatttttgtattttttgtagagacggggttttgccatgttgctcaggctggtcttgaacttctggactcaagcagttggccagccttggcctcccaaagtgctgggattgcagtcatgagccactgcaccctgcctgttatctcttttttaacccacgttctatctgccaagaatgttcaggattactataggttctactctccccagttcaaaggttaagactttgaatcagtaaatatttgttgaatcatatccactgattgatttttctgtgtcaggccctgttggaagtatgtcagtaaaaggaaccagctttcagccaaaaaagggtcacatcctttttattattttattttattttaaagactggttcttactctgttgcccagcctgggcaagagtgagaccctgatcgcttgagtccagaagtttgagaccagtctgggcaacatggcaaaaccccatctctataaaatacaatgattagccaagtgtggtggcgtgtgcctgtagtcccagcaatttagggggttgtgatgggaggatcacctgaccccagggaggtcaaggcttcagtgaaccatgattgtgccactgcactccagcctgggtgacagagtaattatagctcacaatagcctcaaactcctgggctcaaaggattctcctgcctcagcctcctgagtagctgggactactggcatatgctaccacgcccagctatttttttttttttattttttgtagaggcagggtctcactgtgttgcccaagcttgtcttgaactcctggcctcaagcsatcctcccacctcggcctcccaaagaaagcatcacagccttggccaggcacagtggctcacgtctgtaatcccagcactttgggaggctgaggcgggcggatcatgaggtcaggagatcgagaccatcctggctaacatggtgaaaccccatctttactaaaaatacaaaaaaaaattagctggatgtggtggtgggcgcctgtagtcccagctatgcgggaggctgaggcaggagaatggcgtgaacccgggaggcggagcttgcagtgagccgagatcgcgccactgcactccagcctgggcaacagagcgagactccgtctcaaaaaaaaaaataaaataagaaagcatcacagcctttttgttcacccacctcactctcagtgtctctgagataactatcaactgccaccctttgggaatgtagagggtacactccccctttaggaaggggaaatggtattgaaagccggactagggcttgctgagttggtagtcctcatcagtctccctacccsactcctcctctctcccagttaccgaattaccatcggcaataagacgtgtgtgtttgagaaggagaacgatcctacagtcctgagatccccctcggctgggaagctgacacagtacacagtggaggatgggggccacgttgaggctgggagcagctacgctgagatggaggtgactgcagagccsgccgtggggaatcctgaaccctcaaactcccactcttctggctttgtcccatgtctgaacaaacaggcctacctctccccttgaccactgtctgcaaatttctaagggaatcagtctgtggatttcagccaaatcccctgaagtattcaaagaaaaaaacttcaggctgggcgtggtggttcacgcctgtaatcccagcactttgggaggctgaggcgggcggatcacgaggtcaggagatcaagaccatcctggctaacatggtgaaacccygtctctactaaaaatacaaaaaattagccgggcatggtggcaggcgcctgtagtcccagctatgcaggaggctgaggcaggaggatggcgtgaaggcaggaggatggcgtgaacccaggaggcggagcttgcagtgagctgagatggcgccactgcactccagcctgagcgacagagaaagactccgtctcaaaaaaaaaaaaaaaaaacttcaaaaaatgcacatctccccaggaatgagtaagaaggttaatgacagagaaactgggtacagagaatatggaaactctctgtactatttacataactgttctataaactgttgtgtaaatcagtttccttgatttctttattttttttttgagacaagtctcagtctgtcacccgggctggagtgtagtggcgtgatcttgtctcactgcaaactccgcctcccaggctcaagtgatcctcccacctcagccttccaagtagttgggattacaggcacgcaccaacatgcctggcttaattttttgtatttttggtagtgacagggtttcgtcatgctgctcaagctggtcaaatacctgagctcaggtgatccacctgctttggcctctgaaagtgctgggattgcaggcatgagccactgcacacagccaagaattgattgataataacaattattgtcaatcaatgattaaatattaaatattgaccccagcaataattgaaaggtgttaagccaacacttgcaaagccataaccatgtggcaggtgctgttctaagcattttactgatctttattttttaaccttcccagcaaatatatgagatgggcacaaatgtgatccccattttataaaaaagctgggcccaggcaggctaagaaactcactggaggtcacacaaagccaggattcaaacccggaaaataacaacaataatagcaatgaaaatacatcaataatagtagctactgcatattgacctgctgcatggcaggatctgcatctcattcaatcctcgtaagagccctaagaggtgaaactgtcattattcctcattttacacttggggaaactgaggctcaaggaggggagccacttctgaagatcacagaggtattggkgggggcagttcctgggattctagtccaggcctggctgacttgggtgcccaagctgtgaactgccaagcaagagagatagcacagtcctggctctgcggccgccaccatggtgacaaagctcatgccacgcacgtatccagacattcgggaaaattaaaagggctgatgagcagattcttcatttcacagagtgttccctgagggttttctaagtgcctttaataaaacaaactgttcacaaaatgtttgatttatgcagtacgttttaggaacgtgtatatgaaccactctatgtaatatgatttaacagtatttctaagagaagactccccctttggaaataaacatcagtttccatatctgtaaaatgggcatcataaacacctccttggctggctttgcagattgaatggcacttgcctggcacttagcaggcttccagtaaaggtcacttttccttgtaccttctgcctgaacactacccagggagtcattctggcgcgtccctgggtagtgtcccggcgcgtccctgctccggcatcactagttctgggtggctctgggtgtcaatcccggtgggctctgtactatttcttctttttacgaaataggtgatgaagatgatcatgaccctgaacgttcaggaaagaggccgggtgaagtacatcaagcgtccaggtgccgtgctggaagcaggctgcgtggtggccaggctggagctcgatgacccttctaaagtccacccggtatgtggctccacrgcccaagtgctctggctggtgcaggtgcactcgtgacctccactggttcagtgagacaggtggactcaaggctggtagcgcttctccygcctccacctgcagacagagctcgtcgcagcagccaccgtgatggtgcagaaacacaaggaagccgcgccctgctttactcagatccctctctgtggctctccatcctgcttagagcaaaacccaatttctgccagtgacctgcaagaccccaaatgagctagctgttccctgctttcttctctgcctttctcctctgtccctctccccatcacttacttgaatacactggacccctccctcctggcggctgtcctctctgctgtgaaggacctaccccagactttgcagggatcactctcaactcctgggagctttgattccaatgtcttcccctcaatgagggcattcttgaccattgaccaccttttctttttaatagacttaatttttagtatagttttagatgtacagaacagttatgtaagtagtgcagagttcccatattctctgtggccagtttccctgtcattcatttaattatcattcaattaattgttagtattattattattattcatttttttttgagacagactctcgctctgtcgcccaggctggagtgcagtggcgtgatctcgactcactgcaacctctgcctccctggttcaagtgattcttctgcctcagcctcctgagtagctggggattataggtgtgtaccaccataccagctaatttttgtatttttagtagagacagggtttcaccatgttggccatgctggtcttgaactcctgacctcaggtgatccaccctcctcagcctcccaaagtgatgggattacaggtgtgagccactgcacctggcctcaattaattactattgttatcaatttactgttattaatttaactattattgcacgagcatggtccatttgtcatatttaatgaaccaatatcgatatattaggtattattgtttaagaataataattaactttaaaatttaactattattgcaataatatggtccatttgtcacatttaatgaaccaatattggtacattattgttcactcagatttctttagttcattttttaaaaattgtggttaaatacacataacaaaatttaccatcttagccatttttaaatgttctcttgagcagtattaaatccattcacattgttgcacarccatcaccatcatccatctccagcacttgcaaaactgaaacttgacactcgttaaatggtaactcctgagtccctcctccctccagcccctggcaaccattgttctgctttctgtctatcaattcaactcctctaggtgcctcatataggtggaatctatatagtatctggccttttgtgactagcttatttcatttagcgtaaygtctccaagtttcatccatctgatagcatgtggcagaatttccctgttttttaaggctgcataatattcccttgtaggggtgaatcacattttgtttatccacccatccactgatggacacttggattgtttctacctgttggctactgtgaataaggcagctatgaacatgagtgtacgattttcttagtttttacctattgtccrggatcccatccaggttagcacattgcatatagttgtcaggtctctttcaaccgccctttaaaaaattgtgctcacctccacccacgtgcaaacacacaccrtacctcacaaagatgatctcactgattgtcttgttgctttattatttggcctccaggagactggaaacaccgtgagaacagggccttttggctttcttgctcgctgctggggccccagtgccaaaaacagggcctagtacatcagaggtgctctgtaaatattggttgttggatgaacgtgtagcaggcaggtgccgggggcgtccccctgtcctcaggaccaccagggggtgcaccagagtgtctgtcatgtgaccctgagctcaggctcttgggggcacctccaatttagattcctcttaatttgtcaagctstgtcattaccgatgagtccctgaggtcaaggactactttcgatgtccactgttgtgatcctggggcttagcacagtgctcggagcatagtgggtgctcagaaataacaagtcttgatgaatgaatgaatgtttacaccctcctaagcaagactctaaaataattagtacatctgtccagtaaaaaaaaaatttaaaaatatcacatggtctcttttctccagagtattctattaattgtatttgttttctttttwaaaaaaattataattattatgggtacataataggtgtacatgtttatgggggtacatgtgatcttttggtataggcataccgtctaataatcaaatcagggtgattggggtatctattacctcaagcatttwtcatttctttgcrctaggaacattccagttctactcttttggttagtttaaaatgtacagtcgattttaattgactgtagagtcaccctgttgtgctatcaatactatatctttttttttttttttttttgagatggagttttgctcttgtcgcccaggctggagtgcagtggcgtgatctcagctcactgcaacctctacctccagggttcaagcaattctcgtgcctcagcctcctgagtagctgggacttaaggcacctgccactatgcccagctaatttttgtatttttagtagagatggggtttcaccatgttggccaggctgatctcgaactcctgacctcaggwgatccgcccacctcagcctcccaaagtgctgggattacaggtgtgagccaccatgtccagcctcaatactagatcttattcattctatctaactggatttttgtacccgttaaccatccccactcccaccagccccactacccttcccagaccctggcagccatcactctacattctatttccatgagtttatttgttttaattttcagctcccacatatgagtgagaacatgctaaatttgtctttctgcccagcttatttcacttaatgtaatatcctccagttccatccatgttgctgcacatgactgttgttacaattcttttcattagtctctttctctctttttttgagacagagtctcactctgtcacccaggctggtgtgcagtggcacaatctcagctcactgcaacctccacttcctgggttcaagcaattctcctgcctcagactcccgggtagcaagtacctgggaccacaggtttgtgcgaccatgcctgactaatttttgtatttttagtagtgatggggtttcactaggttggccaggctgatcttgacctcctggcctcaagcgatccgtccaccttggcctcccaaaatgctgggattacaagggtgagccactgtgcctggcatcactagtctctttagggagttcccaaagctaggaatagactgggcctttttggatcagtgggcaggtctgggtacctgcactgtgattcctttcagcacacatttcctgtgctgggttaatgaggcagggcctgcccacccattccctgcagcctcacataaatgcttgtgagacagactgggagatcgagtracttcacttggtgagtgtagttagaagaccgcccttggccctgggctgtggggacccacatggagaagctatgatcagattgtgtaggggaaaaccctcaagtcagctttttttttttttgagacagaatttcactccattacccaggctggagtgcaatggcacaatcttggctcactgcaacctctgcctcccaggttcaactgattctcctgcctcagcctctggagtagctcggattacaggcacgcgccaccatgactggctaatttttgtgtgtatttttagtagagatggggtttcaccatgttggccargctggtctcgaactcttgacctcagttcatcctcccacctcggactcccaaagtgctgggattatggtcatgagccaccgtgcccggccaagtcatctcttaaaaggggagaaaagcctgcagggctaggggtggggatgggtgtgggtggaggggtagagggtgggcaggaaacrgagtgttctctgctgggagaacagcaccccagcactgtgcgtcatgcacrgtaggtatttgtagaatgaatgagtagacgaatgagcacatttagtctgtgttgccctctagggagctttttatttttccatgtgtttacctaagactgaatttttatgatttacaaaaatcagatgcatttgtatgagatgttcataaattttcatcctactgtgaggtgtttaactttgggattcaatagagaatgaaaataaatacagaacatgagatttgttgattataaagcaaaacaacaacaacaacaaacagatcggccgggcgcagtggctcacccctgtaatcccagcactttgggaggccaaggcgggcagatcatgaggtcaagagatcaagaccatcctggccaacatggtgaaaacctgtctatactaaaaatacaaaaattagctgggcgtggtggcctgcgcctgtagtcccagctactcgggagactgaggcaggagaattgcttgaacccgggaggcagaggttgcagtgagccgaggtcatgccactgcagtccagcctggggacaatgcgagtgtctcaaaaaaaaaaaaaaaaaaacagatctcaccgccaccccacaaaactgtctggggtgtgaaactgtgtactgggccatttgcaaaaggaatggtttggaaaacccacattggggtgtgagtttggccrttttaactttccagttcattgtctttgattttttcctcagacctcatcctcacttgattacggaagccggcagatctgtcctgcctcccrttctgcccggtcccatttggaattcccagagttttcctgacctgtcgttcttgtggtgtctcatcaggctgaaccrttcacaggagaactccctgcccagcagacactgcccatcctcggagagaaactgcaccaggtcttccacagcgtcctggaaaacctcaccaaygtcatgagtggcttttgtctgccagagcccgtttttagcataaaggtaaagtcacctatgagcgcaggcgtgtagaccagtgcggagggtcagaagatctaccccgtgacagcagaggtcattattgagtaagaaatgagaaaatggtcggtcctctgttgkttttattttatttattttattttttcagacaaggtctcactctgtcacccagactcactgcagcctcgacctcctgggctcaagagatcctaccacctcagcctcccacgtagctgggactwtaggtgcaccccaccacgcccggctaattttttgtatttttgtagagatggcattttgccatgttccccacgctggtcttgaactcttgggctcaagtgatccatccgcctgggcctcccaaagtgctgggattacaggcctgagccaccgcacccagcccctcggttgtgtttatgaaggacctgtcctcagggaattcctcaattcaattgtaaacattggcctgactttttctccttgatcgtaaactgggcttgtagcagttcagctcaagactgagaatactccagtaggacattaaggaaggagtcagtgggggtcaccctgcttaaggagatgacagacaaggcactttgtttgaaacacacctctgttcgtcattcacccttgctgggtctcatctgctcactcagtagagaaacaagaagttctctgatttgcagacctccttgaaagacccatgatgctcatagcagtgactaascatcacactgtgtgctgtaccgggtccgtctcaggagagcaaatcatgatggtgatgacgataataaccgccaacccttagcaagtatgtaccatgtgtcacccccctttgtttttgagagggagccttgctctgtcacccacaccaaagtgtggtggcacgatcttgtctcactgtaacctctgcctcccaggttcaagcgattctcctgcctcagcctcccgagtagctgggattacaggcgtgtgccaccatacccagctaatttttgtattttttagtagagacggggttctaccgtgttggccaggctggtcttgaactcctgacctcaggtgatccacccaccttggcctcccaaagtactgggattacaggcgtgagccaccgtgcccgctgtgtcaccttctaactacttaaaagttcaatcatttcatcctcccagcaaccgataaggtaggaactcttatttccacttacagttgaggcaactgagggacacagagactaagagacttgctgtgcttcatacatgaggaggcaaagatgagatctgaaccatggccatcaggattctgactctgtgctcttcgcccccacgttatgctgcctgatgattattaccaccattgcaacattttttttttttttttggagacagggtcttgctctgtctcccaggctggagtacagtgggggaaacactgctcactacaacctcgacctctgggttcaagcaatcatcccacttcagccttccaagtagctggggttacaggtgcctgccaccacacccagctaattttttgtagagacggggtctcgccatgttgcccaggctggtctcgaacttctgggctcaagtgatcctcccgccttggcctcccaaagtgttcagattacaggcatcagccaccgcaccccacaataattgcaacttttattagttggggcacttcgcagtttatgcatcagttcactttgaaacctcacaaccacactaggatgttggccccactatcatcgtcatccaaagaccatcagcattggctactgagacaccccggaaacagcatagggcagcagttcagagtctcaggagctgaatagcctgggtttgcttcttactagctgagtgactttggttaacttaactaacctctctgtgtttcagttgcctcaattgcaaaatggacaaaatcattagacttcctttatatggttgcttttagggatcaaatgataacatgaaaagaaagttcctagaacactgtctggcactaagcaagtatcctataaacatcagctcatcatgtgaccttatgtttgatcccccmcaccatgctggctttctgatgcacagagagggggagtcagggtcttcctatgtagggaaactgagtattcccctgtggtcagggggccattccactctggactgccccagaggctgctgggtctggatcttcagccacttgagtgcatggggtcaggatgggttgagctgtgttgggtgccctgtttggggcggtggtgcccatgcccatgcagggctgggggctgatgctgtggtccccgcttcagctgaaggagtgggtgcagaagctcatgatgaccctccggcacccgtcactgccgctgctggagctgcaggagatcatgaccagcgtggcaggccgcatccccgcccctgtggagaagtctgtccgcagggtgatggcccagtatgccagcaacatcacctcggtgctgtgccagttccccagccagcaggtgcgtgctcccctgcccagccccaccccaccaggatggtcacactgggccggctcccggtctggctcgatatctggcctctgatcaagttgaactccttgagacccacttatagcctaacrtatcaggggccgagggtttccttttgagccttgtctgcagaatcctatcatttactcaaagcaacagttgtttgaatgaacatcagtattccttaggcctcattgcctaaaacccaagattctgaataggagtgagcagttgttgcagatggagtgagcatttcccaaaaaataaactggctgacatcattagaggaaactgcaagtttttttatttttgttttttcactggtttgcagctttgattttctgcccctggattttgtaggtgatcatctgggagctccatgtatgtgtgtgtgtgtgtgtatctgtgtgtatatatatatacacacacatatatatacatatatatacacatacacacacgtgtgtatatatgtatatatacacatacacacacgtgtgtatatatgtatatatacacacacacacacgtgtgtgtatatatgtatatacacacacatatatgtgtatatatgtgtatacacacatatatgtgtatacacacacatatatgtgtatatatacacacatacatgcatgtgtgtatatatgtgtatatatacacacatacatgcatgtgtgtatatatgtgtatatatacacacatacgtatgtgtgtatatatacacacgtacgtatgtgtgtatatatgtgtatatatacacacatacatatgtgtgtatatatgtgtatatatgtatatatacgtatatacacacgtgtgtatatatgtatatatacgtatatacacacgtgtgtatatacgtatatacacacgtgtgtatatacgtatatacacacgtgtgtatatacacgtacatatgtgtatatatgtgtatacacacacgtacatatgtgtatatatacacacgtgtgtgtatatatgtgtatatgtgtatatacacacacgtgtgtatatatgtgtatatatgtatacacacacacgtgtgtatatatgtgtatatatgtatacacacacacgtgtgtatatatgtgtatatatgtatatatacacacgtgtgtgtatatatgtatatatacacacgtgtgtgtatatatgtatatatacacgtacatgtatgtgtgtatatatgtgtatatatacacacatgtgtatatgtatatatgtatatatacacacatgtgtgtatatgtatatatgtatatatacacacatatctgtgtatatatgtatatatgtatatacacgcacacacatgtgtatatatgtatatacacgcacacacatgtgtatatatgtatatacacgcacatacatgtgtatatgtatatatacgcacatacatgtgtatatgtgtatatatacatgtatgtgtatatacgcacatacatgtgtatatgtgtatatatacrtgcatgtatatayacatatatacatgtatgtgtgtatatacatataaacatatatatgtatatatataatattttttaagaattatactgaggtcgggtgcattggctcacrcctgtaatcccagcacgttgggaggccagggcaggtggatcacttgaggtcaggagttcgagaccagcctggtcaacatggtgaaaccccatctatactaaaaaaaaaaaattagctgggcgtggtgttgcacacctgcaatcccaactactcaggaggctgaggcaggagaattgcttgaacccaggaggtggaggttgcagtgagccgagatcgcaccactgtgctccagaaaaaaaaaaaagaatgtactgagatgtcttatcataatcatagttgcatttgtgaacatgttaaaaaaaaaaaaagaatggaagccattccagggaagtaagaaatatctctgttatttacacatcggcctcgcgttgttcattttgttgtggttgttggttttgtggggcatttgaaaggcatttgcactgggaagagcccctctgcctgtttgccttcctgccctctggtgggagggttccccaccatcatcatccacccacccacaaattggtgatttgggaaaccagaggacagtgtagttcaggccattctcggargttaggagttctatgggttggaatgttgttcagccaaagaaagaaagaatactgattcatgctcccacgtggatgaacctattgtgctaagggaaataagccaggcacaaaagaccacatattatgtgattcctctttttttttttttttttttttgagacctcccgaatagttgggattacaggtgtacaccaccattcccagctatttttttgtatttttttagtgragatgggttttcaccatgttggccaggctggtcttgaactcctgacctcaggtgatctgcctgcctcggcctcccagagtgctgggattacaggcatgagccatggtgcccagccctgtgtgattccaattttatgaaatgtccagaataggcacgttcatgaagaaggaagtagattagtggccgccaggggctgcagtgcagggaaaatggagagtgagcgctaatgactacaaggtttctttttagagtgaygaaaatgctttaaaattagatggtggtgatagttgcacaactttatgaatacactaccaaccactgaatgtacactttaaaggkagatggtggaatatgatggtgtgtaagttatatctgaactaaaaaataacaaaagccaaactctagaggatcctaactgaaaaagtacacacttggaactttcaggaatttgtcattgatccaggtttttttttctttaaaaatatttttgatgccaaaggcaatacaccgataacattatgtgtaatgataaagacaggacccttccccatgagcaccctggtttttgctagagtgggacattcccatctccttgttccccatcccattgatatgtgcggaatggtataaggcgaatgtgtgcactcctccatgtgatcgctggcattttgagcgcttgaattcctcaccgttgaggggatgaacaggggtgtttcagggtagctggaaggctttgggcctggaattttcaatcttcaaatgagtctcggatgggacctccctgggaggctgtggtgggtcctttaggtcagcagttcccaacctttttagcaccagggaccggttttgtggaagatagtttttccacggaccggggagggggatggtttcgggatgattcaagcacgttacatttatggtgcactttatttctattatgattacattgtaatatataatgaaataattatacaactcaccataatgtagaatctgtgagagccccaggcttgttttcctgcacctagaaggtcccatctgggggtgatgggagacagcgacagatcatcaggccttagattatcgtaacgagcatgcaacctaggtccctcgcatgcacggttcacagcagggtttgcgctcctgtgagaatctaatgctcccgctgatctgacaggaggtggagctcagatggtaatgtgagcaatggggaggggctgtaaatacagatgaagcttcgctccctcacccactgcttacctcccactgttcagccagttcctaacaggccacggaccagtgcycgtttgggtactggtttggggaccctttctttaggggactgctgtgtgtcatytgaatcatcagcagtcagacctgtcttgttttcccatccagatagccaccatcctggactgccatgcagccaccctgcagcggaaggctgatcgagaggtcttcttcatcaacacccagagcatcgtgcagttggtccagaggtgaatcctgggtctccccgtaggatgtggttgtcacctgaatcgtcgcatgcattgcaccagggtggtgctctggggctgtcttcagggcaggcttgaactgagagaaagtgtgttatagtcctgcagtgccattactaacagcagaaccctgggtgaggtactttacttctgtaaatctctgtttgtaaatctcagctcactgcaacctccgcctcccaggttcaagcaattctcctgcctcagcctcccgaatagctgggattacgggcatgtgccaccatgcctggctaattcttgtacttttagtagagacggtgtttcaccatgttggccaggctggtctcgaactcctgacctcaagtgatccattctcctcgacctcccaaagtgctgggattacaggcctgagccaccatgtctggcctataaatgtattaagttttgtgaagtgctgacaaatagtaaatacttgatagatayattagattgagacaatgggatgaaatagctttatgtatgataaaacactgcaaaaattgttattgtggcttttgggacaattgcaaaggaaagtggatgaataattgtatttcatctcaagtagttatttattgtacaggggtttcccgctgcaggactattctgatgacaaaaggattttctttgtttttttgagatggagtttcgctctgtcggccaggctggagtgtaatggttcgatcttggctcactgcaagctccgcctcccgggttcacgccattcttctgctgcctcagcctcccgagtagctggaactacgggcgcccaacaccacgcccggctaatttttttgtgtgtttttagcagagatggagtttcatcatgttagccaggatggtctcaatctcctgacctcgtgatccccctgcctcggcctcccaaagtgctgggattacaggtgtgagccactgcacccggctgacaaaaggattttctgccacttttcatgaaaaatccacctagcaagaaggctttccttatgaagacaatcagggccaggcgctgtggcttatgcctgtaatcccagaattttgggaggccaaggcaagaggatcacttgaggccaggagttggagaccagcctgggtgatgtagcgagaccctgtctctacaaaaaaaaaagaaaaaaaaaatgagtcggggatggtggtgtgtacctataggcccagctactcaggaggctgaggtgagaggactgcttgagcccaggagttcgaggttatagtgagctgtgatcgcgccattgcactccagcctggggacagagcaagaccttgtcttttatgaaaaagaaaaaaggaatcaaagcattcttggatttgaaccagtaaattccaggcatgtttcccatgtgccagaaactcacaggtacaaagaatgtgagattgtagaaaactggcctccttttcaaggagctcctcagctgttagggagagagattttagtgtggattccccacaaactgcaagtttcacagccaagggctaggaagggagtcctcctaaaacacatagactgctaaccttaagcycatcctttaagcttcagagaaacatctaggaaaaatgaaccattaataaattaactgaattttctagcaagttttctgtgctgamcataaatattaaagccctgtcctgtattgtgtaagtatgttttaaaatcacatttgtatcagagtcttttagcatcttggtctgttttgttgtgatttggtgatgctgccatgaagcgtctacttccccacaactcagtggcgcatctcctgagaaacttgactcctgtgttcagatttttggaagaacatccaggttaaaactttgttttaaaagaagcggctaggtgcgatggctcacacctataatcccagcactttgggaggccaaggcggrtggattgcttgagctcagaggttcgagaccagcctgggcaatatggtgaaaccctgtctacaaaatatacaaaaattagccaggcttggtggtggccacctgtggtcccagctactccagaggctgaggtgagaggattgcttgagcccgggaggcagagattacagtgagctgtgattgcaccactgcactccagcctgggtggcagaacaaaacctcgtctcaaaaaaaagaaaaaaaaaaagggagaagcaaaatttacatggggatcttttggtaaatgtttttccagtttgtctttttaaaatggtctctataccttgggtaagtaattgaaaaattttgtttttaacagttaaagcttgctaaaattggctacccctgttcagtatccgaaatctatgaagttttttttttttcttaactctgtggccagaaaggcgccctcccaagtataaggcttgggatctacctactccagttttgcctccagtttgatgtgggactttgggcagggcagtgttctttttggcctgcagatgaatcaactccatatcctttgaaggcctcaggattagagggtgcctctagatactttaaaaaaatttttggctgggcgcggtggctcatgcctgtaatcccagcactttgggaggccaagacagccggatcatgaggtcaggagatcgagaccatcctggctaacacggtgaaaccccgtctctactaaaaatacaaaaaaattagccgagcgtgggtggcaggcgcctgtagtcccagctactcgggaggctgaggcaggagaatggcgtgaacccgggaggtggagcttgcagtgagccgagaatcgtgccaccgcactccagcctggccgactgagcgagactctgtttcaaaaaaaaaaatgtatttttaaattaactaattaattaatttttatttatttattttgagacaagctgtcacccaggctggagtgcagcagtgcaatcatagctcacaacagccttgacctcctgggctcaagcgatcctatcacctcagcctcctatgtagctaggaccacagtcatgcgctaccactcccggctaatttttttgatttttttgtaaagacaaggtctcaccttgttgcccaggytgctcttgaacttctgagctcaaatgatactcacgcctcagcctcccaaagtgctgggattattggtgtgagccaccatgcctggccttaatttttttgttttgttttgtagatatggggtcttggctatattgcccaggcttgaactcctgggctccagtgatcctcccacctcartgtcctttctaaaatcctttctctctctctcttttttttttttttttttttgagacggagtcttgctctgtcgcccaggctggagtgcagtggtgcgatctcggctcactgcaacctcctcttcccggattcaagctattctcatgcctcagcctcctgagtagctgggactaccggcgcgtgccaccatgcccagctagtttttgtatttttagtagaracagggtttcaccattttggccaggctggtctcgatctcttgacctcgtgatctgcctgcctcggcctcccaragtgctgggattacaggcatgagccaccatgcccagccaatcctttctctttttaaaaatcataaaaaaaaatactaaatattcaggtactcaaggaagggtgtgagcattaagagcagccttcccttctccccagataccgcagcgggatccgcggctatatgaaaacagtggtgttggatctcctgagaagatacttgcgtgttgagcaccattttcagcaaggcaagagatgctgatgccaacaccagtgggatggtggggggcgtgaggagcctgagctttacctctgtgtggtgttttgtctcccccagcccactacgacaagtgtgtgataaacctcagggagcagttcaagccagacatgtcccaggtgctggactgcatcttctcccacgcacaggtggccaagaagaaccagctggtgatcatgttgatcgtaagcaggaagagggcctgttactagactgggggtgggtcaggagtccacaaacgttttcttaaaagggccagaaagtggctgggtgcggtggctcatgcctgtaatcccatcactttgggaggctgaggcgggcagatcacttgaggttaggagtktgagaccagcctggctaacatagtgaaacctcgtctccactaaaaatacaaaaattagctggccatggtggtgcatacctgtaatcccagctacttgggaggctgaagcagaaggatcgcttgaaccctgaaggcagaggttgcagtgagccgagattgtgccattgcactccagcctgggcaacagggtgagattctgtctcaaaaaataaataaaagaaaaagtaagccagcaagtaaattttttagactttgcaggttggtgtggtckctgtcgtgaccactcaacactgcctttgtacaatgtaagggaatgggcatggctgtgttcccataaaactttgttgggagcccgaggtgggaggatcacttgagcctaggagttcaagtccagcctaggcaacattgcaagactccatttcttagaaaaaaaattaaaactgggcactgtggctcacatctgtaatcccagcactttgggtggctgaggcaggagaatcactcgaggccaggagtttgagacgagcctgggcaacatagggagacccccatctctacaaaaagtacaaaaattagccaggtgtggtggtgtgcacctgtagtcccagctactcagggggctgaggcaggaggattgcttgagcctgggatgttgaggctgcagtaagctgtgatcacaccactacactccagcctgggtgacagaatgagatcctgtctcaaaaaacaacaaaaaaaatcccaactttgtatacaaaaacaggcaatgagtcgggtttgttggcactgggaagatcatgamtaatgcaaagcacctagtttgtgccaggtactcctgaagtgctttccaaataaatagttgctcatttaattcacgcagcagtcctagaaagtgggtactgctgtcacagctctttggcagagcacagagaggttaagccacttgcccaagggcacccagctcctaaatgtagagccaggatttgaaccaatagtctgactccagactcatgaactattagccgcaggatattggattttgagtcctgtgtgtggagaagaagaaatatggagtctctgttcttgtttctctttccactcgatgatagcagtcttttgttttttgtctgttttttcttttgagacagggtctcgctctgttgcccaggctggagtgcagtggygccatcatggctcactgtagcctctatcccctgggcttaagccatcctcccacctcagcctcccaagtagctgggattacagactcacaccaccacgcccagctagtttgtttgtttgtttgtttgtttgtttgtttgttttgtagagatgaggtctcactatgtttcccagtcttgtctcgaactcccgcgctcaagcaatcctcctgccttggcctcccaaagtgctgggattacaggcataagccactgcgcctggccgataatagcagtcttttataactaaaaatatttttctttgatatgtcccttgcaactgacttggaaaatgtaggatcagcagagtaagagcaacttggacttggcttatagtagaaaggggtttggcaatttttttttttttttttttgagatggagtcttgctctgtcgcccaggctggggtgcaatggcayaatcttggctcactgcaacctccgcctcccgggttctatctatcttctatctatctttttttttttttttgaggcagagtctcactctatcccccaggctggagtgcagtggcacgatctctgttcactgcaacctccacctccagggttcaagcaattctcctgtctcagcctcgtttagctgggattacaggcatgcgccaccacgcccggctaatttttgtgtttttagtagagacgtggtttcaccatgttagccaggctggtcttgaattcctgacctcaggtratccaccagcctcggcctcccaaagtgctgggattatagacatgagccaccacgcccggcctggcaacttttttttgtaaagggctccagatagtaaagattttaggcttgaggacgtccaccccctattgccactactcagctctgtgagctctgccactgtagcctgaaaactagacaataggtacatgaatgagggtggctatgttccaataaaactttatttacaaaaacagtcagtaggcagagtttggccacgatctcagagaatagttaataccctgtcccctgtccaagttgcattaataaatattgggatttttggtaaagaatcatttaaaaatctcacgcagcagcttttaatcctggctgtacattagaatcacctagggggtggggagacttaaaaaatacaattgcccatgccccacccttggtcaatttaatcagagtttctaggggtagggcccaggcattagtgctttttgaaagtttccctgtgggaaacctaaatgtgcactgtatattagataatattattggtttaatgttcagtttctttggtgttttaatggttctgtagtaggtggaagggagatatgtgcgaaaatagtgtaaaggattgtggtgtctgcaactgactttcagaaaaagagagagtgtgtatgtgtatgcgcacgtacgttcttattagagaaaaatcaaatatgataatgtggcaaaagttttaacaattagtgaatctaggtgattmctatgggtttttaacatactgatcttcaattcttctgtagttttgaagtttgtaaaaattaattgggagagaggactctccaagtgattgcaacacgcagccaggactgggaatttatgcccaaggagatatccactctttggggggagttctattactaaaataatataatgtttttcaaaatacattctttggatggagtttcctggagtttgagtgtttgtcaagcaaaatatgcctgtaatctattacagtcagcttgccattcaaaggcagtgggtctgtgggttattttgctgttcgttcttctgtgcacatattgactctcttctgggcatgaagtcatgaaatatcatgtacaccagaggacagccaagggaagatgggtggagcagcccccagttcttgggaattgggacattttcctggacctccttggtgatagaggctaaaaatgttgaaccaattacagtctcgggataaatgtgagattcattattcttctractttcttggtcccatttgttagaaaatagtgagttctctgcacctgatggtatttggtacctgagaggttttgaacaaagacttgtgaattgaatgattatttcgaaatgaatttttttgaggcttttaaagggacctagtttctgacaccagttcactggtcatgggacttcgttagtgacaaaacgaagcaaacaaaacatgattctgagaactaaaatatacaagatgagactgcttcacaaagttaacaagaaagaaaaatggtgttgttgttgttgttgttgttgtttgtttgttttcgagacagagtcttgctctgtcacccaggttggagtgcagtggcgcaatctcggctcactacaacctctgcctcctgggttcaagtgattctcctgcctcagcctcccgagtagctgggactacaggcacgtaccaccacacctgactaatttttttgtagttttagtaggaaacagggttttgccatgttggccaggctggtcttgaactcttggcctcagatgatttgtccgccttggcctcccaaagtgcagggattacaggcctgagccaccatgccctgcctagaaaaatgtttttgttattattattattatcttttgtatgtagaaggcaatggttagattttttaacattcacacttagatgtgtggggggaaatttaaaaaatgttcacacaaactcttgagtttttcacctcttagaaaagcaccagtctagctgctggccagcacctgtgctgtctggcctgggagccacatgcctaggggattggtggggagttatgccaccaccgtttaataatagaaagcaaatcagagaagggagaggagatttagaacactttcctaccacatttcttcagcattgatgttcctgtgtctttgtgtatgaaatatcaatatgttgaagttttttctgatgataaaatcagtctcggttcattataataggaaaatgcagaaacacatgtagaaaaaaatgccccacagctctaccatctggtgacctcttgaagaccagtcttagtggatgcccggggtggggaatgggggcatattgctcaggagctctgatatttrgcattcattgctccatcttcagtgggtggttagggagcacctgcgctgagctgttcccaagccccatatgcacttagggcataagaggagatgcgaacaccggctgcacccaggcctggtctccagcagaaaggcccttctttcagaagcagagaggagggatgcaacacagacacattgtccctccctctcctgcaagattcaaccccacgtccctctcctctgaaaccgtgagcgccttaagtcaggcagcaatgtgtaggggaaggagcgggaggctttgggggcagaatagtgctgtgttcgaatctggctctgtcttgcacatgtttgctggctttggggtgaggcatattgcctctttgagcctcagtgttcctatctgtaaaatgggaatcaaaataagtaactcttcgtgggggtgggagaatttggggagttgtatataaagggtctagctgtttactagccacctggcacatagtatgtgcctgataatcactgacctttttttttttttttkggggggagacagagtctggctctgttgcccaggctggagtacagtggtgcgatctcagctcactgcaacctccacctcccaagggatgatcaaatcatcctcccacctcagccttctgagtagctgggactacaggcatgtgccaccatgcccggctaatttttctatttttttttttgtagagacaaggttttgcgctgttgcccaggctggtctcaaactcytgagctcaagcgatcctcctgcctcagccacccaaagtgctgggattataggtgtgagccaccatgcctggcctaatcactggctattaatagtaacgtaggcagggacttagttgtatttgtttgttcttaccaggcatttagggcatgttgtggggtggatgaatgggtggccgagtgagtgagtgagtgagtgartgaatgactgactggggtgggtgcacagtagaaagtggtgagggtttgcataacaggctgtgctgggcctgtttggagagtggagcagccgcctggcttttgcggcaggtgctccccaagtcgagatgagtgctgcatgtttccctgggctggagaaaagccatttggcttctttttctgtcccctaaggatgagctgtgtggcccagacccttccctgtcggacgagctgatctccatcctcaacgagctcactcagctgagcaaaagcgagcactgcaaagtggccctcagagcccggcaggtagggtctcagggtgcggtccccacgatgtgcgtttccccccaccctcctatgtgtcccctaccgtgctcagccctcaccatgcacagtcccaccgtgctgccggcccstgcccgagcctctgccttctgccctgggaggttggctcacgcyagcgcccccatccctccccctgcagatcctgattgcctcccacctcccctcctacgagctgcggcataaccaggtggagtccattttcctgtctgccattgacatgtacggccaccagttctgccccgagaacctcaaggtgagcccgtctccttcctttcaccatctgcagagcacacactgtggcccaggtgggggcctctggggaaacggctcctcctgccctccaggtgctcagtggggtgcagggcacagccacagatgcagacagttcagcccaatgtggccagggctgcccgaggggtcacctggggagactctaggagaggtgggcatggagcccagtcctccaggaaggacagtgtgacagcagtgggggctcacctggtgcagtttacaaacctcagccatatggagcatatctggaagctgtgagccctcctgtggctgagtcgcggcctcatcttccctattcctggactctggctcatttacatgttctcaggtaccccctcagtgcctgatgggagacctgtcccaggtgccgtcatcccggagttcttcaccagctctcctatgattaaataggggaggagcccagcgcgctgcagggcactgatcgcttttagtggtcaaagcatgacttctgcctgctcccaccgcccccactcatcagactggtgattaaaaaacttactcactggctgggcacggtggctcatgcctgtaatcccagcactcgggaggccaagactggaggaycacttaagcccaggaatttgaggccagcctgggcaacatgtgagaccctgtctctacaaaaaatagacacacaaaaaaaagagccacgatgttggcgcacgctgtagtcccagctgctcaagaggttgaggtggggagatcgcttcagcctgggagtttgaggctgcggtgagctatgatcacaccactgcactccagtttatctcaaataaaaacaaagaaaaacctgaaacttgttcacatttacttttccttgtttccccttttcatttcccttagaaattaatactttcggaaacaaccatcttcgacgtcctgcctactttcttctatcacgcaaacaaagtcgtgtgcatggcgtccttggaggtaagcaggagaggcccagagaacagcactgaccatgccagttctagtgttcactgccgctaccatgcacctgaccctaggccacatgccttggtgaatgtgatcctatccttttctcttcaaggtagctatgttaatagtcccatcttacagaggaaggaactgaggctcagagaggtcaagtgacttatgcaacgtcacacagctagaaagtggcagaaccaggttttgcattattgggtctgcctcattccagattccatgctagtyaccactgctgtctcatgtcattccagcctcttccaggcagggcacattaaatactaatccctgagagccaagtctgaggcacctcatctaaactttctgactcacgtgcattaaatacctttgaaagacttttctgcttggaactgccagagctagaggagcccaggtgacaacttaaggtgaccccctgccccccgagtgatgaggtagaagggcgtggccagtagcaaaacccagattagagccaggtgatcccaggtggtcttgctcccgggagcaagaattcaggtcttcttgaattcaggaaccaagaagtgttgtgttggttccaggaaatcagagttttaaatctgctcttttwttattattattattattattttgagactcgcttgtgcctagggtggagtgcagtggcactatctcggctcactgcagcctctgcctcctgggttcaaatgattctccttcctcagcctccccagtagctgggcctacaggcgcccaccaccacacctggctaatttttgtattgttagyagagacagggtttcaccatgttggccaggctggtctggaactcctgacctcaagtgatctgcctgcctcagcctcccaataaatctgctgcccttttagaatctttttaagaaaatatgtttttaacacggccctcttacccgggtctgctttgctggcagtagtttttccaatattctttatcttctgagctcagagtctcagtcccctgttgcccccactttctcttctgcatccttgggagcctgtgagtcacacagtgagaaggtttactgggtcttctggagaccatcttgggcttgttagcatattacagccacagggtctcctgggcctgcaacttttattcctctatgggtttcacctctggaagaatctttctcaggcctcactctttgtttctaacagggagacctaatacacctcttctgtagttactttaaacacaatttttgttttgttagagacaggtcttgccgtgttgaccaggctggacttgaactgctacgctcaagcgatcctcctgcctcaccctccccagtagcttggactacaggtgcatgccaccatgcttgacttayagttactttttaaagtgctaaatgctgtttgtgtcaattagagatttttctaggatgcttttgggtttttttatttgttttgtttttccaccacgcccagctaatttttgtatatttagtagagatggggttttgccatgtcatccaggctggcctggaattcctgggctcacgcgatccacctgccttggctccccagagtgctgggattacaggcgtgtgccaccatgcctgaccccattcttgacagggaatggtgggaaccttccccaaattcaagttccccagtgctggccaagggcaagtcttttaatggaaagcaattatgtctgctaattgctgtattagctcctgctgcccagttcccgcatttcctgttcagttgaaaagcttccagtgtttaaactccagaactgcattgtccactatggcagccaccagccacgtgtggttagtgagcacttgaactgcatccagtctraatcgagctgtgctctaagtggaaaatacacactccattccaaagatgtagtactgtatggagaaaagaatgtaaaccatctcaataatttcttatattgattacatgttgaaatgataatatttgcatatgtggggtgaaataaaatatattattaaaattattttttatcttttttctaagtggttactagaaaatttaaaattataggccaggtgaggtggctcatgcctgtaatcccagctctttaggaggctgaggtgggagaatcactgaactcaggagttgcagaccagcctgggcaacataggaagatcctttctttactaaatataaaaaacaaaaaaaattagccaggtgtggtggtgcctgtagtcccagctacttgggaggctgaagtgggaggatcctttgagctcaggagttcaaggctgcagtgggttatgatctcaccactgtactccagcctgggtgatggagtgagaccctgtctcaaaagtaaataaataaaataaagttacatacacagcttgtgttatatttctgttggacagcactgctctaaagcagggtttgataaactatagaccatggaccatatttggcccaccacctgtttctgtaaagttttatcagaacgcggccaggtacggtggctcatgcctgtaatcccagcactttgggaggccaaggcgggcggatcacctgaggtcgggagtttgagaccagactgaccaacatggagaaaccccgtctctactaaaaatacaaaattagccaggcatggtggtgcatgcctgtaatcccagctactcaggaggctgaggcaggagaatcgcttgaacctgggaggaggaggttgtggtgagctgagatcatgccattgcactccagcctgggcaacaagaacaaaactccatctcaaaaaaaaaaaaaaaaaaaagaagaatgcagccacacccattcatttacatgttgtccacagctacgtccgtgctaacagcagaattgagtagttgcagccaagatgatatgtcccacaaagcctaaaatatttactacctatctcttacagaagtttatcaacccctgctctagagtttagagtggattttgtgtaactagtaacactctgaaatatgagcaaatttgctcttaactgctgcttagaaatctttttttttttttaattgaggaaggatttttctctgttgcccaggctgaagtgcagtggtgctatcatagctcattgcagcctcaacatcctgtgctcaagcaatcctcccacctcagcctcccgagtagctgggactacaggcgcctgccaccatgcctggctagtttttgtatttttagtagacatggggatttgccatgttgcccagactggtctcgaactcctgggttcgagtgacctacctgccctggccttccaaaatgctggattgcaggcctgagccactgcacccggcctgcttacagatagatattttagaggtcatttctggtacctgttccccgtgagtgccctcagcttttgagcacactctgcagtggcccctgagagaatgtccgtgtgtttctgccttgtcaggtttacgtgcggaggggctacatcgcctatgagttaaacagcctgcagcaccggcagctcccggacrgcacctgcgtggtagaattccagttcatgctgccgtcctcccacccaaaccggtatggagtggracacacccagggacggcctgtgtttctgttcttcctgacctctgtcgtcctgtctctggaaggacctggcaagtgtgtttgggcacgctgctggggagacatcagcgataagcacttcccctgtgggagctccctgcagcgccattttctcccctctaacatggtgataatgcagagcccacctcctacacctgcactgttcagtacagtagccatgtgtgcctatttacattaaaatgaatgcacatgggccaggcgcggtggctcatgcctgtaatcccagcactttggggggccgaggcgggcagatcacttgaggtcaggagttccagaccagcctggccaacatggtgaaaccccatctctactaaaaatacaaaaattagccgggcgtggtggcacatgcctgtaatcccagctactggggaggctgaggcaggaggatcacttgaacccgggaggcagagtgagtcagtgagctgagattgccccactgcactccagcctgggcgaagaagcgagactccgtctcaaaaaaaaaaaaaaaaagaggccaaacacagtagtggctcacacctgtaatctcagcactttgggaggctgaggtgggtggatcacaaggtcaggggttcgagaccagcctggccaacatggtgaaaccctatctctactaaaaaaaatacaaaaattagcctggcatggtggtgtgcactggtaatcccaggtacccgggaggctgagggagaactgctcgaacccgggaggcagaggttgcagtgagctgagattgcaccactacacgccagcctgggtgacagagcaagagtccatctcaaaaaaaaaaaagagaaaaaacaaagaatgcaaatgagccagccatggtggcccacacctgtaatcctagcacttcggagggctgaagggggcagatcaggaacttgaggcctggagtttgacaccagcccggccaacttggtgaaaccccatctctactaaaaatataaaaatttgccaggcgtggtggcacacccctgtaatcccaggttactcgggaggctgagggatgagaatctcttaaacctgggaggcagaggttgcagtgagccaagattgtgccactgcactccagcctgggtgacagagcgaaactctgtctcaaaaaaaaaaaaaaaaaaaattcagcttctcagtcatactgggtggctcatggctgccatattatttgacagtggagttctagaacattctgtcatggtagaaagttctagtagacaatgccacccaagccattgggaagagtcatgagataaggcacatgtagcattttagacagtgcctggcacaaaggaagttgttgactgtaagtgatcccggagatgatcatgactaacgctgttattaccatctagtggcatgccattggcctgggcactctgctcagtgctcccacactcttttatttatttattttttttgagatggagtctcgctctgttgcccaggctggagtgccagtggcacaatctcagctcccagattcaagcgattctcctgcctcagcctcccgagtagctgggactacaggcgcacaccaccatgctcggctaatttttatatttttagtagagatggggtttcatcatgtcagccaggctgatcttgaatgcctgacctcagatgatccacccgccttggcctcccaaagtgctgggattacaggcgtgagccaccgtgcccagcccacactcttattttattcagctcttatcctctatcggccaaaaatgtgttctcatcctcgttttacagatgggagccctgggccctcacctgacctaggctgagctgcttgtgcacgtggagtgggaatttgagcccaggccacactctcacctccaagtcctttccacagcattcaggggccctctgagccaggtgtgagggcacctgtcctgtctgtgtccactgtagtctgctgtccaagagctgtagttcagtagataccctcagtgttctcacctgagaatatctttttttgatttttttgagatggagtctcactctgtcacccaggctggagtgcaacggcrcgatctcagctcactgcagcctccgcctcctgggttcaagcgattctcctgcctcagcctcctgagtagctgggaccacagtcatgcaccaccaagccccactacttttttttgtaattttagtagagatggggtttcactgcattgaccaggttggtctggaactcctaacctcaaatgatctgtccacctcagcctcccaaagtgatgggatgacaggcgccaccatgcctggctcacctaaaaatatctgatgtgtctgagttcctcactcacagtctttttttcagtccatcttgtttcaggacccaaagtattaataccatttaggtcaggtagagtgggataccttctcttaaagtaattatgtctccttgggattcgaagtgttctctctcacgctccctcacccctctggttttagttcttatgggggtgcccaaggccttacctacggcggcattgatgtcattgtgatttgggagttcggttgatcagatctgtacaggcaatagggttcatgctttggtgaagcggggatttttctggcctcttaggatttttaaaataactttcttttcctgttggttttaagaagaaagatgctgctatgttttggatgaagaaaagggggcttccccasgaggcactgcctttcctagttatttgtttttacccttcttatttccaaaaataggattgtgacattttaccccattgagagaaaggggactgactgcttgcagcctggggtcattctggggatttggagagcagtggtggtgtaagatattttgtagctgtctactcctgagaaggactcttttgatttttttgtttggttgtttagagacagagtctagttctgtcacccaggctagagtgcagtggtgtgatcatagctcactacagccttgaactcctgggctcatgtgatcctcccacctcagctccctgtgtagctgggaccacaggcttgcgccaccacacctggctaattctttaaaaatatttttttgcagagatgggggtctcactatgtggcccaggttggtcttgaactcctgggttcaagtgatcctcctgcctcggcctcccaaagtgctgatattataggcgcgagcccctgtgcctggccttctcttttgatcttattgtcccagcaagtcagccctgttaggaagggaagggcggctctcctgagggctgtgggtcatgccttgtgagctacacgtatatccaggttattggttgtgattttcagtatgggcacagggtccttttttgacccagagagacattgaggaccctgggggattcctggccatctaagattctcatgattgctctcagtgccagaaatgtactctgggcctgtgaagagaccttgcctgcggctgcccccaccaaccagccctttaatgcctctgtaaagggccatgaggaataaagtctatccccaagatggcctggcttggccctcaacacttgtgtgtgtagagccaggcacatggtgctttaggtcaccgagacccaagggaaggtcagatgagaagttggcagggctttgtgccagctgcagcctggacctggacctctgtgctgggtgggaactggctacatccccctgcgatggggctgctgtcctagctctgcccactgttgccctgcaggaaactgaccatcacaaccagacttctccatgattttttccagcagaagcaggaaatctatttttttttaacctgaagtccttccatttttcaatggggacaggtaattcatgttaaatgaatacatgaacacatgttaattcatgtatgttattaaaatgctgcatggaccaaagtcattctgtgagtggcattcagccacactgccactgcaagtttgtgacccctggattgagctgtcggggagcagaggggccatgatcgtgatttcagagcacccaacaggaatgcacacacctgtgtcagggtccccaaaagcacccccaggttcgatcatcgcctakgagaactcacaggtctcgggacatagtcatgcttatagctctgacttattagggggcaaggatacaaagcagttagccaaggcagaaggcatcagggtgaagtccagaggaaagcaggtgtgctgccagggtcctctcccagtggattcacgcagggtgcacttcattcccccagcaaggagttgtgacaacacaagtgaagggttgtcttccagccccgcaccagggattggtggctggtcacatcaccctctgcyctgcatcgaaatctcaggcttgcagaagaaagcaggtgttcagcataaaccacactgtttgtgcaaacagttgaggcacagtgagccccccttgtcaccttcagggaacgataggaaccttccccaagtccaagttcccagaggccagccaagggctgtccttgcaagcaagcaggtctcctttctcagaagagcagtgtggggcctgctgtgctgacttcctgcacaccatttcattacccctcccgtatctgattccaaggcccaattctaacaacctcaggtggcccattgagatttgctgctggtgagcagccagttctgggagcatcgttgtctaaactccagaaggctgctgactttgtcccaagggcaagtttgatggagggattacagggagcagaggactggagtgtccgtcaggaccaagcctgactgcctcaccagctgcctggggctggtggatttctccaggagaaattgatgctgggagtgtttcttctctgtggtcaagttcagcacttggggctcccctcgggactgtgttgagactggactctcatgcatgaatcattgattcctacacttgttgagctcttactcttcaccaggtcctgagggatcagatgagaccctcctcaggccccggccccagccattgtctcatcccctgcccattttaagcccccatttggaagagctctaaatctggtccagctcactgaagcttcaggagtaggagcagctcgtagagttgggtctgcaagcagctgcctcatccccgacttgccatcaccytacaggatgaccgtgcccatcagcatcaccaaccctgacctgctgaggcacagcacagagctcttcatggacagcggcttctccccactgtgccagcgcatgggagccatggtagccttcaggagattcgaggacttcaccaggtacccagcatggcccggtctccaacaccctgagcatgggggctgsgcagacttcccttgaatccccccccaattcactggacagatggggtgggagagacccagacaygtggcacagcatgtcaataacaacagaataataatagcattgtagccaagagtatgagcctacatgtcagcttgcctggcacagcacatcaataacaacagaataataagagcatcgtagccaagagtgtgagcctgcgtgtcagcttgcctggtttgaattctggctatgtgctttctaactaagagactgagcaaaatatttttacctctccataccttcrttttcttatctgtaaaatgggaataataaaggactcacttcataggtgcgccatgagaattaaatgagataacatatgtgaaataacatatttaaagtataattagtatgcagataatatagtgactaaatgttagctctcaatagttactgttatagtcttttttcagcctttcactgtgtgttctgctttgtgcttggagtatcttgtggaattttcacaacagcctcatgaggcatagggattactcttattacctttctttgactcggggtgaggtgaggtttctaggatctcccagccagtaaaaatgggagccaagagttgatctcaagcccagctgatgcctgaaagcgctggaatccttccctgtattcctgatcacagatcacttaggttcattcttcccttttgggaaggaccccatcacgggtgctctggacaaagtagacagggaacctcctgagctctgtagagttggataagatcaaagggtgttggctgggaaattgggagggtctggcgttccctgctgcctggcttggaagcttgacctcatccccatgggtcagcagcccctcagccctccctctctacccgcacccccagaaattttgatgaagtcatctcttgcttcgccaacgtgcccaaagacacccccctcttcagcgaggcccgcacctccctatactccgaggatgactgcaaggtaagcgtctaagcccagggagcaacctggggagcaggtgggccgtggyccccaggctttccagccctaycccttgcttctccctmtcagagcctcagagaagagcccatccacattctgaatgtgtccatccagtgtgcagaccacctggaggatgaggcactggtgccgattttacggacattcgtacagtccaaggtactctgggcgtgcctctggttttggtgggggttcttggagaaggaggaggggctgggctcgtcgaggcggcccttggggaggcaggcgtgctgagtacttcagagccacagacctggcttcccactctagctctgctcgcctcatagctggcgaccttgggcagatgtggctgaacgtggggtcagcatttctctcrctcacggtgttgcaatgattcaatgacaaagtatatacacggcttagccagtcccaggtacggagggcacacccaataaatagtttggagattttctgggagtgtttttgttggaataatccagaaactggcagttttaaaatggctacttacattgatgaccaagtgtgccaataacagcaggttgctctgtaagcctgtgatgccattgtatttcagcctgggggacagagcgagaccctgtctcaaaaaaaattatatatatttacagtatacaatgtgatattttttaattatctttttaataacagctttattgagacatcattgacatactacacaattcacccatttaaagtgtgcagttttgcagccataaaaaagaatgagatcatgtcctttgcggggacatggatgaagctggaagccatcatcctcagcaaactaacacaagaacagaaaaccaaacaccgcatgtgctcactcataagtgggagctgaacattgagaacacatgggcagagggagggtaacaacgcacaccggggcctgtcggggggtgggggcygaggggagggaacttagaggacaggtcggtaggtgcagcaaaccaccatggcacatatatacctgtgtaacaagcctgcacgttctgcacatgtatcctgtttttttttttagaagaaataagaaaaaaagtgtacaatttaatatatttttagtatattcaccaggttgtacaaccatcaccagaatcaattttaggacattctcatcactccatagaaaaaccctgtacctgttagcagtcactcccctctgtccccaacccaaaaaccctctccccaccacagccctaggcaaccactaatctactttctctctatatagatttgcctatkctggacgtttcatataaatggaatcagatcacaggaggtctcttatgattgacatcttccacttagcataatgtttacaggttcatccgtgtggtaacatgcagcaatacttcagttccttttacggccaaataatattccattgtgtctttggtttttaatgcagaaaaatatccttgtggattatggactccgacgaatcacattcttgattgcccaagaggttagttcacagttcatctctatgagtctttcccattctccaagccttggtgtgtgccatttatttgatatttattttgtagatttgggtgaaagagatcattagaaaggagaaggatttccaaatgattcattctagaagtgaatgtaatcgtttacaatcactaaataaggatgtacatatttcagtgcgtcttgcttgatttaattgtcttgtgtgtggatttctttttgcagaaagaatttcccaagtttttcacattcagagcaagagatgaggtatggccaaaagtaatgatgttttctcttctctagcatcttgttttattttttaagagatgggatggggccgggtgtggtggctcaagcccgtaatcctagcactttgggaggctgaggcaggaggtttgctwgagctcaggagttctagaccagcctgggttatatagtgagaccctgtctctacaaaaaaattaaaaaatcagcctggcattgtgatgcaagcctgtggtcccagctacttgggaggctgaggtgggaggattgcttgaacctgggaaatagaggtttcagtgagccaaggtgattccactgcactctagcctgggtgacagagtgagactctgtctcaaaaaaaaggaaaaaaaagagatggggtctcactatgttgcccaggctggactcgaacttatggctcaagcgattctcttgcttcagcctcccgaatagctgggactataggcacatgccaccgtgcctcccagctccctggcatctttgatattcatgaagaatatagtctkcagtccttaaggcatccccatattcaagaatgtagcaacttttgtgtagactgcagtcttcctctgggattgtatttccattgagagccctctgttccctgcatggcactcagacctgagaatcttgccctttcagcctcactacaggtttctgtcttgcttgaataattttcagtacttgctgatgtactcagtaagacattttttccaaactgtttttcttatgctcgtctagaacagtggttggcaaactcacttgcagaccagctgcctgtttttacgaataaagttttattggaacacagccacacccgttggattccacattgtctactctggctttcactctaacagtagcagaattgagtagttgtgacagagcccgtatgatccatcagcctaaaacatttactctctggccatttaagaaaacgtttaccgatccctgttgtagaacaggtaggtttattcccagcactgattcaagaccccaccaaattcagcattttgcattttaatttatccaaagctttatttttctagctaagacacatccttttcttaatgtcttcattttttttttcagtttagtttccagtactgtcagttgctttcttttcsgggaccaatttccaccaagaaaccaggggttagtggcttcatgagaattgccacaggctgtgacagatggagaacagcctggtcacgctggcaggtgatagggactagctaggttcccccaggagccagcgctgcacccagcacaacaggcttgcaatgcccatagctctcctcagatcttagcaaaaccccaaatatctggagccctgggggtagcttacaattagggaacatcatgaatgctgcattcctgagtgccaaacccatggacaccaggggtctgcagagtagggtgtggaccaagcagggacgcagctccaacgtcacgctgtgtgtgtatgtgtctgtcttctctctctggtccgcctacagtttgcagaagatcgcatttaccgtcacttggaacctgccctggccttccagctggaactyaaccggatgcgtaacttcgatctgaccgccgtgccctgtgccaaccacaagatgcacctttacctgggtgctgccaaggtgaaggaaggtgtggaagtgacggaccataggttcttcatccgcgccatcatcaggcactctgacctgatcacaaaggtaagatgtcgcagagcatttcttcctctctcagaacctggccctcccttccttacattcctgctctgtgctgggtcctgggctgcatgctggggatggagagtacaccaacacccagggtcctgcccttgctatgctccagtccagggcaggaggcggacagcaaagtggcctgtgatcacgtccaggctggtggcacttggatctgtttcttgtattatgtgggtctctgcgcatgagaagaaaatttccaggatagaaaaatactggtttgttcagggaatttcttaatatttgctgactgagtgatcgttttccattgtttcttgcatttagaaaagtaatccatggccgggtgcagtgacccatgcctgtaatcccagtactttgggaggctgakgtgggcggatcacttgaggtcaggggttcaaaaccagcctggccaacatggtgaaaccctgtgtctactaaaaatacaaaaattacctgggcgtggtggcgtacacctgtaattccagctactcaggaggccgaggcatgagaatcgcttgaacctgagaggcggaggttgcagtgagctgagatggagcccttgtacttcagcctgggggatagagtgagaccctatcmcaaaaaaaaaaaaaaaagaaaaaaagaaacagaagtaatccatgattatattgtgaaaattttaaataagactgaaaacgatttttaagaacctagcgcaaggaccgagaatcctgtcactgaggggccagcttagttgttgactgtttctagacacaattccgtccctgaaacctagagttgtaggcataagttgcagataagagctgagagtggacagatcatttgaatatattattctttaattggtcagtcacttgtggacctctttcattgttaataaagagtggtccaccacatattatttccttgcatggatgtaccgtgtataattttttttttttttttactaatcccctattgatggaaacatatatatattattatatatataattatatataataatatatataatatattatataatataacatataatatacataatataatatataatatgttatataacattatatatacataatataatacatattatatgtatttatataaatatatatttatataaatgtatatataattattatatatatatwtttttttggagatggagttttgctcttgttgcccaggctggagtgcaatggcacaatctcagttcactgcaacctccgcacccccgggttcaaacaattctcctgcctcagccttctgagtagctaggactacaggcacaccccaccatgcccagctaattttgtatttttagtagagatggggtttctccatgttggtcaggctggtctgaaactgccgacctcaggtgatctgcccacttcggcctcccaaagtgctgggattacaggcgtgagccaccacgcctggccctattgatggatattaagctaactgcagtttttttgctacctgtcagctagatgttttatttttattttgatacagagatttgctcttgtcacccaggctggagtgcagtggcgtgatcttggctcactaccacctctgcctcccgggttcaagcgattctcctgcgtcagcttcctaagtagctgggattataggcgcccaccaccatgcccagctaatttttgtatttttagtagagacggagtttcaccatgttggccaggctggtctcgaactcctgacaactgatccacccatctcggcctcccaaagtgctgggattataggcgtgagccactgtgcctggccaagccgttttaataggttttattattgttgaggtatggtgaggccaacagataaggagacaactgccatcaaaaagacagtttattactcatagttcccaagaagaaggggttttccctgccatggggccacatggggaggctctggggttggtcaggcagcagagggacagaggggaagacatggaagacgtggacgagagccttgattgtggtttcctggagaagaaaaaagtgaggctgagtaaacaggtttaggattggctgtgaatcatctcagcagaccctggcatatagaagctgtctctggttctcaggaatctggccctgggtgattagagcaggtggtttgtgtccccaggtatgatccagggtcagcaaggccccaggtgtcaaagtgtcagaatgcagaaaataggacacatgtcaatacactcaacagctttgcagtcccttcgcctctgagaggcagggctctgctgttcttgcctggcacactttttggaggaggggaatgttttcctcctgtctctgcctctttggggctgagtttccagccagctgggagtaggcctgcacccctggcctgagcagctgcccctcccactctttggcaggaagcctccttcgaatacctgcagaacgagggtgagcggctgctcctggaggccatggacgagctggaggtggcgttcaataacaccagcgtgcgcaccgactgcaaccacatcttcctcaacttcgtgcccactgtcatcatggaccccttcaaggtctcgcctttgcaggggggctctcaccgggctctgggttcaccctctgagccatgctgctttggggtattgtctcttgccactcaagacctgggttccaggatgaaaccatgcgtatctgagcctcagttgctgcgggaggagagcaaaccttctgccattcaattctagagctatgttttagccatgccctgcacgggaatgctttactttaaggatgacaagcatgctcaaaatgtctttcaaaacaaaattttgtcctttccctggttccaggctgcgctggggactgcatgtgggtggggagagacgtgagaccgtgaggtctgtggctgaatgttccctgtcaggtggctcttcacgagcagacagacttttatggtggtgattctggaatgaaagaagccccacttgtaatcccagtactttgggaggctgaggtgggtagattgcttgagcccaggaatttgagacaagcctgggcaacatggagagaccctatctctactaaaaattttaaaaattaaaaaataaaatattaagattattaatcaaattaatattaatatcgatatattaatattattaaaatatataaatgtattttattttattatttaataatatatattattaaaaataattaatacaatagtattattaaaaagagaagtcctgatacatccgtttggtatctgggggattcaggggacccatgtggaggctctggcctcactagttcaggtagttccagaaggaagcagtgcaatggcttgagtcaaaggcatgtaaagatagtataacatagcagtactagttcagtcacttatcagcctcagtttccttatctgtcagtgagggattagaaaagctcgcctctcttgagtacttacgaaggcaaaatgaggtagagttttaaatgcttagcaagagccgttgcttgttattagttaatactttttgttggatacacactatgtcccaggcgtttttgcagtcagtatatctcatcctcttattagtatcagtgctattgcaaatgtccttgggatgtcttggccctgaaactggaattgctgtgttttggggcagatcgaggagtccgtgcgctacatggttatgcgctacggcagccggctgtggaaactccgtgtgctacaggctgaggtcaagatcaacatccgccagaccaccaccggcagtgccgttcccatccgcctgttcatcaccaatgagtcgggctactacctggacatcagcctctacaaagaagtgactgactccagatctggaaatgtaaggctggcccgcgccgtgggggtctaagtcaaagcagaagcaggctkcttgggccatcaatttgtagattaagatggcatttggaggcggtcttgccttgctctcccatgtcattctgggttggggtagccccctctgagtgttatgttaaatgtgttagcctttgaatcttggtttttcactcacctaaaaaggagagtgaatctccaagtttaatccattctgtggccatgttggatttttgatagagacaaggtgtcaccatattggccaggctggtctcgaattcctgacttcaagtgatctgcccgcctcracctccaaagtgctgggattataggcgtgagccaccacgcctggccatatggccatatttgggataagttgtgcactactgtggttgactgtaatgcagtcctcagattggttcacttagggaaatactttcccaaccatgttctaggacagacttttgtaaagtgaattaaatgttcttttgactgccatttaaattcctatgtgtgtacataaaaatatacatatatatacacgccattttttaaagagatattgcctagactgggcctgaactcctgggttcaagcaatcttctggcctcagcctcccaagtagctgggactacaggcacatgccattgtgcctggtctatgcactttttattttggagtaattgaagactgaagactctcaagcagttgcaaaattagtacagaagaaaaaaaatagtgcagaggattttcacccagtttcccccaatggtaatgttgattgaacttcaccattgcacatcattaaaacaggaaattgacattggcacaggactgttcgcaccaacactgaccacgttcggatttcaccagcgtttccatgcatgcctgttgttgggagtgtgwgatgccttgatcactgtatttttggaactgcattccacagcccctgttgtcccttcttgttctggccctccacagtggtgaagaagggagttttacrtagcccaggcactcactttgtcatgccatgtgacatgctttgcttcccccacctgcattttcattgaggactgggcagaaataaattgggggagatgtgtgattctctctcactckctgttttcccycctttctggtccagatcatgtttcactccttcggcaacaagcaagggcsccagcacgggatgctgatcaatactscctacgtcaccaaggatctgctccaggccaagcgattccaggcccagaccctgggaaccacctacatctatgacttcccggaaatgttcaggcaggcaagtccggcggctcagacgcggtaccccctgggtcctcccagcagactccaccagaaccaaagcccatccttaattctccttctaaagacctagtctaaaggacaaggtcttgccaggtgcggtggctcacgcctataatcccagcacttcgggaggccgaggagggaggattgcttgagcccaggagttgaagaaccccatctctacaaaatatacaaaaattaaccgggcgtggtggcgcatgcctgtagtcccagctacttgaaggctgaggcaggaaggatcacctgagcctgggaggtcgaggctgcagtgagccatgatgtcaccactgcactccaggctgggtgaccgagtgagaccccgtcttcaaaaaaaaagaacaaggtctgcattgaagaaaaagaaatgaatgtgttgagaacgacttcatagtatttttctccaaataagactaatttatcccaatgataaaagtcayaggatatagaaacttcagaaaataaaggaggttggaacaaagaaaaaataattcctagtcccacactctgatgacaaattgcttaacattttgatgtgtttccttctggtctttttaatggtcatttattaagtacctgctacttaccaggcaccattcgaagtctagacagctgtgggaaagaggagggggtcactgccttgagtaatttttagtctactcttaaaaaataatgttttgggttgggcacagtggctcacgcctgtaatcccagcactttgggaggctgaggcaggtggatcatttgaggtcaggagtttaagaccagcctggccaacatggtgaaaccccatctctactaaaaatacgaaaattaaccaggcgtagtggcaggcacctgtagtcccagctactcgggaggctgaggcaggagaattgcttgaacccgggaggtggaggctgcagtgagctgagatggccccactgcactctagccctggtgacagagcgagactctgtctcaaaaacaaaaacaaaaacaaaaaaataatgttttattatgtttttctgatgattaaagtatacataggaaactatggaaaggtaagaataaggaagtaaaattctattcatatgtaattttcccaccatcaatgcctgaaagaacatttgggtgcattttcttcaagtattttttatgcctttatatgtttatgccctaggggctttaaaggagcctgaaccactgacattggtgatgtgaatgtctcttcattttccaggattgctttggaatgacattatatatatatatatwttatttatttatttatttattatactttaagttctagggtacatgtgcacaatgtgcaggtttgttacatatgtatacatgtgccatgttggtatgggatctaattaaactaaagagcttctgcacagcaaaagaaactaccattagagtgaacaggcagcctacagaatgggagaaaatttttgcaatctactcatctgacaaagggctaatatccagaatctacaaagaacgcaaacaaatttacaagaaaaacaacaaccccatcaacaagtgaatgacgttcatgaaaccaaggtcaaggaccttccagtgtaggcaggaagcatctgttcctacctctgcctatgcctcatgcatagaggatatgaaagagtaggaaaagctgctctttagagtaactcgggcctcagctcgaatgctggatctgtccccttgcttcctgctgtccctagccaagttccttcacctctctgggcctcagtttcctcttctgtaaaataagaataataacagtacctaccaaaagttgttggaaaagtgtatgtattcagtgggcgcttaataagtggaaacttatgattaagaatgtcattgtctgtatccttttgcctttgacctcaagagctataagggaagaaacatgactgaaccagaagcaaatccatcgtctcttttttagataaatccattgtctcttttttacaggcatgagccaccatgcctggctaatttttttatttatagtggagacagggtttcactatgttggccaggctggtctcaaactcccggcctcaggtgatctgcctgcctcagcctcccgaagtgtttggattacaggcatgagccaccacacccagctgtctgtctgtctgtctgcctctatatctatatctatgtctatatctatctatttatctatctatctatcgagagaatggaaaactgaacagcagaccagagctaaatttatcaatatggataaatctctcaaacaaagaggagtagaaaaagtaatttgctgccgggcgtggtggctcacgcctgtaatcccagcactttgggaggctatggtgggtggatcacctgaggtcaggaatttgagactagcctgaccaacatggagaaaccctgtctctactaaaaatacaaaattagccaggtgtggtggtgcctcaacccgggaggttgaggcaggagaatcactgaatccgggaggcagaggttgcrgtgagctgagattgcgccattgcactccagcctgggcaacaagagaaaaaaaaaatagaaaaagtaatttgcggaaggatgtgtacagygtggtactctttatttaaagtttgcagtgcaaaacgataytgtatgtttccaatgtatgcatacaggataaaggaaaatgaaaaaaaaagcatgcataggactgggtaggcactgaattcaagggaatggtcacctgtgggttggagttgggaggaagaatgagctggggcttcaatcgcatctttcttctttctttcaaaaactttaaacaactatggaaaaatcaagatttgacagagccactggatgggtgctcatatttaaatatgctttaaatatttcatgattcaaaaagagagagtgaactacagaattcaccctggaatcatgacagatcatctctgtctgggaaagatagttcttccctactgatgacttcaagttttttctctttcctcttctctccccaggctctctttaaactgtggggctccccagacaagtatcccaaagacatcctgacatacactgaattagtgttggactctcagggccagctggtggagatgaaccgacttcctggtggaaatgaggtaatagctcagcggagcctarcccctggctggagtcacccccttaaaaatatttttgggccaggtgcagtagctcacacctgtaatcccagtgctttgggaggccaaggtgggtggatcacttgaggtcagaagttcaagrccagcctgggctacatggtgagaacctgtctctacataaaattttaaaattagctgtgtgtggtggtgtgctcctatagtcccagctactcgagagactgaggcaggagtgattgcttaagcccagaaagttgaggctgcaatgagctgtgattgcaccactgcactctggcctgcgcaacagagcaagaccctgtatctaaaaaaaataataataactaaaataaaataaaaagttttcccccaaagaaacaaactcattttccttgtrcattcatccccttgccaggtgggcatggtggccttcaaaatgaggtttaagacccaggagtacccggaaggacgggatgtgatcgtcatcggcaatgacatcacctttcgcattggatcctttggccctggagaggaccttctgtacctgcgggcatccragatggcccgggcagagggcattcccaaaatttacgtggcagccaacagtggcgcccgtattggcatggcagaggagatcaaacacatgttccacgtggcttgggtggacccagaagacccccacaaagtaygtcgtgaaactggcggggcagggtgattctgctcagctactactgtattttcagtgggagtgctagcacctgcaagaggtgaaaaaaatctcacttatgtataaagcacagatgtacatgtagtgtataaacaggcatacagtgtatcagtgatactaacatttcactgtggcgggggggatggtgatgagaaaaaaaagatctaaaaaggctccttaacggggataatgaaaaaagtctataaaccctgagctgatatacactgagcgctcctgaatgcagtgtgcactgagaatgcagaggtgattgtgtcaactccctggcctcatagcgttcttagaattatggctcacacctgtcatcccagcaactcaggaggcttgggtgggaggatagcttgaagccaggaattcatgaccaagctaggtaacctaggcagcatagccagacttcgtctctactaatgaaaaaactaggtgagcatgatggtgcctgcctgtagtcagcctcagctacttgggaagttgaagtgggaggatcacttggagcccaggagttcaaggctgcagtgagccatgatcatcataccactgcactccagactgggcaactgagtgagaccccccatctcaaaaaaaaagaaaaatctttggggagttgtatagataccagcttgccataaaaggcaagatgaatgagggaagcgcacgcattctgtgatgtgaaatgacaggggacagtcatcctttccattcagagcatgcattctcgggggcgatattgcccactacccccaagaagacagaaaaataatttttggggtggcaataaaataktttttaacatatatacatatacrgagtatgtaaatagtggttaaacagtgtatcttgaaaattaaaatttcatgttggggtgctggcaataagaaataaaaatgagatagtccttagaggagagcttagctcaaagcagaacttcagtttatggctgttattaatacggtatttacatgagatgtgttaatgtgtcattgacatgttactaacatgttattaacatccatccctacratgttcacattaagaaaaaaaaaacagtggctttcagtgcagggaactggattcgtagcctcactaaagtattttttaagggatttaaatacctgtacctgactccccaagactacaccagaatcagctccctgaactccgtccactgtaaacacatcgaggaaggaggagagtccaggtaaataacttatcaggtagctccttarttttgctcrtggttaatttcagctgtcttctttcctcggggcttgtggcgatattttccagtggggtggtggtgtttgtatgatgggaaccaatgcctgttgggggcactgatgccttaaacatttgttaaactctccaaggtgagtccatccttgtcattctaaaatgagtgactcctttcacaaaaaatagcacgtcatgtagggagaatgagattggattctcgtgaatctcctaggagccgcaggctcacattttgtgaccaaactgatgcagcggtgacttggcaaactgggaaggtatgggtggggcagagagaggtctgttcttcgagagcattcaaaggctactatcttttccaggacaagttatgtttttctcagtgggattaactgactcaggatttcctagactgggttttttgcaatgttagtgacaagctggggggaaattccatagtcagatgagtttgggaaacactgggttaaatgagatctcataaacatctttattgcagaccttcttagtacctgtagcatgctgtattagtcagcgttctccagagggacaggactagtaggatatatgtatatatgaaagggactttattaaggagaattgactcacatgatcataaggtgaagtcccatgataggctgtctgcaagctgaggagcaaggaagccagtagtggctcggtctgagtctaaaagcctcaaaagtagggaagccaatagtgcagccttcagtggccaaaggcctgagggcccctggcaaaccactggcgtgagtccaagagtccaaaggccgaagaacctggagtctgatgtttgagggcaggaagcttccagcatgtgagaaagatgaaagccaraagactcagcaaggcagcttactccaccttctttcacctgctttttctagccgcgctggcagctggatgactggatggtgcgcacccacattgaggatgggtcttcctctcccagtccactgactcaaatgttaatctcctctagcaacaccctcaaagacacacccagaaacagtactttgcatcctaaagttgacacttaatattaaccatcacacatgctaaagtgcattgtgaatctctaacagaggctggcgggacagtgtttctcattatgtggccctggaatttttgattgattgattgtgaaygggtttcctctgtgtacccccatctctctgtagaccgttggaggaatatgggccgagggtsatatttcactgagacagcccctgaacaggcagatatctttggttgtataaaccaaaaagtatctgagacaggtctcaatcaattgagaagtttattttgccaaggttagggacacatccagaagcaaagaacacggaatcatagaaaccgtctgtggcgtgtrcctttcttcaaagatgatttggagggcttcaktatttaaaggagaaaagcaggctggaggggaaagagggaagttctggtaatcacatgttgcaggagaaaaggcgcakgcaggggaagtcagttatgtattcttcctgcgctcagtaagtcagcactttctataagataaggtggacatagaggaactacctgtggagatatttcagcttttatctgtatctatctgcttactaaagaaacaaaaggaaaggcagcttgcacaactcagcttcagcttaaattgttccttttggcattgtgaatcgtggtcctagtttttattttcctttcacagatgggagcagtgtgatgatttatttatttatttgagacagaatcccgctctgtcacccaggctggagtgcagtggtgtaatcttggctcactgcaacctccacttcccaggttcaagcgattcttctgcctcagcttcccaagtagctgggattacaggcgtgcaccaccacgcccagctaacttttgtatttttagtagagatggggtttcgccatattggccaggctggtctcaaactcctgacctcaagtaatctgcccgcctcgtcctcccaaactgctgggattacagagcagggtgatgattgttgatgctgcacttgcccttttagaaatcttagcactcattttgagggttctagatgccaatttcattttgcctctggatgctttgtctgcttccaatctctcaccttgctgcccagtcagtcccttcttgggaaatgcatccaccttggattttttggggctagagcccagcctttaacctgtgcttgcttttgaagatacatgatcacggatatcatcrggaaggatgatggcttgggcgtggagaatctgaggggctcaggcatgattgctggggagtcctctctggcttacgaagagatcgtcaccattagcttggtgagtcttcttctattttctcttacttttcaactttccattatagaaactttaaaattgtcacaaaattagagagaatcaataataagccccatgtgcccgtcacatacctcctacagttaccacatgccagcccactgatatttcctcaatctcacccccatcccctgcacctgttttagagtattttaaagccagcccccatcatgtcttttcatccataaatacgtaagggtagatctttaacagataatgactctcaccctcttcccccrgtttttaaaaacataactgaaatactaatattacacccaacagaatcagcaatatcattgaaacccagtgtggtttaacagttatctcaaaatacccttttctagtggtttgtttgaatcagggtccaatctcatcttattttcaaggtactgaatgtttagaagaacttttctctgactttaactggcatataaggagtagtccccatcccatccccatggcctttccaaaaatgttttctgtttctagtagtagtactactgtagtagtagtagtagtactagtagtaattctagtactagcagtggtggtagtagtggtggtggtagtagtagtagtggtagtagtgtttgtggtggtgaatctgtatgggtctaaggcagagtgagagaccgaggcaagtytctcagcaggagtgaaagtttattaaaaagttttaaagcaagaatgaaatgaagtacacttggaagagggccaaacaaggcaacctgagagatccaagtgcctcatccaacccttttgaggttttatgcattggcatgattccagggtttgtgtttcttctcccctgattcttcccttggggtgggctgtctgcatgcacgtggtctgccagcacttaggaggggccgcatgaacagtgtgtttactgaagttgtgtgcatgctcacttgaggctttcctcctttaccagtcgagtgttcctagaagaagggcacggtaccagataaactctgccatcttacctcttagcatgcatgcttgagcccacccacccagctcctgagatcttatggggaagctgcttatcactagcttcaggtgttttctatctatcaggagattgcctttccctggagscagctgtgaccaatattaattttagagagacactttagcaactgcctaactatcacctgatggttgccttcctctcctgccctgctcatgtctgcttaactacctactctaacagcagcagcagcaggaataatagtactctttaatgataaactgccttggaaggccttatttgtacatgcaatgttgaatcttcagtttccaagtggaaaatgttggtcataagcatcttccttgggcttgttttctagattatatgtatagtctttttattttgaagtcatctaggacccaccgtaagttataagatactacagagaatttccaagtacccttcacccagcttyccctatggtacttacataaccgtagtacattatcgaaaccaggaaactgacattggcacaatattgttaactcagtacagaccttattttgaatttcaccagtttttacatgcactcctaggtgtccttttggttgttaagaggctgcaatggcccatgaatgcccaggctcagaagagctgcacacaagcctcttaaaatctgaaacattcactgtctgctgcttgtctttacagcaatctttgttaaccatgttatttccagataggaatccaagctcaataaagtggcctgaagaatargcttttgcctctactgtggtttggctccaaatygggttgccattggtcaaaacataacttccatttggtcccagcaggttcctggactcttccctgctgtggggggtgggtccctcgccactctccagaattcagagggggtcctctctccacaggtgacctgccgagccattgggattggggcctacttggtgaggctgggccagcgagtgatccaggtggagaattcccacatcatcctcacaggagcaagtgctctcaacaaggtgaccaaaaaggggcctgtgcagagtggatccttgggggccaggagtcattttaacattcccattggtctytggtgggggatttttctcaatatgaagccagtttcattcctactgatacaagagctctttttttccaatttgcagctatctgggtccttatgagaaaaaaaaaattagttttaggcaattctggtcgatctaactccctgtattactgacattttaaaacaaattattgaagtgccattacacattgcagaaaattagaaaaggaaccccccaaaaaagtaattttgcagcttctatcattctggtatagttccctctcatcttctgtctttatgtggttwatttatagtgaatatgcagttttgtattctacttttttcactgtattaaaacattttccttgttgaaaagtctctatacttaatgtctgctcaaatctcagccaaagtctcaaagcctggttcttgaaccaacagcatcagcatcagatgggaacttgtcagaaatgcacatcctcaagccctgctgcagacctgctgaatcagaaacactagctagggttttgcttttgagatggtcaaggtagaagtcagctgcatcaccagttctcaaattggcctgcatattggaattatctagaaactaaaaaacaaacaaaacacaaaaactaattcctcgaagattctgatataattggtctggatgtagcctgagcatcaggatttgtgaaatctcctgggtgattctaatgtgtagccaggattgagaagcactgagatgatttccaaacaggtggtagagccctgcaccgtgcaggacattgctaaccatgttgtgtcaaagcaggtcctgggaagagaggtctacacatccaacaaccagctgggtggcgttcagatcatgcattacaatggtgtctcccacatcaccgtgccagatgactttgagggggtttataccatcctggagtggctgtcctatatgccaaaggtgcagtactccccctgcagcttagaacctggaaractcttattaagctcattggctaattctgtccctgtcacctcctgggtggtgtgggaggctgaggagcaggaagcactgcacatgtggctggggttgatttttcttactccttcttccttctctgatgcccagccctgtactaggtgtcctttgctcttttggtggcactaatgccattgtaaggatgctatctgttaatcctttagaaagaggtagtattgcctcttgacaagaggcagcattggacaatactgagtctttaagctttacagtcaggctggatttgattcctgccttcctcctcggtagctgtaagacactgggagagtccctaagtttttctgagcctgtttcctcatctgtgaaatgagaataataatagcacctaactcatggtgttatcatgatgattaagtgaagtgatatttaaagcacaacgtttggtaggtcctcaccaaagtaagaaggggacaatcgtgggcacagttcttggttaactgtaacattccttacaaatgagtgaggttgtcattcttcattataaccatttctgagaggttgggtttacagagttcaggtcattccagatcttctgccaagaaccccaagtcacaaatgtcagtttgtattcccaagtgccccttttccccatctgcatgccatctgttaccaytctctgcaaccaatctctttttctttcttttaagatgtttttcctcctatctgaccatatatagcagtagcaaccctttcctgcgtttctgtaacttcccagcatcagtgacaccatctgaaccgggaagcacactcaggagttcataaactagatttcagaagaatccatgggatggccagtccttatctggcattttccaatcagagcagtggcttcaggagccctagggaggggatattgctgcataaccaggcataatcatagtcagaggagcaaagtgctgatcagaggtattattgacaagcaccacagactragtcagagacttggctttcttttttaggataatcacagccctgtccctatcatcacacccaytgaccccattgacagagaaattgaattcctcccatccagagctccctacgacccccggtggatgcttgcaggaaggcctcacccaagtaagttctaaagtattttgcctaggacctggtctcgggtttctttctagggcttgagacaaaggagcactttgtctcaagcgcttgagacaaaggcttgatattcgttctcatatcccagagaggtatacctgaaatcaaatgcagggaaagtagagaaatggagattttactctaggcttttcctgagccattgaccaagaaggggtggaaacagcctccagtttctggagctaatagatggaggtggggtgcaatggtggtcctggtctccctcccctgatgctccatgctcygtggtctctaactgccccactgtctcatcagtagaaaattcagtgctgaaacatcagagtttcaaagagaagactgcatctttctctttctttctctcttacaaaggaactctgtgagtttacacaggataggcaatctggtctcctcttctttttttttttttgagacagtgttgctctgtcgcccaggctggagtgcagtggcgcgatcttggcttactgcaatctctacctcctgggttcaagtgattctcctgactcagtctaccgagtagctgggattacaggtgcctgccaccacacccagctaatttttgtatttttagtagaggcggagtttcaccatgttggccaggctggtcttgaacacrtgacctcaagtgatctgcctgcctcagcctcccaaagtgctggaattacagacatgagccaccatgcctggccaattttacctcttctatacctacacacacacacacacacacacgcacgtggacacgtgaacacacatgcacatgcacacacatttttgcacacacacattctctctctgaaagggatgagtttctctcttggaggtatattatttcagtctgagcamccagaacacaacaggaaagttgagctgctcccgtcactatatcccaaatctagaatttcacatgctgctacctttagacttggctgctccttggctgtgcaatgcaggagaggtgaccctcgggagtgtgctagactccagccagtgcaaggagtcctgtggcttccttctcttgcttttcatttctcttgggctttctggcctgtaaacactgagggggctgcttatctcaattaaaaaatgttcggcttctcactgtcaggccagtcctcggcagatgctgaagctgtgctgttgcatgcctgggtgccgggcctcccatgcctgagatgcctcttactctggctgccccctcctggtcagagccacagccatttacgctgttgcatggatttaagtcatcatttcttccccaccaatggctgtcattgacatcatcatattctctctctgtctctctgggaaattgaaacttttttcccaattaagtggttatgaagctgcagccagcagctagcaggtgagggatgagtttttcgggaaaggtggtcccttcctaaaatcccaccttctggaggtgtctgtccactctctgcatcttaggaagagaaggcagagaccatgattagaatctatgtgtttggagttggctggctgttgatggtagtcacatattccatacagactgaattcttgacttggtatatttattgcagccctgtttgtcttttgaggcattttgggaaggagggaaggggttgggctgtgtggttttaggtagaaaggggtatctgggctatgaggttaaagccaggctgtccttagggagcttttgcacagccaggagtgtcctgggggcccccagccacctggccctccagcctgggcttctgcccttctgtccacagctctgaagggaacgtggcagagcggattctttgaccayggcagtttcaaggaaatcatggcaccctgggcgcagaccgtggtgacaggacgagcaaggtaatcatgaagacgggagcaggctgcccatgtctgactcaccaggcattggggccccgaggtgtgaggccagggacctccaggggcaattttcttcttggcctcaggattttctaaaagaaaaaaccaatttggggaatgatttctgcagtgtctgtgtgtgcccttagaaggtatctcagccagcckcctcctgaggcctgggaccctgtagtcagtccccaggccacaagggctaacaacccctttgggcatcagaaggtggccttgggtgctctmcccagaaaacttcacagacactggcactctgaattccatcttargagagccatggacaggagccctgttgtatgccactgttggtgggaggctgcaatgcttgcatgctttccaagctgggcagctcacccttcagccttgtagctttcatctctttggacagctccacctgcctgaaagttcctccttataatgagccccgagctccctcctcatcatttaccactcattcctggtacgatgtcgcagctataagtccaggctctgcattagacctgaggccaagccccatctccatcactcaccctctctggtccttcacatctgtaaaatagggataataattctaccccaaaggattattgtgatgattagatgcaataacatgtgtgaaatatttaaaatcgacatactccataagtgggaatggctgctatcatttacatcttcggcaataaatactaaagtgcagccagggccgggcgtggcagctcacacctgtaatcccagcacgttgggaggccaaggcgggtggatcacctgcagtcaggagttcgagaccagcctggccaacatggygaaaccccgtctctactgaaaatacaaaaattagctgggcgtggtggcaggcacctgtaatcccagctactcggggggctgaagcagcagaattgcttgaacccagaaggtggatgttgcagtgagccgagattgcgccattgcactccagcctgggtgacagagcgagactccatcttcmaaataaataaaataaaataaattatatttttaaaagcaaaaaataaaaaaaaaaaaatccactccttcttccatgtgaaaacactttgatttgaagactgctctcccccacccctgcatcatagggtaaacgagaaccatgtagtgatgcacagttcagtagcaagtaactgatgtcatggcatcccctgagctgagtctctgtccagttcaatatccctcagccctttccaagtgcaacttgatgtctagaccagtgtagtagctgctggctacatgtgatgctttagtttcattattattattattattttgagacaaggtcttgctctgtcacccaggctggagtgcagaggcatgatcgctgttcactgcagccttgacctcctgggctcaagcaatcctcccacctcagcctcccaagtagctgggactagaggtgtgcgccaccacacctagccagtttttttattttttgcagatacagggtctcactatgctgtccaggctggtctcaaactcctggactcaagcaatcctcctgcttcagactctcaaagtgctgggattacaggcataagccaccatgcccggctccttcagtttaaattgaactaagtcaaagtgacagaggatgacctgttccattcctcacacttgccacgttccacgtgcagcccacagctcctgtattggacagtgcagatggagaacgtggccctcgtcacagaaagttctagtggttcatgctgctccaggccctataccatcccagccctcctctgatggttcttgcctcaaaaagggcaccrataggtctgctacctttcgaggctcttaccatttgggggctttttctttgccttccaataaaataatccgccagattaaaaagagcattctcctccacgtgccctcacccccacacccagaggtccccaaatgcacctggggtgctgcccagggcctggctcactggtgctcattttccaggcttggggggattcccgtgggagtgattgctgtggagacacggactgtggaggtggcagtccctgcagaccctgccaacctggattctgaggccaaggtgagggggccgggagctgtggctgctggtttagccagcggtactgtcgagagtgggtcctgggcrtgggggtcccatccctgccctgccaacttaggtggagaagcaggggacccagtgcagtccctggccctggggggctcagtgcctgtttctctgacactttctctatgggttgcataaatggctgcaccatcttgcttcttcctcagcagatgataaaggtccctagaaacccctcccacctcctgccctgcctctgttgctgtttctgcgctaggccagggcacagactgagaagagctcaggagtcaagagggctgggttccagggccggctttaccccaactcagtgtgaccttgacgagcttggcacccctcggagcctgtaaaggagggcaacgggaaccttgctgggctgcaatgggagggtcagcctggtcctgagcggaggagatggggcttccatccttctgagccctggctctggtgctggggccagcacagatcagatcgcctgccatccagagcgaggttctggcagccgtccctctgtcctgggttgtggttgtgcagagacatctgatccccgcagctctgtgttccagataattcagcaggcaggacaggtgtggttcccagactcagcctacaaaacygcccaggccrtcaaggacttcaaccgggagaagttgcccctgatgatctttgccaactggagggggttctccggtggcatgaaaggtaagcccctccctgcctatgttaccccaaagccttggggtcagcacccaggacagcaccctctgggtggtgatgctaatgtcstagtctgtgcccatcatcatcttagctgtgtctcccaacaaccctgaggagaaaatattgttcaggtgccccactaccccgttttaaagatgaggaactgctgggcacagtggcagacacctgtaatcccggtgctttgggaggccaaggcagaaagatcatttgaggccaggagtttgagaccagcctggggcagtatagcaagaccctgtctctacaaaaaaacaaaataaatgtttaaaaaattagctgggcatggtggcacatgcctattgtcccagctatttgggaggctgaggtgggaggattgcttgagcccaggaggttgaggctgtactccagcctgggcaacggagtgagacccccatctcaaaaaaaaaaacaaaaaaacaaaaaaaaaacaatgaggaactgagggttggaggcaaagtgtcactttctagaggtcacaccatgaggtgcaggtcagggaggggcagccccaggagctgccgggtgacctgggcaggcacctccccatttggcaaggtgaggaggatgtttgtccacccttccctctgcagaaagctgctctgagcctcatgtgaccttacaattgtgtgagggctttttaagccaccaagcatgttttgggagagagtggctgttggatcactggggtgttgaggacagagctggatgggaggcagacagacctgctgtgagtccttgttaactgggtgacatcactgagcctcagtttccctcctttgtaaaagggggttaagaacaggaccaacctcagagggccgaggtaagrgtctgatgagctaattgctgacatgcagtgtgattgtcagtgctgttattattgcattcttgttttcatgtagggtgcctggggacctggagagatgtgtcttggtggaagataagggccatgttgcccatgcacattggggaaggatcagtgtgactgttagtgagggttttctttgctggaaatggtggggcagggcagggacagtcatgggtgagggcatttcaattccagttggaaagaatcctagagattggtttttccctgtgccttcacagatgaggccactgaggcccacactgggtgaatgacctgttcgaggtcacacagccacttagagagtgatcagtactctcaaatcccagcccagtgctctccaagcctctcagctgggctcactctcccaggacccccaggacaactagggcagtgggtttcatgtgtggatgagtgagggccctgaactgggaggctgctttgcttttcagacatgtatgaccaggtgctgaagtttggagcctacatcgtggacggccttagacaatacaaacagcccatcctgatctatatcccgccctatgcggagctccggggaggctcctgggtggtcatagatgccaccatcaaccckctgtgcatagaaatgtatgcagacaaagagagcaggtgggtgtgttgcccttagcctggcttagccttttcttgttctcccagccttgagagcccatgaccttgggagatcatggagggatgcagtggctggaacctgwaagtggtggagaaatgttgtctcttctttcatggtttccacttccccttcccaaggaagtttgcaatcaaaaaataaaaaggaaagaccaaaagcacttgaacttcctggcagccaggatgaaaagggaaatatgatgagccatttatctctcattagactctgagctatgagttcctataggaaatgttttattcagttttatatcccagggtctagcacagtgccttactctcctggtaggtggtcagaaaatactggctaaacaaatgactgaatgaatacttgcatgagaggataccggttcttcgcgggagaggtaacctccttggcactttccttaggaggaatttattccagagatkcttacagaaaggatgatgacaatmatgttcacagcacagtgactgatgactttgaagtgaaaactacatgmtacacaggatgtcaaggcctcaagagtcattctactccaaatataggcacggcattcctgtgttcactccctcattcatttgctaattcaatgaatatccattgattacctcactgtatgccagccattctggtagacattatgatatggtggcaaatgggccaagcttgtcctgcattcagggcacttagacccttgttagggactgctgaggtcagtcctccaggaagactcaggatactgagcagcacttgaatggagtcattgctaacttttcatgctggccaccaggaagctcagagctactgatagcattcttcagggcttctaagctgtcaaaagcaaaagggggcagggggagaataaggggtaaataaaaatgttggaaatgaggccaggcgtggtggctcacgcctgtaatcccagcattttgggaggctaagggsggcagatcacttgagrccaggagttcaagaccagcctggccaacacagtgaaaccccgtctctactaaaaatacaaaaattagctgggcatggtggtacacgcctgtaatccaagctgctcggggggctgaggcaggakaatcacttgaacccgggaggcagagattgyagtgaaccgagatagtgccactgcactccagcctgggtgacagagtgagaccctgtctaaaaaaaaaacaaaaaaaaaaaaaaagaaagaaaagaaaatgtatgttggaaatgggaggacagctcacrcaagactacactgggctctcaaggtgcttttgtgagatttaaagcgatcagaaacagtgcccctcctctaggagggcagaaattagcaaagttagagaggactgtggctggagagcaggagggttatgctgccatggaaaaagtcgtacactcttaracctgaaaggggccctccagagttcagaaagcattattttaaacagttggctcagtctttccatctgtgggtaaagatacagaggcccagagagggaaagtgacttgtctaagggcacacagcatgtgtgggggtaaaagagctgaggactgacacccagatcttctggctctcttccctccagctccccccacatccattagcccttgcttgctgggcaatgcctcatatacccccatccctgcctcttctcttttaaggggtggtgttctggaaccagaggggacagtggagattaagttccgaaagaaagatctgataaagtccatgagaaggatcgatccagcttacaagaagctcatggaacagctaggtaagggggtcccaaaggcttcacctctcagaggtcaagagaggcccagctggcccactgctgggggtttctaggatgttmaaaataaaatgaaaaaataccaaaatacagctataataactgtgagatttttaaagatattcacatttgtctgtttgttttgttttgtttttttgaggtctggctctattgcctaggctggagtgcagggtgcaatctcagctcactgcaacctctgcctcccaggcataagccatcctcccatctcagcctgagtagctgggactacaagtaygcaacaccatgcctagctaatttttgtatttttgtagatgtggggtttcrccatgttgcccaggctgttctcaaactcctgggctcaagcaatccacctacctcagcctcccaaaatgctggggttacaggcatgagctaccatgattggaggacattcacatttctaaatcaacctttttaacattttatatatatatatatatatatatatatatatatatatatatatatatatattgccatcgtgaatttatttctcagcatacacaaaagatagcaattgaagtatttggggctgatggggattatcagaattttggtggcaaaatgttcctttagaattcccaatcagagataagatattttactaattttgtttgaatgacagctttgttttacttgtcatctttagatgtaattatctttatttatttatttgtttatttttgagacagagtcttgctctgttgcccaggctggggtgcagtggcgcaatctcagctcactgcaacctctgcctcccaggttcaagcgattctcatgcctcagcctctcaagtagcaggaattacaggtgtgtgccaccacacctggctaatttttgtgtttttagtagagacagggtttcaccatgttggccaggctggtcttgaactcctggcctcaagtgatttgcctgcgtcagcctcccaaagtgctgggattacaggcgtgagccactaagtctggccacaagatgatatttaaatatccattttaagtgtcagtgtctttataactgtgctattcacaagattttttacagtgtgtgcgtgtaatttctttggctggtatcagggtaatgctgatctcatagaatgagttgaagtgttcgctcctattttctgagtttttgcagaattggcattatttctttatgtttttgatagaggtttttacctataaattcaacttctttgttatatataggactatttgtgttatctgtttcctcctaggtgagctttggtggtttgtgtgtttcaaggaatttgtctatttcatcttaagttgtcaatttggcatagagttgcttataatattcccttatcatattttacaatgtgtactaaaaatcattgatatagtatcctacaagcacgatgggtctgatggaaggggaaaatgtagagttgcatgttgaatgctgtcttgcaattgtgagtgcatttctgagactgtactagctatttgatctgagacaaagggggccatcaagatgggcctggggtgggggccaggccagtggactctgggggacctagggggctgagggcagcctgtgtagcagcaggggtaatatcagagttaaagctcagacctctcacaaggcaaggcctgtcctgcaaatcctgatttgtgccttcttcaaaaaaaaaaaaaatctccaccccatcacatatgaccagcttccatggcttgactggcctttctgctcacctgcaggggaacctgatctctccgacaaggaccgaaaggacctggagggccggctaaaggctcgcgaggacctgctgctccccatctaccaccaggtggcggtgcagttcgccgacttccatgacacacccggccggatgctggagaagggcgtcatatctgtgagagccacagctgccgtgtagggtgcaaagagcccaccctgttttccaaaacatggaggacatttgggctcgggggcggggagggcggtggtggttgggatgggtcaaatgctgcaggaggtgggagtcacctgggaactttaaaataatcccgatccccaggtggcactgcagaccagtgaaatccaaacacctggatggaagccaggcggtcgtattttttaaagatccccaagagattctaataagcagcaaagttcagggaccactagtctgatggctcggtcagtttggacctggaccaggggtagaaaccgttgttcctgtccagcattcacccacccctcaccattgcaaggactcccacagtcacctcctacccatgtccagtgctcattggttctcttgctgcattgttctccctcccagctgactcatgcctcacacgagcctgtgtttgtgtcggttgaggtagaagtgggtgccaggtttttatgggggacattttttcaactatggccagtctggagtcctggtgacrtcctgcctctgagcaggtgccttctcctccctgagcctcagcttacttgcctgggatgatctgggaatgatctcagagcctgggcccagccccgggcagccactgtcatgggtgtggtcagagccagtgtcccgtctcctccttccctttccggggattcaagcctggctcgtccacaggacatcctggagtggaagaccgcacgcaccttcctgtattggcgtctgcgccgcctcctcctggaggaccaggtcaagcaggagatcctgcaggccagcggggagctgagtcacgtgcatatccagtccatgctgcgtcgctggttcgtggagacggagggggctgtcaaggtgggcctggggtgagaacgaggccggtgagcacagggggtgctgggggctgagacagctggcccacagctgggtccctctctgaggcatcctctgccccctccccaggcctacttgtgggacaacaaccaggtggttgtgcagtggctggaacagcactggcaggcaggggatggcccgcgctccaccatccgtgagaacatcacgtacctgaagcacgactctgtcctcaagaccatccgagggtgagtggccaccgcacctgcttcccagcctcctggcaaggacccgagcctggattgacccctagctacccgactcctatgcagccacttgaacccgccaccctgtgcagtctggggttgtccccrccccctccccgctccccagcaaagagaccacactccctaatgtcgggtctcccagcacagtggctggggtgggacagagagcctagaggtactctgaaggccgtgtgagatgcttccaactcatgaaccttgctggaatatggacttgtccaaagtcacagctggagcagggttggtcacagaacccacatttggaaccgctagccttcaggctgctgtcttccacgccagtgttgacctttccagagggtcccctcccccaattgccatggggtcaccccgtgaaggagggagtcgagcacaggggaccccattttggggatgaagctgagactcaaggcagtgtcttgtctcaggtcatgtcacaaagcagtgaccagtagggacggtggtgcctcaaggcattctgaacttcaggtcacagcccctcctgctgcacaggaccatcacccccatggggaccacagcagggactcgggagctctgggttctggggtgtggccccacacaaggactctgccacccttggggccactgaaaaagtggctggagtgatcccagccctcctctcacctcccccacagcctggttgaagaaaaccccgaggtggccgtggactgtgtgatatacctgagccagcacatcagcccagctgagcgggcgcaggtcgttcacctgctgtctaccatggacagcccggcctccacctgaccgtggcccrcccagccactcccgggaccacggcaaaaggaaccacccagacccaccacccgtacaccctcagcagaccctgaagacttgcttttaaacaaagaaaatcctgggcacttctgcagggctgctggttccgagctgacacccgtcttaayaaaaggcccaggagtgcctcttccaaacaaaaacagcctcctctccatagctgggaagtttattttgttttgtctctgaagacagcagttttattgcatcactaaatctaatcaagctaaaacatccctgtttccttttgcaaaacagtgcctggcatgtgggatccaggcgttctttaggatccttggataccacatcgtgaaatcttttatttttttactctgagaccagcaccagatgtaagtaagcatctcatatatttcagccaaataaatgggccaagggaaaaaaatatatatatatagacaggactagagaaaacctatttttgtaatgatgtttctttggatactgtctagtcacccagaaaaatgtatggatgaattttttttttttttttttgagacaaagtctcactgtgtcatgcaggctggagtgcagtggcatgatctcactgcaacctccatctcctgtctcagcctcctagataactgggattacaggtgcccaccaccatgcccggctaatttttgtatttttggtagagacagagtttcaccaggttggtcaggctggtctcaaactcttgacttcaggtaatccacccaccttggcctcccaaagtgmtgggattacaggcatgagccaccatcttcagccagatgatttttttattgagagagtgaaatgctattttgttccccaaatggcgctagtgaatcactaggagggtcccactgataggccatgtttagcactggttgccagggattctctttttgagagagggaaagcaaaatgaatggaagtacccagctggaggtttcagggcttctggaggatgctctcgcatagctcgaggtcctctgcccacctcttctctccaaggaaaatgaggactgccccttccccctgcaggattggcccccagcctgcgcatgcaccctcctcttgcccaagtggggagcacagaggcggagaggaatcccttaccacacccacggcccagcttgctcacgagtgtcacctctgtgacggtcaccactgctcccttggagggccacttgagttactgttgcttcctcgcctgctggcttgatgagcaccgatggtgggatctgaccccgaggggcagagctgtcggtgactgaggactggactgtggtgaccatgccgatttgctcagggagaacgttgcaatgcacccagcagctcctggctctgcaggcggcacagcctggggccctgtgatcctctggtttcttccaytggggcggagtcggggrtggagggagctggccacaacccactgctctgatgggtggtttgtccaargatgctgaatgtaatgcctggtcaatgtggaagcccatgaggttgcccagggaagcctccaaaagctgggatgcttgagggtatccaagttgaaaaagacaaaatctgaccatcagccagtgacagtcctggcaaatgaaggtggggcggggcagtgaggggtgggagaaggtgaatgattcattattccaccccgaggtttgctggggtgaggggaagaatcgatgctgctttgggaactgaaggtttttctgttgggaaggccctcttggttttggagagaaagacaagttatgagtagctgctaccctggaacggtgggcagagagcctactaggaaatgtgcagaataaactattttttgaaggaaacactttggccttgactttattatctggattggagaaggcaggttgcctccaggagcaaaggtaggcgttcacctttgcaccctccattcctgacaccacagctgagaccttgagtgagttcccatcacaggggcagacggggatgcagtgaaggaagctgaaggctagactgaaatggacaaagtcatccctttttgaaagcactggggaaaaatgttttagaaaattatatgcaagcctagtctataccacaggcaaaaagggagcttctctggaagaaggggttgggggttggcccaggcacttcacgtgcgagttccattcctttccaccaccttgatccacccctgttgtgcagatgaggaagctgaggcacagagaggtgaaggcatttgtccatggttatgcagagacggaatcaagtctgcttggctccagaacccagccctttccttttatgacctaggtccttggtgggcaggcttaagccacacttaggagttggttttacatggacccaaactgcagaagaaccccctacccgccccccaccgtggcttctcagcacacagtgactattcaattttgtctccaaaacacgtaacaacaactgttaccttgattctgcctgacaccttttccaggcaattccccctcaccagggatgggccaatcagagttctccattccccctgacagtgactgacgcaggtatgggcgtgtatccccagtagagccgatcagaattctttagggatggctgacagtgctgatgtggagagaacctaccaatgcagggggaagccaagcccagagatagagggggagatccagtcctgttggtggtacttggatgcctggatcaagccatgcctgaagtcagtagcccagtcccaggaacctatccatggtttttgtttgtttgttttaatgtttgcaytagtttgagttggagctctatccttagccctggagatggcccagttagcccagaagacagcagttaatttccacccacagcagcacctaatggtggtctgtatcagcagaccctccaggyagggaggcgaggacctgagaacaagctgaaatgcagccctctgggatggggaggaggaagctctgatttggttttgcatcctgaagactacaggtcaattgtttgttttcatccggatttgaaacccggacacaagttgctatctgctgctaaggatgctggagtttactctgtggacatcagctgaaagtgctttctctgacaaggctaacttttctcccttgaaggacttagtgtagccagtcacaaggggaagggagaaaggatcagacaactgagtgtggacagaggtcttgttgggcaggttgggtgctaactgaacactccctacgatggccactggtcacgtgccaggttctggcctctttccacacaatcctcatgtgacccttggaggtggctgctacatacactctatcctcattttttttttttatgagacagggtctcgctctgttgcccaggctggagtccagtgatgtgatttcagctcactgcagcctcaacctcccaggcacaaataatcctcccacctcagcctcccgagtagctgggactacaggcatgcaccaccatgcccagctagcttttttggtttttgtagagacagggtctatctatgttgtccaggctggtctcaaactcctggcctcaagcgatcctcccacttcagcatcctggagtgctagaattagaggtgtgagctgctatacccagcttctatcctcatttttatagaagagaaaacccaggctcagagatgagcagacttctccaagtgcacatagcaggtaaaaggaggggccaggctaggaacccaggctggctcagacccaatccccctgggcttaatgcctttccgtaaatcctgaacctttgcaagggttagatcccraaacatgagagcatcctgtagaccaagctccactcctcctgcctccctgacttcctggctaattcagccaatggcatcattcagatcctcatcaaaagcctcatgctctccatgccaagagcccacactagggtgggctgccctctttcccgattggcagatttttcagcccttgattggcagattctgtagcccctaaaccactcagaggaacctcacatttctgcatgcacagtgggctcctccacatcacaaatgtaaatgtggactgggttatccccatttctactcctttctttggcctccccaattgattattttatttattatcttgttattttgccttcctctgctccaaaagtcagttggccttttttctcagggtcattcttttcccctaacrttttactatgaaaatttccaaatgccaaaaagtcaaaatatttcatagcactcaccccaacccaccatcttgatgccaccattgacatctgactgtgcttgtaccttctttaacaccattctctccatctgtccatctctctgtgaatgcatgttattattttgtcacatttcagagyaaattgcagacattaatacatttctccagagttatttttgcatttcaaaaccagttgtttgttttgtaaatcacttcctgagcttttttgcagctgagagcacatccagatcaacagagctgtgttgagacgaagcagccagccgcgtggccagagagggagctccagttctcacagtgcacacagcaccagaaaaacgctttttttccattattttatgagcatatgccacaggctgagcactgtgagagggtgctgccatgagcaaggcaagccactcctgcccttggggactgatatcctggggttcccaacaggtagaaattgcaagtggctaaccataaggagatgtttagggtcacgactagtcaaaacagtgactgttaaatccagaaatgtccagggtccacttttcagagttcttgtgacaggaacgtgatagagaagagaacaaggaccatccacacaggccacagaaaggttctgaatgaccaccacgcacagcaaagcctccctatggcttctgctaactcaaccagtgtggacaaatcagccctcttctgggcactggccgtgcagccgatgcaccgagccacgctgcttgacgtccagacagatctgccgaaaatgccacttccttgtactaagtgcccttgggacaaaagtatcactcaatcccataagacatggcatgagtcctggggcccaacttcagctatgcgagagcatcttgttactaccgtgaaccaaccagtctaaactgtcagttcacctccaggtgagcactggctgtttctcctggggaacctcttcccccttggcctttgtctggctgactcctactcatccctcaaaacccaactcaaatggcacttcccccaggcagccttctttgaccacctctcccatgggttgggagccctcctctgtgctctgacagcccctgttctctctcttttgtgcaacatatgtgaaacagatttctaactaaaacacacagctagggatccctaggtgtttcyggttgctgaaccagggctggattttggagaacagtctgctgacagagaggtggtcctctcctgggaggggaggtgagaggatgctcctgakgatgttctgtattttgtaataccctgaccaacgcggtatgtctctggatggaatactgtgtaggaaacacaggcaaagagcctacatgtttttttgtttttgtttttttgagacagagtcttgctctgtcgcccaggctggagttcagtggtgcaatcttagcacaccacaatctctgccacctgggttcaagcgattctccaccctcagcctcccaagtagctgggattacaggcacatgccaccatgcctggctaacttttgtatctttagtagagacggggttttgccctgttggccaggctggtcttgaacccctgacctcaagtgatccacctacctccacctcccaaagtgctgggattataggtgtgagccaccacacctggtctagtattttgtattttgtatatttttattgtggtaaaatatacataagaaaatcttaaccatttttaagcgtatagttcagtagtgttaagcgcgtccacactgctgtgcagtccatctccagaatgcttttcatcttgcaagagtgaagctctgtaccattaaacactaactccccactcccctcccctcccagcccctggcaaccaccattctactttctgtgtctatgaatttgactactctaggtacctcatgtaagtggaatcatatagtatttgtcctctttgtgactggcttatcccacttagcataatgtccttagggttcatccatgtttagcatgggtcagaatttccttcctttttaaggctgaataatactccattgcgtggctagagcacagtttatgtatccacgcatccatcagtgaattacttggtggcttccaccttttggtggttgtgaatactgctgctatgaaaatgggggtacagagtcaggtgcagtggctcgcacctataatcccagcactttaggaggctgaggcgggtggatcacctgaggtcaggagttcaagaccagcctggytaacaaggtgaaaccccatttctacaaaaaatacaaaaattagccaggtgtggtggtacgcacctgtagtcccagctactcgggaggctggggcaggagaatggcttgaacctgggaggcagaggttgcagtgagctgagatcgtaccactcactccagcctgggcaacagagcgagactacatctcagaaaaaaaaaaaaaagcaaacgggattgctggacctggcggtaattctttttaattctttgcacaatcagcatactgtttttccaacgctgctgtgccattttacattcccaccaacaatgcacaaacttccctaatttctccacatccttgcccatactatttgttttcctctttttgtttttggtttttatgtgtttgtttgataatagccatctaaggggtggagtctagaagcaattgaactcaaaagtcattgcacctttttacttgcatgcctcgatcgtcacggacgggatatatagaccccacctgtgacccggacatccaattcctctgcctcttgcttccctcgctcacccagctggccccgccccgctgcagccacgcctccctctcttctctcccacctgctccccattctgcgatgatgctgaaatccagacgcccgcagacccaggcggtggcagaactcctgggggccggtggagaaggaagcagctggccagccaggctcattctccgtgaggcggcacccaaggtactttgttcatctttccccatctcactcccactgcctgaacctttctgggagcctcctcttccctttagttgccgccagggtcacctgcaggccgcacaagtgtaaggcctttctcagttcaagtcagaggaatgttccgtgtccctagccctcgggtctgccttatctcagttcacaggcccaccctgcgatccgctcctcactctgtcttagaatcttctcacccttcccctcaccagctcccaagcgtagcaggggtgcttgtttaaaaagctcagattgactctggccctgcctcagtctctctctctctctctctctcttttttttttttttttttttgagatggagtttcactctgtcacccaggctggagcacagtggcatgatctcagctcactgcaacctccacctactgggttcaagcgattctyctgcctcagcctcctgagtagctgggattacagatgtgcaccaccacacacagctaatttttgtatttttagtagagacggggtttcatcatgttggccacgctggtctcaaactcctgaccttaagtgatcccgtcaacttggcctcccaaagtgctgggattacaggtgtgagccaccgtgcccggccatgcctcagaatcccaga

SEQ ID NO: 13263 - DNA, 57198 bp, Homo sapiens
cacttttcaaaggggatgcttccagtttttgcccattcagtatgatattggctgtgggtttgtcatagatagctcttattattttgagatacgtcccatcaatacctaatttattgacagtttttascatgaagggttgttgaattttgtcgaaggccttttctgcatctattgagataatcatgtggtttttgtctttggttctgtttatatgctggactacattttttgatttgtgtatattgaatcagccttscatcccagggatgaagcccacttgatcatggtggataagctttttgatgtgctgctggattyggtttgccagtattttattgaggatttttgcatcaatgctcatcaaggatattggtctaaaattctcttttttggttgagtctctgcctggctttggtatcaggatgatgctggcctcataaaatgagttacggagggttccctctttttctattgattggagtagtttcagaaggaatggtaccagttcctccttgtacctctggttgaattcggctgtgaatccatctggtcctggactcttttttgttggtaagctattgattattgccacaatttcagagcctgttattcgtctattcagagagtcaatttcttcctggtttagtcttgggagggtgtatgtgtcgaggaatttatacatttcttccagattttctastttatttgcatagaggtgtttgtagtattctctgatggtagtttgtatttctgtaggatcggtggtgatatccyctttatcattttttattgcgtctatttgattcttctctcttttcttctttattagtcttgctagcggtctatcaattttgttgatcctttcaaaaagcagctcctggattcattaattctttgaagggttttttgtgtctctatttccttcagttctgctctgattttagttatttcttgccttctgctagcttttgaatgtgtttgctcttgcttttctagttcttttaattgtgatggtagggtgtcaattttggatcttycctgctttctcttgwgggcattgagtgctataaatttccctctacacactgctttgaatgtgtcccagrgattctgttatgttgtgtctttgttctcattggtttcaaagaacttcttaacccaggaatacagtgaactgataagacagagccctgtcgcagaggcacaatccagtggagaagggaatgctaaccctcctgggtcaccatactcaggactcaggaaccatgtcttcctcaggtttgcattctgagaaagttctcctgcagaaacctatgcttactacatgcttgattatatttaagtaaatttgccatttttaatttaatgaaaattcaaaacatgtaagtcatttcaacatatggtatgttgctaaataaaaacctttattttaaaaataggttttaattattaataatttatattactttcctgatccacaatgwggtctagcacagaggtgttrgccattgcatgaaagataggaactgagcccctcttctctcttcagaaacttggaagcaagaaacaaaagtcagacattcatgtctttactcatctacacaaatttcatattttacctttttaaaatagctttacttatatatactctacatactatacagttcacccatttaaagaattaagtttatcctaaagctgcttccttacgtattttaaatttggcctaaaagtttctcagyatgtagtgaactgtaacctaactggatgctgaaaagactgaaacctactcttgtgccaatcacagagtttcagcatatctaaggtggtcagttgttcaaactgtgttcaaataaggcaaatgccaaattataaccaattctatttctgtacctcatttttgtcttctttacatcactttcctttttctgcccataaatctttttcaaccacgaggcagtgctggagtctctctgaacctattgcagttcagtggctgcccgatttgcacatcactctttgctcaattaagcactgttaaatttaatttgactaggtttgtcttttaacaaagatgtacagttcaatgttttttgtatgttttcaaacatacaaaagttgtgtaatgatcaccataatcaaatgtacaattttttatcatcgtccaattagcagacactaccattccctcctacccctccactctcagcctaggcaatcaaaattctctacagttatgtcactcctgaatatttcatataaatgaaatcatataatatgtcttcttctgtgactggcttctttcaattagcacaaggttttcaaggcacttccatgtgtaacatgtactttattcccttttattgccaaacaatatcctatggtatggagatatcacattttatctattcatcagttgatagatatttgacttatttctgctttggggctattatgaataatgctgctatgaattttcacgtctacatttttgtgtggacatatgttttcatttctaatgagtatatacctaggaatggaattgctgagccatatggtaactctatctatgcttagcattttgaagaattgccactgttttccaaaatggctgcactattttatattcccaccaacaatatatgagggatccaatttctccacattctggacaacacttgttactatctgactttttgattatagctatcctagtaggcctaaaatcataactarttgttcctttgagttgcattttcctgctggctaataatgttgmgtttttttatgtgtttgtctaccttctttagagaaatgtatattaagatcctttgaccatttttaatggtgtttttattatctttgtgtgtgctttattatctttatatgttctatacacaagtccttatcaggtatataatttgcaaatatctttgcacattcttggctttttcttttcactttcttgatacccttggaagtayagatgctgttaatattgatgaaatcaaattaatttacctactttttcttgtatttcttatgcttttggagttgtatctaagatggctttgcataacccaaggtaacaaaggtttactcctacgttttctatttagttttataatttttctcttaagcttgggtctatgatccattttgacttaatttttacatgtggtattataaggagtccaacttcattcttctgcatgcagatatccaattattccagtaccatttgtaataaagattactcattctgcattttttcaacccttttcaaaatctagtggctcataaatgtaagggtttagtttgtggacacaattctgttccattgatctttctatctattgctatgccagtaccacattgtcttgtttattgtaattttgcagtaaattttgaaattggtaagtttgttctttttcagaattgtcttgactattctgggcccctcgcactgctacatgtttttaggataactccattcatttctgcaataaaagcttgctgggttttgatagagattttgtttaacctgtagatcatttgaagattaatgccattgtaacgatattaaatctttcaatccaagaacatggaatgtcattccatttatttaggtctaccttatttcaacaattctttttgtttgttttcagactacaagttttagatccttttgttaaatttatttcttagggttttttttgttttgttttgttttgttggttggttggtttgttttgagatggagtctcactctgtcacccaggctggagtgcagtggcacaatctcagctcacagcaacctctacctcctgggttcaagcrattcttctgcctcagcctcctcctcctgagtagctggaactacaggcatgcaccaccacgcctggcttttttttttttttttcttttgcatttttagtagagacagggtttcacgatgttggccagcctggtctcgaatccctgaccttgtgattcacccacctcggcctcccaaagtgctgagattacaggagtgagccactacaccaggtcatttcttagtatttttactcttttgatctatagtaagtaaaattgtttttatctttgaatttttaaatttttaacacagttcaaatcagtgtgtctgatttcatctccttctctaacaaaccagggtgccagaactgcttcagtttctctgccttctctttgtctatgatgactaatgtatgaaggtatctgctgcatcaaactttaaacttcacattatccttatttctcttgaccttgacagatctggcatcttttcacctggctgtaagcagaaagtccttgatctccttaactttttgaggcatggcagcatgtgaggcagggagaggacacagacccacacagcaagtggtgagaagccaacagtggaattgttttcttaattccatttgttgattgtttattgctagtgtatagaaatacaactgatttttgtatattgatcttgtattctaaaaacttgctcaacttgtttcttagttctaatagttaattaattgattccttagggctttttaatacaagatcatgtcatctacaaatagaaattgttttactttctttctaatctggatgccatttatstttttttcttgtccaattgccctcactagaacctttagtacaaagttaaatagaaatgggragactagacattttgtcttgttcctgatcttagacataaaaacgttgtcttccgttattatgtgtgatattagttaagtttttcataaataaacttcacagtttgaggaagttcctattcctagtttgttgagtgttagcatgaaaaagtgttgaattttgtccaatagtttttaaaaawttttttagacaatcatgtaggctttgtccattttttacttctttaawtttatttttattgatacacaatagatgtacactttttaggtacatgcaataatttaatgcccctcactataaattcggagctgcctcctcgccgatgattccagcgcctgacagccaggaccccaggcagcagcgagtgacaggactttttaggtacatgcaataatttaatgcattcatataaagatcaaatcagtgcaattggcatayccatcaccttaaatatttgtcttttcttcatgctagaaacattcaagttattttctcctagctactctgaaatatacaatagattactgtaaactacagtcaccctactcacctatcwaacattaattgatttttggtaaactaatctaatcttgctttctggcatcaacctcacttgaccatggtgtatagtccctttcrtatgttattggatkcaatttgcctacattttgttgagaatttttatctatactcttaagaaatattgatctgtagtctcgtgatgtctttatctggttttgttatcagggtgatactggcctcatagcatgagttgggagatcatccttactcttctattttttggaagagtttgtgaagaattgatattatttcttctttaaatayttattgggtttttaaaatacatttttaaaatgcaacttgggtagcatgtccaataggaacaaatgagtgtccacccttgaatttcataaccctggaattaatccatgtaatctatgatccacaactgtattaccaaagttcgagttactcataggaaagagaaagaagttctctaattcgtccttaaaagttttccaagttcagaaaaaaaaaatgttgaagaacacgaatctccgcaggaaatgatactcctgtacccccagctcgctctccctcacgacccctcgctaggcggggttcgggaccmsgtgaacgctgatctgatagttgacacgggacgactgtggcatcatccttgctgccgtcartatcccgagagggaggaggttgggccgggagggtctcccggggcggggcggaggaggagggaatgcaaaacagagcctcgtccccggaacccaagaagcagcaacgcccctcactataaattcggagctgcctcctcgccaatgattccagcgcctgacagccaggaccccaggcagcagcgagtgacaggacgtctggaccggcgcgccgctagcagctctgccgggccgcggcggtgatcgatggggagcggctggagcggacccagcgagtgagggcgcacagccgggacgccgaggcggcgggcgggagaccmgcaccagcgcagccggccctcggcgggacgtgacgcagcgcccggggcgcgggtgagtccgcgcggaccgccaggcatgcttgggggacttcaagggcggggtgctaagtttcatgtcacggtgtcctaactgctggctctatactgggaagctctcggggaccaaggaaagagcgaccgtagttctggtcagcgcctgcccctggagctggccacactttcccaaatcaggtgaggggcttctggaatgggagggaacaaggtaggtttgtttgccacgtgcctcgaaattctcaatccattttaaccaaactcttccgagtgcaaggaagaaatctacagaaataagatgcaattcaataaactttcttcctgaggcttttagttaactcttgtattttagccatcatctgagcgggaagccggtatgactctgcaaggcgttcgtttaaaagttgtgctacttttgaggtgaagttaagagtgtctccatccacgccctctgcttcccagtcaatgtccctgcactgctcacgtccctttagctctctccctgcaaaccatagcggtgggtcctagacacgggacatcgctccaaccttggccaaactctcccaccctcagggttcccagatgtcctttgaataatcaaactgargaaggagaagcaagatgtctccacaccccaatccctacagccttagccaatgcatgtgtgtaactgagacagaattttagcaaaaggtctcctgcttccaggactaaacagagcctctggcaggccactgcccgacacccaactccatcctccaattttcttaaatgtccaggtaaacatctccatagtgccagcctgctatagtctcccgaagacctcagcaattcttccccaaagcgtctccttctgcaccgtttttttytttgggcaaccatttgtgacctggctattgagcccacctgggcctcttctctttgtttgctgatagcctcgttaagtattaaaaacctactcccccycttcaggagccctcttttaatgaaagtttgggtactgggatcagatttgggacttggctacatttatttcctgtgtcattctgagaagagaaagtaatagaggcaagaaatttggcaccctattgatctattttattactttgttgagcaacttgtgcttccsgctgaagatgctgcatcccaacatgattctcttattattagttaccacctgagggttttggatctccaggtgtttatttcacatagcatatgctttaacccccttataagtcttctctaaggaagaaactgccatacttcccttgtcttctcyggtgtttccctagctataaaggccccacctgcataacctgtcctcaggctgtgatgtattcccgggtgccctggtaccttctccttcctctccaccacccttcctgacagtgcaggggcaggaaagcatggggagaagggaaatggagactcccacttaacttgctgtgtgatagtaagagcattatttcacaactctgaacctcaagtctctgcccataaggttccctccagtgatataattccttaatttcttttgttttggttattgctttaaaataaaagtctaagcttaaggctaggttatagaaactgcccatcataattgctaggtctcaacatttgcttaagttttgtgattcttagtttcaagtctgttacccactctctctccccgccaccttttttccccctgacttcattgttctttgttcccatcctgaggccttgatttctggttctgctcttctttgaccttaaactgaatcaactcttccatcatccaactcagaataaaattggttttcttccaccggttccactgatgccaatggaagacttgtcttccttgcgatttgcaaaatgtctttcagtcacaggtgctgcggcaatgctgctgtcccacagcattctaagcttcagtctttctctctcttatcgtgggtcagtattcagaaaagggcagatttgtgggttgttcaggtttctcacttttctttttcttctttctagtttgggatcagagttgtgtgagtatttgtgtatataattttgttttggttttttgttcctgctgctacttacgactgctgttattatttcaattatgactaattaatactaatgactaattttcccctatgctagagggaaaataaggaagaaaagtttactctgctacttacccaaagcccaggtaaaatgcttagctgagaaggaatttaaaactcatagtttaaatgcatgatgcatgyctgctgtcattttatctgtgctgccacagtgtcctttcaagcagataactgagagttgctgtattttgctttcgaatttgttacagggacaaaaatagtgacccctcacatttaggtgttttggctgcttaatgcgagctcctgccctctagccgcatgcttattagtttacctagccctttttctggtcagtsatgactggagaatgccaaagagtctcccaagtaggctaccaaattaagaattgtgtttagaagtttgaagtcagtccaagtgttgtaaagattaaaacgttgttttgaagatatgctgtgtcaataaacaaatatggagccagagcaacacaatgtgaccaagtgtccaagcccagcttaggaacacttttctcccatgttatctagcaaactgacaaatcagctttccaacacgtgatgattggaaaatgctattagtttccttcaaaattctcctaatgtttctttttcaaaattgcctaagatcattggattatgtggtttgtgtttcttttcactgtagctgcttgttaaagcagtatactcaatctctgataagcaacagtaaatttgatcgatttgtatcctaaatttagctatcactttacattttgttttattcataatatgaactttagcttctaaaaatcaactttttaatagcttaatatataaagccatcttaaatcaaggaatatctatagggacttaaggtaatattcaactaaattggcaagtgactaccattatcctattaaagctctaaaatgcaatatttcaatcacagaaaaaaaatcttataatttaaagaactataaattgccagatgtttccctagttattacgttagtgacaaattagacaactggaaatagaaaacagagtatatgtttggaacagtcataaaaggactagtgactattgctgctagctgtggttgtattaacattaaaatatttgctatgggatttttcttcttatcaaagcagatgctcagatgaggaaaaactytcttgcatatgaaaatcaaaattgtcttccaaaatatttaagtaacaaaaaattcattatgtagtataaatgctgtatgattacattattcttatagttaatttagaagggtttgaatttgtttttgttttgtttgtgtttgtttcttcgataggtgcattctctaactgtcttaagtagaaacaaatgtctagaatctctcagtgattatcagtctccttcctattaccaagaatgtttttattgtgttgttaatctcacatgtaatttttttaacatttaaaagtttggaaaatgggtaaaaaatgagtgtgccttgtttcctattattacaatgtgccttcctatttcaagtcccaattctagatttccttaaaacttaaaatcatagaattaataatctttcagtttaagtcaacttttgtgtgatttcttgtccacttatacacacatagatgccttcatcttcaccaaataatgtagaaattttatttagttcaatggatttaagtactctgtatgcttaagtacaaaataagaatattgagaaatacacatatgattgtgtaccttttttttttttttttttgagacagagtcttgctctgttgcccaggctggcgtgcagtggcatgatctcggctcactgcaacctctgcctcccaggttcaaatgattttcctgcctcagcctccttagtagctgggattacaggtgcatgccgccacgcccagctaatttttgtatttttagtagagaagaggttcgccatgttggccaggctggtctcaaacttctgacctcaagtgatctccctgcctcggcctcccaaagtgctgggattacagacatgagccacctcacctggcctgattttgtacttttaaagagaatttgttgttgctaatttgctaagtttatttagatattttctgattctatattagtcaaagctcctcttatctactttggaaaatgaagaattatgtctataaaatatatcaacaacagctgcaggtacttacagaggaaatactgtggatctgagtgatattaggccctgaggatacaagccaaagtataaaaatggtctttgccgtagagagatagtagtcaagctaagcacatattttggcatgggtctctaatagcctaatgctagtagggtgggaagccatttaaaaatggcccctccttctgtcctgcctttcagaccagatggtgtgtctaaagtggtcacactgtttggttctggccacttctgtaataaccactgctcctttcccctcctcgtgagattataactcctttgacagtatggayggcacctaacgcatccttgttttcttttactaaatgttccacggagtcacttgcttgcctgtttgttgcttatttgtttgtttttggctaaaactacagaaaatgttaaatacattttcagacctttatattttaaaaaagaaatgttaagaaataaataatttttctaatctcatttagatacactgtcctattacacacaatgacaaatttgatgcttttgtcttgctaattgaagagctaagcatgaatacagtttttcagtctacagcagcaatgacaagggtaaagtggagaaaagagtaaggaaagaaaaaattaaaaagaataaaaggttgaaatatcaaatcggtggttcttaagatgacagaggcaggtgagacaagaatactggaatcacccagggggcatatgaaatctgtacatttcatccacaccttcttttctccccctgtcctcattccccctgttgagacacattgtattacaaattaggaggaaaccatctaaaattatctcacgtatcccagttcccatattagcatcatgagtatcacctgagagtttgttggaactgcagaatctcagaccctgtccagacccattgattgcataagaatctgcattttagcaaaatcctcaggtgattcaaatgcacattaagggaaaagaaacacagtgtaccgtacctgtggcttgtttagaataattatgaagaggtgttttcttggctcttmackaacgtttttaataaagctaatatttattgagtacataaatgtgccaaacacaacgttcagtctttctttaaattttttttatttaatcctcacaacaaccctgtgagatagtttctgttttatccttattttatagattgggataccaagtaataatgagataagtagtttacccaaaagctgtaactgatacagtcgagatgtaaacataagaattctaatttcattgcctgttctcttagctgttacctacagtgtctgctctatactgggctacctactttttaaggccaactaattatttgaaaatttatttaaagttttaatttgagatcaaaatctgtttccctcataaattttttttwaaaaaagcaaacaagatctattccattttgatctaatgttttcctgtcaccttacctttaagtgcaataatgggaaattctagaaattccttctttaactgtttgaaaaaataccaaaactatgacagcctgtccaaatccactaaaatatatttttatatgcatgctttttgtatatcaattatacttcaataaagctttttaaaaaaatagtagatgacatacttttaaaaattaactttggagcccaggtatggtggctcagacctgtaatcccagcactttgggaggatcacttgaggccaggagtttgagaccagctgaggcaacaaactgagacccccatctctacaaaaaataaaaaattgccagagcatggtggcgcacaccatgtagtagttgggacctgtagtcccaactactcaggagactgagttgggaggattgcttgagtctgggaggtgaaggctgcagtgagccatgatcacaccactgcactccagcctgagcaacagagaaagaccctgtctcgaataataataataataatamcaacttttgatatctctrttttttcccataaaaatccaaaattttctgtttactttttggtgctctcatgctataaagtaaattctcccttggattggacaagttattttctgttttctacatacacatagactgttcagcattccaactcaaattacatattactttttcagcttttaatataaatgcttatttactacaagcatggtttacaaaaatgtagtaaaatatagttactaaccagtcaatgctcaagccagtgactccccaaatgattcagtccctgagctgtttcacccagtgcaggtagattctctgacagccatcagttggatctgtccgaatatctcctgttttgacaggggcttattgatgttggtcaaaagacaggtgtgtatgggttccctgggatcatgtttgaggggaaacctgtgccaacaggactgagcagccactttttcaatggtattgagaaaatttgtaggagataaaatttcaccagctccttgaatctagaactgtagatattcaggtagcactgacattacaacatctaatttgtaagttatgggttagggcaaaatcaatccagggctgccatcatgacaagtagtggaagtttgaaagaaggagaaatacccaaaagatatcttacacatagcaggcagagtttcttagtactaataaaaaataaagtaccagtgatcaccctctatagcccctaagagtcccctggtttcactaagccccaatatttgtggctgtggctgaatgcaatctgcacaaggttttctttttaacagttggaaaaaatctcatagcatagcatttttttctttttaacagttggaaaaattctcgtagcatagcatttttttctagtaaatttcatatacttaacaactttatcagcacatatattttccttcacacttacaatttcatcaacacatatactttactttttgactcaaattcttcttgccatcaattcaaatgctcctgcccttagaatgagaattttccattaacccagctttaataatctaactctcccattcaaatgatgtcacttcatataaaacacattttatcatgatgtctcccagccctcagttacacagttaattgctgccactttatcatgaatgaaaaagatgtgattcttgggtaatgatttcttgagtatgtcctggtctattatctactgagttaccagagtggatttttgagagaacacacagttattcctattccttttaatttccattaacttaagccatatgatagaacattacagttgttatatattttgtataaatataaaatgtaatatataatttatatattttaaaatatttagtggcaagtaaagatagtagtaagtgaaaaaatcactgtataacatatgaatcgtaagtgtgatcccatgtatgtgtatacctggtagatgcttgtcaaggtgccattaaggtcttgggttattggcatcttaatgaaattcatttaattatgttaggattgatttgttagtaaaatcacttacatgttttttaaatgcatgcatatctgtggagccaataagaaaaattaggaacaatatacaacaaatcttaagagcttttgaggatgattttttttctttctttcttttgtatgtacctacaaaattttctataatggatctctattgattttatattttttactttctatttgtcttggaatttctattactttatttataattcactctagattttaggtactagacaactactattaactctctggagaatggtactataaatctgaccctttctgtcatttttttttcctgtggtacactagtgtctcacaaagagtccacagaattcacacggtcatgatattttatagaagaaatcattttatgggaactttcttttgttaatagatccttccaatgctaacattattctgtataacartgctaaagttggtatgcctaaatgctaaacttggtatgctaaagttggtttaaaaattaacctatatacaatcttcttgaataactcttcaactttaaataaatttcttatttaaaaaatcctcctatatataattaaaaatactgatgaatttgactacataaaaataaatgcttatacagtaaaaagtaccataaacaaagttatcatctaaacaagaaacctgggaaagctatttgccagccattacatgtaaaatttaagtttccttaacataacatgagctctttaatgtgagaaacaataaacaacctaattgaaacatgagcaaaagccatggctgagaaaactcgtagaagaattactatggaaacaataagaaaatgaaaagaagttcaacctcattcataattaacgaaatgcaagtcaaaacaaagatataccttttacttatcagataaagaaaaaatgatttgataaaacccagattcttggtattataaattggtataaccttaacggaggacattttatgaatatctatcaaaaacttagcatatacaaacaatttggttcaacagtctgttagaatttattatatagatacattcatataagtacaaaagtgcatatatgtaaatattattattgggacatttttgtagcagccaaaaggaaaactgaaaaaaaagattaaggctcattaatagcagactggttaaataaactatgtgtgagtacaatgaatgaaatattgtacagccatcaaaatgaatgaggtagatttatatatgctgatgtaggaaatctgcwagccatcataagtaaaataaatgaaacaaagaagaaaatactatgatgtacaaaaagaaaaaactatagatatacatatttatatgcatgtgtatgcattttttatgaatatacatatttatatgcatgtgtatrcaagtcctagaaggagacataggtaactattagtagtacctctgggaagtaaatgcagagaaaagtaatagagggtaaggatatgtttacttttattttacatccttctgtaacttgacatttatacgacgcgttagcattacttctgggaaaaagaaaaacagaaaaggtaatcttttaaaaaggtattttttaaattatggtacaataaaatgtgcataagctttatactaagtaatagaatcatttaagtttagctgtagattcacaagtaaaaatccaatctrttttcatattcttacatttatagacatttcttacatgtctatagaaagaaatggctaggaatgagactgcactattttaccctaaaacgttctttttctctttgcctaatgtatatctacaagggcattggggaagatgttgaccacaggcaggaagatgatgagatcctgtgcccaccacttaatgcagtctagctctatataaggaaaaatatgttcttgatgtgaaccagatggtttcactcccttcaaaaacactcttaagatgcagtgtggaagcttactctgtaaattaaaaaataaaaacctgactatattcagtggaatgcgttaatcatttttttctttttaggtttgatatttgacaaattgatctaaaatggctgggtttttatctgaataactcactgatgccatcccagaaagtcggcaccaggtaaatgccttacatctacagcagtgggtctgtcagcagttttctttaatgtgtcagcrgtggggagagcgcaaaaacccacacacaccattatcttgtgaaagaagtagaggaagcagaaaataatgaaatcccagtgttaccacatcccctccaatatacagattaagagcrtttgtatttatrtggttttaaacataaataacatcagaattactaagctatttccattcatgtactgataatgaatcatgtgagaaagtcctttggcaaggactccacatggccacaggtgattcctttgagcagtgttcttcctgtatagggcttaagaggaccagaagggaaatgaytgtactctcttgtcagctacttcctgggcratttgggttctttgataccccagtgctcactttcggaagtgttaagaccataaaccttaacagttgaccttctcaccttcagaaaacccaaatgtctcggagtttcattctcacaaacttccaccttcctccaatgatgagatataggaaaaaagacaatgtgaaattggagatggaggtgccctcttagcctctttacaggcatgagtcacatggcagggcattaaactctctcacaacctgttgtggagctcagcagggttagccaggactgytttgtctatctaactcttcttacatgggcctatgtgatatttttcataacaagagtccgggatttacctaactaataagatttccccaygcccctccttacaaaaactcagttcaaagaacaagccctcagcttctcctagtcccctccagggaaaatgaagagtagcttgtcctattctgaatatgttgtgctcccattttatcaaagtagaggatagatacgtaggtgctgggtgggtagataaatattagagggatgcttcttctttgctgtaacagattggcaagtaggaatcattttctggaaggtactccacagtggtggtgttagaaaactatttagaatgcctttaatcttggagataaaaatagtaacactttacagagttctgtcaatggatatctttagggatgttttgttttgggaggttttttttctgattttgtttttttcaggtatagcgaagcttgggaatctggactgtgcagattttctgcaaaaatccagctctggaaagagtgtattaagatgcatatcctaggatgacacaaagacagtatgctttattttacatcttaaaagtattgaacagaaggagttttgtccatgatatcccatcagcccactagcaggaaaagcaggacacttacccagggkgttcctgctggaaatgattcttggaatcagccttccttctactctatttgggaagtctttggtttctaacattcacacatttgtagcaaagcttccaaaataactatgatgttttgcttaggaataacaaaacatggaagaaaacattctgtgaaattttaaactttttcaaacctttaagtttcagatgaataagcaaaacatacttaaktctaagaagctattttttgtttgtcaaagaactgatgttataccagttctaatattaattagcaactttgccctggttttcctgtaaaataatctccaaggccctatctcaatctgtgggcagtatactgaaatacaaaaagtgttcacaaaaggaccttctgaactttgcaatctccctttaaaacttttaccaacttaaaactacagaactctgatctcttattgatttaaactagtgatatgtaaacagcacttcagagcttgtttcacaggaccaaaaaatttatgctgaaatctactcatgacaaatgggaaaamcctgattagcacatttaaatgaataaataaagaaccgtattcaatggcttaaaatttatagacctgcatcatccattatggtagccatttactatatgtggctatttacatttaaatataaacgtattaaaattaaactaaaaattcagcccctctgttgcattacccccatctcaagtgctcagtagacacatgtggttagtggacaacacagatttagaacatttctatcataggaagtactactggacagtactgctgtmaacacacttattaataatgcagcagactttcttggccacttggtaagaaagttttctgctcttttaaacttatttgggaagtttttaatacttttgaaattatgatttcctcagtgttagattatctgatatacagctctcacagaccattttttgtttttcctgtttgtttgcatattaaaatatataggattcaatgtttcacgtgcttttctaaagttgcagttcttgatttcttaaaattgtgaaaagaagtacccacagttatattaagaactaaaatatatggctgttggcttggttaccaacattgctgacagctccaagtaagcaaaagtaaaaaagatgtaggatcatttttaaaggccaatattttcttccttactcattaccttctgtaaaattctgtaagattttctttagttttccartaatgataaacatttcaccattgcatagacataattaattgattttttaagcagttggagagccaaacaaaataaggggtagaatacttcttattttattttttaataaaaatgtacatattagaagcctttatttttatttaaattgtatgtcactgataaggtttggatatttgcccctccaaatctcatgttgaaatgtgatcccctgtgttggaggtggggcctggtgggaggtgtttggatcctgcaggcggatctctcatgaatggcttggtgccctccccatgttaatgaaagagttcttgctctgraactgtgacacctcccccctctctctcttgctcctgctctcgccatgtgacatgctggttccctatcaccttctgccatgattgtaagcatcctgtggcctcaccagaagcagaagctaacaccatgcttccttgtaagcctgcagaaccaggagtcagttaaagctcttttctttataaattacccagtttcaggtattcctttatagcaacacaagaatagaccaacacagtcacggataacagtagtttttcatttttcatcaatataatgatcctgctgtattcttaaagttcttaatcactatttgtcactaatacgataacattaataaaatttgagtctcagttactttccagtcacttatacctagcagttcaataacatttagttcctggactaatgatcatgtgttatataaggcaaaaaattaaaaacaaatttgtctttgagtcatcaaagcatcaagggtttgaaatagctatataactagctgtgaaaaagggatataaatatccagctgatatttcctttacacatttaatagtatcatttttcaatgaaagcataaataaaataagtttggaaccagtttggaatttttaaatattaatcgcagaatcttactaacagaaaacaaaagcaagataaatgctagtcatttgtgcctgagtttttttttcaataaacagaaatgaagcttgctttaggaaacatgtgtactccaaataacctactattcacacaattctcagtaacattctttctttgcttaaataatacagccagatgtgcttagcacataactctatagaaaataataatttaaattagatttaaatagagatagatagacagacagacagatagacagatatttttgagacaaagtctcactttgtcctctaggctagagtgtagtggcatgatcatagctcactgcagccttaaactcctgggctcaagccatcctcctatctcatcctcccaagtatctaggactacaggcacatgcactatgcccagctaattatttttttaattttttgtagagatgtcgtcttgctacattgcmtaggttgctcatgaacccccagcctcaagtgatcctcctgcctcagcctcccaaaatgctaagattacaggcatgaaccmctgcacccaaccaatattaatatttttaacaattgaaagagctcaaagaaataggttttaaatttagaggccctgttttgctgacaggaaaggcttttagctggaatcaagagtgctgttgtcttttcccttcaattagtcattccttttaagacttttaagatttaaatgtatgagtcattttttaaatcccagaaagatctagtatatctcataaatgtaataatacagtgcagacctggtggaaaataattatttatctgaaactgggcctcagtgcctttcctgaatctaaacaaatrttcatctcacccagagaactgggacaacaggaacaaggtattgcaagtccaaaatccaatccaaagcagcgttcttcctccccacctctaggcaaggccaaaatacttctgcacacagtatagacrccagaaaaaaacagagccactgtagatgaaaccagtcagggggtaagagctgtcttttgatctagagcttgcacctttgctcctcagtaatactcccaggtcaaaaaggaaaaataagatgggcagttggctgcctcctggtccctccagcctggtcagtgaacagagtgggaagataaaacagctaagtatcttccttaacaatgcaaagcaagaaatccagtctgctttgggaaagtgaaagcaatgcaaattcagattattaatcataagagcatctcatgtgatatacaaaattattgtatagcagtaatgggtcagccgtattttattcaacactgaaccattaatgaatgctagctagtcttcctttcacttacagaatgtttatctatacatgactaaacaaagaaggagcgctggaaatgatcctgtgaaaaatactggctcacaatgtatcagctgagtttggggcaactgaggtagtaggaggcgccccctggacttctgctrgaatttagatttaaatagatggatgaattagacaaaacatactctctgaaagagtgagaaatacaatattcaccaattaagtgaaggaaaaatctacactatgaataaaacaataaatgtggatacatttgaaaatttgaatttcaaaccccttaagataatgtgacaaatacaacaggcctaatttaacatcttaaagagatctgtgtgacctattttgcagttttattttcttaggacaatgcttcagtatctttaactttcatatttaatcattttttttcttttttggtttctatggtatcaccatccatcaatccatattggttggagggggggaatatatatatatatatawgtatgtctcccaagagaaagtaattctgcaatcttcctcagcaattcagtctaacaattaagaacccttaagctaaatagaaaaattcatttcacaggcaagttttactcaatatgtataattagttttagttaactttattaatgaaatgtcgcaaatcaattaggtttgcaataatcagatgccgaggacccaagaggaaccattcctctcacaagaggggaaggtgatacacaatttagttgggaagcaaatgtaattagatttgatcaattgagtattcctgtcctgatgtggagtcagtcacatacccaagcctgagaatatatttgaaaagaggtagaaaaaaacccagtatgacttagaaaatgtccttgtggtcctattggccacaactggcagccaaaaagggctttgaagccacaggtagacaggttttgttcagacagggctatgttttagatttctctttcaaatctgaatggttttacgtagggcaatatataaactttcctatttgtcacagattctagcactctttaatgccttatactgggtgtttcacacagttatttaactgcccaaatcccaatggcacttcagtttgcaactatcatgacctagaagttagttattgaacagttatgaggtaacttaaagtttcttccctttgcctctagaataagaatatcaaagaaatgtcatgatgataggaatactactgaaagaggatattaaacactaggtattcctacttagggctacagtttgcagcagattctattgtgtttcagtcaataagtgtttttggacacctacatgccagacactattctcagcattgagcacaaagtcgtgagcaaggtagacaaaaatgcttggcctcataaaacttacattccagtgyataaagatgagaacaatcamgtaaaatttataatatgttggatggcatggaaaatggaaataaagtggaagggaggcttcaggttaaaaagagtgtttagggaaggtcttcttaggaagaaggaggaagctatgtggacatctgggagaagatcgctccaggcagagggtagagcaaatgcaaattccttgaggcagcaatgtgctggcatrgtcaaggcacagcgagtatgccagggtcttcagaaaccacagagaagagtggataacaaaagtgaaatcaagtattgaagagtatgaactgacaggaactagagacatatttagaatggatgccrgaacaggagaaatgggtgggattttaaaagctaaatgatttaaagacttaaaatgctctgaagtgtagtgaaatgttccccaaactgcagattttcccargaaaccaggtgcataatttagtcatcgatgactggttctgtggcaatgactctagtaattagacccctgcattttatgtcagttccttctggatactcagctacmttatttggtgcttttggyatacttcaaatatgcattgcctatcactgacctgtaatcctgtgtctctgggcctgaaaatataacttttcatgtagtagagaattagggctgtgcaacattgccactagattatttttaatgaaagctttgcccttttrgataaatacagcaatgtattcaaacaagtcctagggataccactgagtgcaaaatgtcatgtactagttattccatttaaattattttatcttcaagtctaataagaaaattctaaataaaattatatatttgggattgtgtgtgtatcatccatccacatgtaagtaggaataaaattatttaatggaaaatttcaaataggctaactctaaaaatgtacagataatctgratgagagaaaactatcctcactttgtgttatttttyaatggtagcattttctcataatccccatgcttttttcatgtcctgctattctttaagatttcctaatgaggattagggaataggcatatttaacaatctgtgttcgcaggttgaaaacaagaaaatgaagactaatagtttctctcctgttaatttgattttctacagctcctctcctaccagcttaggcagaggacttagttactatttccaatagatgggagccaaggaaaagacaagcatctgtgatgtcatgtctcccccaaacgggtagctgcctcaccagcctccattagagacatcccccasagtaagaaataagaaataatcatgagtagaatgagaaaaaaatrcagcttcctttatctgagaaaaacaatagtagctcaatgctgtggcctaaagggctttgaaaataatgcaatttctgataaaaataaatgccattattcttgcttattgtcactgttttagtcaaataagattttagcaagcatatttcaaattgttctaaatctaagtaaattggtaattaaatgctatcattagaaagtattttaatatcaraaaaattggaccataagaaagttagtttacccttgtattcatatatacatgtgctttgtgctaaaaattgttatcatttagtgagaacctgtgactatattaattaatttaatttaatcttcatatttctctgaccgttagagagtttgtgacttggataactttcaaacaactagtaccctgatggaaatccagaattttgttaacccagatcacagstgcatacttaaatgctatgcaacagtggcacttacccccaaaccgtatcctatggaaatgcctttttagcaaattaaactgaattgtgttcagagatccacaggtctaagcaacattagggaaggggtaaagtagtcctcagcaaggcccttttcagagcactccaccagtgcccttgtcctcctgggcagagctcctcagctatactccctttcctagtctaccctatcccacaacggaaccatacttctctcatggaagccctggtctcacagaactaaaaaggaggctcctagaaatggggttgtgttgagttgacagagatgtgtggctctttaaactgaaatataatccaaagagaacaagatctagtagaatttcaggtcctaagsctggttaaatttcaggtcctaaggctggttaatagtacaaatacagttatttatttataactagtgcaaatacagttatttatttataactatacaggaatttatttcccagtaccttctatattactaacatcccataaaaccagccatgtaaggaactagaacattttgagaatatgcaatacataactttaaacaagaagttttcattcttaattaaaaagaaataagcatagttcatcacaagttccttcaaatccttgtgccatttattctctctccccagagatattagacggcattttagagaaaacaaactctttaagtcacaaggagtggaataatcatagttgcattttaagcaagattatggttttttctttgagttctctgaatttgaatagtttcttaaccttagttttttaactgctctgaaaatggtttctgtccctggtggactcttgtttcaatgcagttattttgtctggtagagtcacagagttaagcygtcattcagatcmgaaaaaataaaagagagagatgaattaatctcaatggcacagtctccttattcaaaaaataaaaataaaaataaatctcaagtccaacaatgaatcatctttgagactctcccaagtgatctagttttaarggcaaaaactttggggaaactgttgggggagcaactggtgcccagtactgtttcacacacgtggtttttcttatctattgctcacacacttagacataactggaattattgcctttgtattgttgttgccattttataaaggaagacaaaaargatcagacaaaataatagtgaacatctattaattggacacttactggtgtcargcactgtgtcatgcactgtgtcargcactgtattttcttatttaatccaacaaaaaaaaataggmtaaattatcttattggctcaattttctttacagaaactgagcctaaatttcccaaatggctaaccaatgccagggccagcaactcaaatttgggagtaattccgacacctaggttccaaccatttttctcccagaaataacccaccaaattcaccagagtctaagatcttactgttactgtttaattaactgctacaattgcagcattttaaaaaaatataaatgagcactgtgctagtatttaattatagctttatactgatactgggtacaagtataagctaacaccattttgaattatagtagaagagtcaggagctctgagaggaatgttcaggatagaataaagcagatattttaatgtctcatttcagtgaggaaaattgttaattcatatgccaccagccatyggcagaaatgtaacaggaaatgaagaaaaacttaattactttaaatacagtggtctgtagtacaaattattgtgccgtgaattagtttccttctgctgtagaattgatcattttgattatgtagccaagcagtgtaagacattactaaaattattcttgaatcctacctttgagatctatataaaacactaggcaatttgcctgcaaatacatagaaaacaatttttaaaaggattgggaygagttattttcccctctgttaaatattagcctttgaaatgaacccagctgatctgccaaataacacttggaaattgttgtgttttaataaagtgacagactgagagggaagccacactagacgtccttatgcttttagaggccttacagggcaggaacattatgcaataatgccttttaaaagaagtgagcttcctagtattacaccttgcctggcaacaaatgtagccacttactgaaatgcaggcgtaattagaatctatgaaaatctagcatcagaatcccaaacctctatgcaatactcagtaaattacagcttttatgtctgtaatattttcaaccattctacttaaatatgtgaatacatgagtgtggagttctttaggaggcctgctgcatatgctagggaaaggtttcatcatttctaatcaggatggctctgtaaatgggatgyctcatgttcaggtttctggaaggctcagagcctgggcttctactggcagagggtagacccaaatggactactctagtgaaaatctccaggtgaacatggaaygcagtgaaaacctggggtatccaacttgcagtataggccaccagcaagtgtcacctctattataactttaaccaggcaagctcagtctcatgcattagtttataaaattgcaacagagccttctaagactgaaaggacattagtttttwaacctatatattatgacctaattaaatgaaattttattttaaagccctcataaaagtagtaaaattggtgttttaaataaaccaaatgggaattcaaccactttaatttttcttttgttccaataggaaaataaatgctttaaaatttgaagttgaaacatgggttttaaatatattgagataaaaactattttgcataggcattttgaagaaaataaattttgttctcgtgatttgtgattggccattgatttccgtgtttaagattatgaaggtgtgctcagctgtctactagaaataacaggggagactcaktcttgtttcaaatggaagggctcctattcggttttctccttcatttcttaaagtgttgtgatttttttattccctggtgttatgtcttgagattttaaatcttaaaacatgcaattaggtattgaagttgaaagctggaagtctcagccagctagtaatggttttttaaaataggtaatacagacctctagtggttgaacagtttgaaagcctctgcaagaaaaggaaattgcgcagaaagtgcctgcattttaaggggaaaagttagttaaaattattcagatgataaaattcacatatttcataggaaaaaaaaagccagaatgggcttcaagggaaggtggcacacttcccatccttttagatgttcctcaattcctctaaataagcaaaaactctctggccaaagtcacagtaagaagtctggatctgtattatttttctctaaaagatcttgtgaacagagctgctagatctctgtattatatgaaacatatatttttgtacacagttttgcctcactggggctttgcttcctttgtactccagaggctcyccatgaaaacaatctgcagccacctcaacttgcctgtgctgttctcaggttctgtccatggggagccacacttcagtgagctcagcgattggatggctwtttagtctacatgagagggaaactccatgtgcctctagactagtgcttctcaaactctaatgaacacccaagtcayctggggaatctgcttgaaatgcagattctrtctcggtctggggtggggcctgaggctgtcttgttcgtaaactcccagttgatgctaacgctgcccatccagggccacccagagcagcaagccrgttctatgacagctctctttattttttagttacatattttgtttttactcatttcttctttrtttgctcttttactttaataacttctgttaaatttttaatatttggatctgtaaaacatttaaagttctctttcacttcactatgtacaagtatctctgggaatctgttattgaagttttgagaagttgatctcacattttaaaaatagattcagtgtcatctctttatcttgaaaagttcatggtagttgtgagcatctctctaaccacttgaagctattgggttagaggtagctacaattaaatatctgattagccatattgggagagtgggtgaaaacaggttttgtgcatgtggtagatgtgtaggaagctaaggacccaaaaaacaaccacatcataaaatcaagcagaaacacacacacaccacacacacacacagargctcaaagcataagtgtcaacagatcagaagaaaacatgggagaatgtattttttcataccaaattattaaaattccatcatctaaataacttcctatcatagcatgttgtcgacctyatttttcaaatccataattttagaacttatgtcgtggggtagtctaaaagcctcttgcaaacttttaacatctagtttcaaatcaaaaataatatattaacaagctgtagcatagagggagtacataaattatcatcattgccctgcatgaatagtaattcacaggtttggctcacacacaacttagatgaaataattaactatgtacagtacttaacagtataaaagtaattaatctagctgcctcgtaccggtttggcctaaataaacatgcaataaaaaagccataggattttattatttttttactcackwtactactttagtgtgttggaattttaatatgtcagaagaaagatatctttgcattaaaaaatcattttcttttcaaatgttaatgtactgattataactaagtgaattccatatatttataattgtgggcagatgttctcaattaatagtttyattcattctacttcacagtttagtgaaaaggattattttaaattaaggtgtaaataagaacaaatgagatttttattactacaaatcacacagaatttgttggtggtgctataatcctgtgtaggtatagctttggcaaaacatttcagataagcttgttttttgccccatgggttctgggacgaggtgagttgtctgtytgtcctataaggttcagaaaggtaaaagggcaaggtcattaattggctagagggcaacaaagaaggtagttatccctgtgtggtcaagaaaaagtggctcaggttatcttgctcgggagagaaaatgttcattcagctccagtccttttggtaaaagcccactctcagtgtatgagtgttcctttgcctaatcatgtagactataacatgttttcccctatatgactccatcgattaatcattgcagtattatccccacttcataaatgggcaaagaggaggatgaagccgagtagttcttccaaaatcaagtagcatgtaagatgtaggagcaaaactcaaatccagagacttctgcttccagccaagatggaataacagggactagatttacctccccacctaaaacaattttaaaaactggacatacatatgaaacaatggttttcaagagagtggacatcagataacaaagggcagtgatccctggaggataggaaacaaatgacctgggattgtcccagcccactgcctggagggagtttgcaggcatgatacagggatggtacacccaggcagaactcgaggtcctctctgagttaaggacacagagctgggagtccagagaggccaaggaggctagagttcagagtaccagagagttgagagctgcacagagaacccagagatctgcaaatggtaccccttgtgcttcagtgcatgtgggcaaataatcacccaaaygtattagagagaacaagccccagaggtcatcaagagctagaaaatagttgctatttccaccagccacagtggaaagtctcataattcatggagcatcaggtagcatactcagtaggttcttgcctcaggaatgggaaaaatttagccctagactaattgctgctctggtaccacctaagaaaccrtaaaagtcagactcaaaagaattaaattatttgcaagtaactcaactgcttttcagaaaacaactggagaaattttgtaggaatacaaaagcatccaatatccaacaaagtaaaattcacaatgtttagcatccattataaaatcaccaggcatgcgaagaagctggaaagtacaacccataaaaagaaaaaaatgaatagaaacagacccagtcagtaatgacacagatgataggattattacactattacattaaatggttattatgactatttcatatgttcaaaatgcttgatggaagtttgaacatattaaatgaagacatgggagatataaaaaagactgaaattgaacttctagagatgaaaactacaatgtctgagatgaaaacttaaactgagacttcagatgctaagactacatttgtttcacatccccacaacattcttccctggacgctgagtttcctcccagcagctgaatacttcatgcttcatcctttcttaatgctgaactctcagaaaaagtccttcattctaagaagaggcgggagggtgccactctgtagcccctttctcatctcactctggtccctgctggcctggaacagattccactcccttcatgcactgatactccactctagactgagcctcttcatgaggtagccatcaagccatccgcagtcatcaacatggcaccttctgagtcagttacaagagtttgcatcatcagaccaccattttccgtctctgttttctgacttaccccaaaactctagttaaaactcatgaaatattatctcttcacatgaaatacaattaatatggaagtcagcatttttgcatctcccaacgcttcacatccaaggagctgtgtatgaaatcatgaactatgttcttccagccaaccaagcaattaaccaaagtatacatgtccatgttgtccttgtacagagtttgaaatatgctcatgagaattaaactatttttcagtaaatctgaaaaatcaacttgcttgtccaggaagttttattagggatagaatcccaaacaatgaatgtgctagccaagtgttactattaatcagaaatactccatattcatccaggattaatcctgtgtaactccctcagtcagtgtagcaatgtgttctcttcctgcactttttttatgtgtgtgtattcccaaatctgcagtgaatgtatttaggaaatacattagtatcaaaaggacaaatgtagccttaaaacataaatgtacagataatttcctatttgtagcaaagttcacttcagaaacacttgataagaactattcaaaaataaatattttcagtatttatttaaaatattttaaaatgtaaactcctcaccagtcatctagccagggccactgagtgtggctctatgaaatagcttcagtccctttcactactgatgaccttttgaacacaagataatatttgtcgagtaaatgtcaaaatagtataagaatacccaaatcatggattctatgctgtattcactcacatagagacttcactttggagcacttcagagcagcaacagctctaagagatgtaacagtatgctttccaggatagaagaacgaaaagggaaaaataagttgctagcaagaacaatgaggggtaggggtgaagttcaggctgcyattctgaaagcttcctcagactgagtcaggcacrtctcacraagtgcagactatgcaagctgsctgtgtgagatcaagggtagacagttgactcatcctgtcacatctctgtgttttaccgtamcctccaactattcagccatgaatcgctgcatgtggaatggaagggggaatgtctaacaaacagagacatacttcaagtcttcagtctagttaaamcattggaatgagggtctgcaacatctttctggggcttggagtctcgtctcagttctaaaatgagatggttggcctggatcctaagtttcaaattggcagcctttttaactaaatctaatctagaagagttctgttaggttccacagtgttgggttttaaaatatatatatatattagttgaaaacattttaaaataggatctttcacatgaaatttgaaattttaagtttatattttaaagttagctgttttcccccacctcattacaattggcacagttgactatagctgagaagtgaccccgtggcccccctccaagaaagggggagggccctccattcaccaccatgtccacttcacctatttctcccagcctatatatgtatttgaatatgtgaaccctggaatgcataatgtctagggaccataacaacaatagaatgctatgaatctctgacttacaaggactctcttatgaatctctgacttacaaggactctcttatgaatctctgacttacaaggaaaacaaaagactgtagagaatagtagttcaaccacattttaggttaaaatagactttacttggataacctgacaaccaaaacatctttgataatatagtaattgtgtatgtttaccagacaaagggtatacatgtatattcttgtatttctcttaagaagaaaatcaataaatttgacccatgaatttctttctatagcagacatttttgtgacttcctgactcacaggagatacagctaccctccaaacctaaatcaaaagtccgtaagttgcagaatgactttttatgtaaagagaacatactagtttctgataagatataaagaaaccatgtaatttatctagggaatgactctaagctgatcattgacttatttacacaactatagctactggaatagactgattccaaaaatatattttctctgaattagaatctttttcatatcaaaatatccaaaattattagcatattatgttattctcacaaagtcctaatgaacttcacaaatctgcctgctctattctgagtacaaaaaatatttagcctaatttgtttttccattattttatatagtaataaagtaataccaaaaatgttattgccagaaacaatacagtgttgtataattattagaaagtgaactcatgaaattctattaaaaaacaacaattaccacatgttaagtcagataattcacagaagagacttatatgaatactaggggagctgtaggcaacamaatttttctctgaatcctgcattttgaaggaagtttctgtcatttaattagttgaggtttgattcaccaaccaaaggtctatagtgtgatatattttcttcctccaacataaagttaacttaaagtcatttgtactttatgtgtttattctttcacttcttccccaaaagtaattctttaaattgctttatgggattaataacaaattatatcattatatatttttgtattattagggcttctaacttcattataatcaatttattggccatatataataatgcaacaaattacatctgtaaagtaaaattttatgacgcaatttacttagtatatgtataagtctcattctgctgcccaggctggagtgcagtggcgcgatcttggctcactgcaaccttcgcctcctcctgggttcaagcgattctcctgcctcagactcccaagtagctgggattacaggcatccgccaccatgcccagctaatttttgtatttttattagagacgrggtttcaccatgttggccaggctggtctcaaactcttgacctcaaatgatccacccscctcagcctcccaaagtgctgggattacatgcatgagccaccacacccggccggagacaggttctccctgacctgtgagactgcaaaggtggtgtttcctatgagtccagccagataatagactctgctaacattaattaaattaatattcctttttaagattctaggtgctgaatatatatctcttggtctataaattagcttcgcacttcagctatttagcaaacttgttttttattgtatctagtgtattcatactgaatgggtataatatactgtcttttgaaaaagttattttgtacacataatcttaaaacactcttccaagggcaaggtagaggcttcataatattatttccatttgtcagatcaatgaaggtttaatgatttgtccaagatctcaatttctagagaagcgaagaagaatcccccaattctagttytaagtttcttttttcccttgctaaatcctgcagtctactgatttttttttttttagacggagtctcgctctgttgcccaggctggagtgcaatggcatgatctcagctcactgcaacttccacctcctgggttcaagtgattctcctacatcagcctcccragtagatgggattacaggtgcatgccaccatgcctggctaatttttgtatttttagtagagacggggtttcaccatgctggccaggctggtctcgagctcctgaccttgtgatccrcccaccttggcctcccaaagtgctgggattacaggcgtgagccaacatgcctggcctgcagtcaactgatttatgttcatcaccttcttaagttaaattgctcttttactcattgcctttggttttgtgtgttaagattcagcatcagcattcatgatatcttttcactcttaattctgagtgtttccgtccgtttttttaatttttgtactttatgggctttttcttcatttacccccaattatgcrggaaaggctgtgtgcctcttttgaaagctctgatgttctcaatgaagagaccttttaaatgaccttgtttgtcccccaccgagttgcatatcacaacttcaaatgtctcactaaaatgttacccatttggcatcagtatacagaaaaggctgcactctgagataagaaagaacagtggtgttttcatagtaagagaatagagttcttaatgggaaaggggagagtataatttccactgatttmgctggtctttcaaactttatgatgcttttctccttgaactagcctataagaaatttgtagggaaaataccacaggaatcaaattttgggcatagatgtctattaatattgctccttacaaagctttttcccagaattgtttctccttgcctacaaaaactactccatgcctttattagtcagaaaagcagttttgtagagaaggcaagtaacagagaatcaagctaagtaagtgaaactctgtaattgtcaaacttccagaaagtaacatttgtaactaagtatggtatctttgtcctctctctttctctcttctctccacttggtttctaatgaaagccttgattacatgttatatttaatgtactgttccacaaagaagaaaaggcctaatgtgaatgcaagctgaatttacacttaaatattgcagtcagttcagaccggaaggatacagatcgatgccctctgatcctgtcagattccccgaagtgtctatggcagtgataccacaagagggcagggtttgacttccggactaggtggcttcctcccttcagtgcagaccttggggccacgacaacagccatcaatctcttgaaaccctaatgatgaatctgagctcaaattccctcttcagccttatctgtgcagaatcctgaagttatgaaaaatgcttacagaaggtaatttctagaatgatctaacacagcagatatttagtaaactccctgtttgagagctcctactaagcacccaacacagctttagactttggtcacccaataggattttatcttttgtgagggatctgtagttttccccggaagatataatgcatgaaataaaagcctccaataaaattcagtatacagttaatttatttcataaaargtgagagatataaattatcaaaggttaaaacaaaaagtaggaaccagagcagggtttttcagtagcaactctattgacattttggattagataattttttggtgtgggagactgtcccacgcattgtaaaatggttagcagtatcacttgtctgcctgctagatgctagtaataccccccacacctccctctcccacattgggaaaatcaaaaatgtctcgagacattgccaaatatccctggagtacaaaatcagtctaattgagaggcactagactggagtataaagagatgaccatgccaaaaagtaaaaataataataatagagccttgaaacattacttacagaatgtcaaaaacgtaaggacctgctctctattcctgtttcttaacctgagcaatgggaataatgatgccttccctcataggtctcttgtagaaatgaaagcaattaatgcaacacttggcacatagtaagcatccaatgaataataagtgatcagtgttactattgctaatattaagccactattataagtcctttctgttaatcagcagaaacaaaaagaagtataaaataatggtacattaaatgaacttaaacacttgtatgtcattttgtgctaaagttatgaagctgaaaagattgaattgacattttccccattgatagaaatcatctcaaaaatgctccatcttccttgtgaaagccaaaggccagcagtttccacatacccagcatctgataagtagttaatgatccwgaaataaactgttaggtgcttcagggaatttctgtgtatagagaagttccatgtaaatatttctccgagaggtggatggagaatgataattcacttttaccctctgaatttgatttataagcttcacctatctggcaggagataagaaccaaagttaactgaggagaaaaaaaataaatgatttcaagtgaccatgatcttcagctggaaccagttgaaactgcaaagcaactgggctgaagaagttcagccaaaattatttgtttataaaaactagagagtgttagatatttctatcacattggcttatttgaaatttctgctggctcaaatgaaattgtattcttctatttcctactgcggggttccttccctaaccacaattgcttttggattggagacttgtaactttgagaacaagaagagcctcagcttagctagctggaagaaccagaggagagttttaatatctcctgaagaaagaaaagcactaacacggttattatagttcaggacaagtggagtcaaagttgacagtttctgacttgaacagttttgttgctggtaataaaagcagaagtcacgtgctgaacgtgaaggtgagcagaggagaacttgcgatggcaaagttaaaaacaagaggagatgatggtcttggtgtggcacaggatgttaaaaaaattctcctgtccttaaggagttactgctatttgagtaatgtgccacttccctacatagccttctatgcagaaatgctatatttccacttcacaacccagaacgtgcattttattttacatttagaggaggaacaaacaaccagaaggcaaaaactggtgcattattttttgcaattctcttggaaagagttcgtttttaacttctgctcagacagcacacaactactgggaatatattttaatttcaaatctgatgtgtgacatctggtaactcatttattgctaatgaagttttcacaggaagcagcagtcaccagtagctcatcttatttttcagttggcaaagtgttgtttaccttttattggcctggcatcggtgtctcttatcacaggatatttaattagaaaacgcaagtagcctaacatagaaaagaaatggagtggtagataatagtagatagaatggtctaaatatttttattacagtgatgtaatatcactgtaatttatgtttaaaaattatgtaatactcaaaaggaattctcagagctggcgaaacagtctggtccaagcagcctctcagcagtgcctttcagcctcccctctctgagtctttccaccccttgctggtactttagtttcttccacttctagcaccacgtgtagtttcccaatttctcttacccaaatttgctcrcagggaaaaaaataaattaaattagccatttacaccacagtgtgaacttaataacaccaacaaaagttccaaagctctagggtctcatagcacctccagatccatgatctcattcggtgtttccaacaatgttttgcaccaaactggacacatgcttgctacttcatcatcctcatcgtgaacattattattattatcatcattttccagatgaagaaaatgaatcacaagtcaactgacagtccaaaggctccacagctcagagraggtaaatcatgtgcttaattcagaacttttggctcccatcactatgctcttcccactgtcttaactctggttgtcacctgagccattgtgtttcttctcaggtagatcttagttcttcctgagaaggtatgaaggtgggtattccaccctacctgaattataggaatttcagatatctgtgagcagctgcaaaggggattttactagatgacatcctgctgggcacactttacgccagtcctgaatgtgtaatagaaatctgcagtttaatgagtaagtttctcatattcagtttttgatgcttcataaatgttaaatgaaaacattttagctgagggtacttttgttgtttgttggattggttttgcctgttcatcaggattatcagcatttaagccagagttgcaaattaagttgcctacagggcagtgcttttcaaatattagtgtgtatcagaattacctggagggctcattaaaaacagcttgccgaaccccacccacagagtttctgattcagtaggtctgtggtggggccagagatttacatctctaacaaatttctgggtgatgctgatgctgttgtttcagggaccacactttcagaaccattgctagaggggccaactaggggacgtctgtgagtaaaagcacctacactgtgcttccagtacagcagccagccccagtgtgatgagcacttgaaatgtcgctagtgtaactgaggtgtcctggaagcatacattataccctgggttttgaagacatggtacaaaaaatgtaaaatatcttaataattttatatggattacatgttgaaatgacaatagtttggatatattggattaaatattttatcaaaattaattttacctgttcctttttacatgtcaaatgtttttaatagaaaaattacaattatatatgtgtctcactttctatttcttttggacagcactgaactaaagaaccagaaaatagaggggtgtattagtgaactacagaaaattcaagtcccaaaagctgtaaatactctgaggaccaaagaaaatayatacgttgttcagatttgccctgaggggtcagtttgtacccaaacatttgctgccacaagtagtaaatgtagaagcaatscaatatctactattttacttttctttcagggttaatcaagtgccttgttataattcttcaaactaaaaacattattataataatgaaaaatatttctgctgaacttccgaataaaaaaatttagtaatattttgaaagtctgagctttatttaattcattttacttacccttgtattatagaacaattatatttttaaaaatgcttttatgtcttccaaagaactttttatttttagcagtccatgaaatagaggtgagaacaggtgttggtattctcattctaaatatcttgtaatatttaaaggaaaccaaagtgaaagattaaattgccatgtaagattgtgttgccggttactggcagagcagactctttgccaggacagcagtccagtgctttctcttccaggctgttctgctcttcctcaatttttacagcatttttatgttaatcaatmaataaataaaaagtaaagaactataatgcatacaaaactgtgatggaagaaaaggaaactatgtgataaaatcaaataaatatgamccttatagctttagttttcttagaacagaggccctttaacttcagaatgttgaaaccttctcttgaagttctcttataatactctgccctcacctctgtgtttttatctgggcaattagaccacattaactaattgctaaactttaaaaagttgtattttcttacaaagaatctgagaatagggttgattttctatgttattttaacagtatcacattgcgcccccctcttcacaggaccatgtaatcttgactctctaacttcatggcaagcttttaattttgattttcaaccatgttccaaactgtactctttgacttggtagtgtcaataaataacgtaagggatgtctgacaggcttacagcctttggccataaatggaatgaaacaaagtagtccagatagggctcaaactcataacattgacctcgttagtctagaaccacaaccagctatccaaatgtgcctgggaaatatttctttgagtaatagttaattttttaaaagaaagaaaaaaacctgtgactatgataatcttatgttgagtttctttattcatcttgagtaaacagtaaatttttttcactttgttgtttcaatacaaagagttcttgtgtttaatatagaatattattaaattagtgtgggattaaaaatatttagatagctgatttaacaatatgtgatagcattaatcaactgccttgttataattcttgaaattgttattactctacttgtcaagcaattttgcccttctcgtcaaatgatgcatacctgttcaatggaaggattataaaagttcatgcttcggaaaatttttttttttttttttttttttttgagacggagtctckctctgwcscccaggctggaktgcagwggcgggatctyggctcactgcaagctcygcctcccgggttcacgccattctcctgcctyarcctcccaagtagctgggactacaggcgcccgccactacgcccggctaattttttgtatttttagtagagacggggtttcaccgttttagccgggatggtctcgatctcctgacctcgwgatccgcccgcctcggcctcccaaagtgctgggattacaggcgtgagccaccgcgcccggcccggaaaatttttttaagagtataaccaactccccgaggatacaggggtccagggaagctaaatgactgcttcaaggtcacccagccagtgagtgggaaagctaaaattagaacctcagtccgctcccacattttccaccaatttgcargctatcgttaaagaatatttcttctgcaatcagaacattgagcaatttggaaaaacgtgtacagtatatcgaatattctagcttcatttaaaatttatggttatgtgkcttgtataatgttaaaagctttaatctaaaatgaattgccatgtggccaataaccccaacataatactcataatgcatataaattctctaatattatcataatttcttaagggtacaaattaattagtacctcttttcctgcccaataactttcctcacaccccttaaaatggaatttgaaatgagataaacagttgctgctgctgaattaaagtttcaaagaaataaaagtgaggtggcttcatatacaaaatctgtagtttttttcacaaattggatgaagcaattgttattgactaagcccatattggtgctgcccttttctctgttgaaaagaaaagcttgtgagtagtctccaagagccatattattaaaaatgatgtttcctccccatgatggctgagatactaatccattgaaatgtggcgataattcttgtgagaaaattctatgagtctataagtttgaagaatttagaagtgtaagaggacaggggttcatttacttacaggccttcttccaagttaggttttattttccttttctcctagtctctggagtctcctctctccagacaccctggaaagccattcatggcctttmatatttaacataagagtatttaatactaacactaacatgtcgaaggaagatgtttaaagcatgtgaattagacttgatcatatatgtttcattggcacctgtttctctactttttggaataaaataaaaacgacaaaaacagctaagaattttggatagtgatgtgggtgggagggattggggcattcatcacaactgagttgtttaatttatagtaagtgggaacttttagagttgagagaagtttaattgtagtttagagtttcattattagacagtagtcttaaacaattcccaagaagctaaaatgtgggattaacattttactttcattgkaattcatatcctaaatataaatgttaatataaattataaagtttctgaatttcctttcataaaactgggttctttgggttcttagttattttggatgaaacaaggggagggctagttggaaatgatggaacatttaaccactgtcaccacagttagtcacaattggtacatgcagaattaataaagcagcttgccttgtttttatttcttgtgaggtcagatgacagtggatgatattgacttgggaagatggccagaagccactatttaccatgtacatatatcagagagccatttattaagtttgaggagattggatcttaagtacttaattagaatgacattaataattttaataaaatgttttgcattgagagaactattcactcagaaatagcaggggtgaacaaaatcatctccaaagaaatcatttaacatgaagttagtctaggattaccaaccaagagcatggcattctcccatgtatctgacttaaaagcaatacttgtctcttgccccatggtgccaggtggtctgccatgcttccctcttcgtggctgccaggattcccrgtatagaggcaaatacaacctgtaaaggctcaaaygcttcatcaaaagccatgactataatccaaagctattaggtttaagcaacttatttggaaattatcaccttcaaataacaygtagggcaacctcagtagagatgaaatggacgaagcaggcatggaaactgcccttcctgccttaaatacagaatgccagatcacagctctgaataaaagttaagaccacattgggccagatcaggactaacactagatacacagctgagatamagttccagtgactttggcagtgtgaaagtcaggaccastaggcacatatactgaaggcaatttaagctgtgtttcctgattaaagccagggactgaaaaatcactacctattcatgatgaaagactagaaaacttctgaagaccagacagagtttsagagtggtatagttactaatctactaaatactgcaaatatatagtatctgcaaatatatatataaggttgaaaactargctcagaaatgagcattaaaarcttttccagatcaagggagtgctgtacccccaagctgaggtttcataggctaccatcatccaggcactcagtcttcccaagcaagttaattcccaccaaaaatgaacacagtcaaagattacaaaacctaagcagaagtccattatcaagaaacagtgtccacaagtgcaataaatataatttatacctgaggaactataaatagtaragcaattgggtaggggctcttaacagacagatattcaaaatgttaaggaaaataaaagaagaagtagacttcgtaaaataggaacagagggctaagaaataagaacaagtagatctgaaaaagaaacgagtaaaaagcctagaaatattagtgccaatttctatgggtcaatgatttcacaagtgaatagctaacagttatttcctgtggccttacttggcagagagaggtgggggaagcaacataggagcagaaacagttcctttctaagtctgacttataaaataggaacaataaagacaacagtttattgaacaggatggtttattgagctgtccagcactataagcaaatggcttacaaacattttcctactctttttgatgcttgagagagatactttgatagaagattattccaaaatataattacttggtcatttagttctctctttattatcataggaaactatggggaatttttttttctttagattgcaaactagttttaaaaagagcttgtaatgaacaatttaattagattggttttggcttgcctaaaarcttaagaaggtattaatattctaatcaaaagtcttgggaaagcattcttagaataaaaaaaggaaagaaaatcttcattcttatgctttaagaaccaggaaagctgtcaaaggatataaggtaactcttacaaaagcaattgtaaaataaacgtggtttggccacaatgagccaacacctatgtttgccacagacttagrttcccacctcactcatggcaaatttattcagctgcttaagattattttttactcatacttcgaaagaacaacagcctggaatttttagacttttaatggcaatggaaggaacttacctatgataaacatttttctttactctcacgctttcttaacccatggctgttctgagtcaatgtttgccttgcattcaaaaaataatastaaagattcaagtaaaacatattcattaagcactatttgaaagatataccaagtgctttaacattatctcactttattcctacaaagatcatgtgcaataaatatcactgttcatgtttcctacagatgaaaaaaaactgagggtcatgttcagagaaattggatgacttacccagagccacayagatttgtacgtggcaaaggaggattccatttcaagtctttcaaccccaaattcatcttcctttctctaaggggamatggtgctatggaattcatgtaagccacagagyttggataaaaggaatagtaagaccaaaaataggaaaagtaggaagaggtggatcctcctatgtttttaatcagggttctatctacctrtaactcttctgggaaaagaagcaggatgtgactgaaacatagctgctttctagatctcacaaatctggcttttctagtcaatcacatctctctctccttcggcttctcaccaaaccagcatccgttcagcttcaaagaaaaaasagccctactgtttcccactcatttatcatcaatctaaagtaactgccaatcacaaaagtcccatctttatttctttccttagaaacaaatttctctagggaagcttatcagtagcagaagtgcagactgggaaatggcctatgtcaccctcccatctagaaatgcccagtgcacatccagatcccacacccccaagagckttgtgcaatatctgttaatttatgagagctgtttcccatagatgatgctgcaggcattagtaaggagggcaaagttcaagtgatgacaccatctctactccacctggctggtttccaggtgccatctcctgatccctctccccacccccactgccctctcaccatccttcccccaaaccccacactccccaccaatctgggtcagtgataaacacagagtattccacatgcctctgatatgatgtaacattcgacacactaaagataatactgcctttaaggctcctgtccccctggctagacttaaactgtgtagaggaggagaactgtgactttattccccttgcatcctggacacccacacatggtaggtgttcagtgaatatgtgatgagttggtgaatacccactgaatgtgctatttgcattgctacttccttgtgcttccttccactgtttctatcgcctaaaattcttctccctttttcctccaccctcgagtaggaaaaaatttgtttcyttattgggcrgggagktctggtcattatacatttatgtaaaatgttcttctaattggcatattccatgctatgtccagattctttcaagcgaattctcattaaggtaataatacctcaccgaagtttccagggatgatcccctagctgttcaaagctaccttttatatattaaataccagtcaatatgaatcaatggtaactgaaaaaaaggctgatagcttgtgaaggagttggagtacaaaactatgcctataaattgatcctcacaaaggcagactttttcccacagaaattgtattatgaatgctagttatagtttgagactagttaataaaattctactcactccaaacataggattaatggaacccacatgagttgtgtgctgtcaaagtcgagtcaagaggagagagaaggagaagaaaatttcctccctgttctcatagctcagggcacccaagggattctagagcgtaaagtgtactcccttctattttttactgcccttattcccaagctgaaccaaatatttacctctgccctcattttcagttatggagttcactcaggcccttttcaaccttcgaggttccttaacctttacattattaattctttttctaagcaaaatccagctgatctctactagatggttaaaaggatagtaaataggtaaattaatccacattaagccacaaatgactgctagccctaaccctttaatgactaattaatttttaataaagaatatgtgtctatataaatgaatttatacttctaagttggcataagttcagaaaaaatagtaagatgaactggaaaatctacaaggtatagggaaatcctctgggtgaggaagaactagtcatacctccctaaaagcctagccctagtttctgttacattatttcttcttttcatcttctgttttctaaaccacaagtttctaaaagcaccaaggaattttctacctgtttatttcgttttgtttttgtttctgtttttttgtccaaggtgaggcccaagttgacactgagtattctctgtgaaactctgcaaggagcaacatgtgatttcacagaaattagtctcgatacactatattcatggctgtaagttctatgctgctcacccattcatttgtccattcagtcactcattcatgagacatttatcatctgcctcctggaacataccagggcctacaccagaaaacaaggaaacaagtaaacactagtaaactttaaacaggctctccccacaagcaactgacagaccagtggagaagacagatatgtcaacagatgattacaataaagtttcaaggccgggtgcggtggctcacgcctgtaattccaacattttgggaggccaaggcgggtggatcacccgaagtcaggagttcaagagcagcctggccaacatggcaaaaccccgtctctactaaaaataaaaaaattagctgggcatgatggtacacactggtagtcccagctactagggaagctgaggcatgagaatcacttgaacctgggaggtagagatcgcagtgagccaagatcgcaccactgcactccagcctgggcaatacagtgacactctgtctcagaaaaaaaaaaaaaaagtgtcaaacctacatccaaaatgtcaaagtgctcaaaaaagttgggaaggcttcaccaaagatgtgacatttagggtagataacacctgtttgtggatactaatgtcctggtgagtcaaagaagaaaaggatgtacattatataagctggatgcaaaaaggaacaataatgaggacatgcaaccaaaaacttacatagggagaacaactttacttactcagggaaggcaaagagaccacttaagaactccttcacatgtgttatgtcttaaaagctgactactggagttgtatcccttgcacagcatccctttgcaccaaagtgaacactactctaagaacatgtgttcagctctcctgaatgccaagcacaaccatgcttggcatggcagtggtgtcttatttctgctcctctttttccccagggcatgccattgcaagagaatgctcakccatgttcatctggggacctgctcctggyagagcaataggatctgtgtgcccagcaccactgcccacctakctgtcctggcctgtgcccaatgctgaccttcacctcakagtgtggctgtaccacattcggtgatgtcactctcactgaaccttyagcctccttcctgggacttcctgatggactgttatccagggcagaatgtgttgattttctaaatcacataaatgaatagcttgactgttgattatgtagaaaatcagagcaaatatttgcatggctttgtgcagcccattcttgagcatctgattctccccagaattctaaaaaacctgctgctttctcaagccctcagtaaagacatgctttcttgataatcctagccaaacctattcatttgacatctttgttacacaaatggttaaccacagagttaacttcagaaatggctggcaggtatgaaggttagaagattcatgcacttttgctagactgaattggaagttaaagagtaagtagttactgactgcagaggcctggaaaaccatggaaaaaatcctattcctcaaagtcgagccctacctcctacgcctcttaaatcaattgccacagtgaccaatttgtcagtcacctaaaggcagctatcctgaccacttaagggagaatacttataatctttatacctaagtaaagattgtgagaggaaagaaatggtttaaagaatatgaatgtgtcacacttctgaggttaatgataaatgaattggtcctgcttacctcaggaaaaactttcaagtctttctgaaaaactaatttaattcagtagtattttctaagatttaggttatgttwttaatcaatttggaaaccaagatttacttatagaaaaaaaggaaaaggacctagataggtttattcacatagaatcccaatttcacttctctggatgataccattttctacaaaagcaattatgttctaaaatttaagtgtgctttcttaggctttatcagttcacagtgtttccttaagaaatatgatccagtattttttcctaagactaaagttgagttactacgtttatgactgagaaatgaatgtttgttagtttgtttgtttacaataagaattttttctttaccattttatttttattttccccaggtgtatttgatatagtgtttgcaacaaattcgacccaggtgatcaaaatgattctcaactcttctactgaagatggtattaaaagaatccaagatgattgtcccaaagctggaaggcataattacatatttgtcatgattcctactttatacagtatcatctttgtggkgggaatatttggaaacagcttggtggtgatagtcatttacttttatatgaagctgaagactgtggccagtgtttttcttttgaatttagcactggctgacttatgctttttactgactttgccactatgggctgtctacacagctatggaataccgctggccctttggcaattacctatgtaagattgcttcagccagcgtcagtttcaacctgtacgctagtgtgtttctactcacgtgtctcagcattgatcgatacctggctattgttcacccaatgaagtcccgccttcgacgcacaatgcttgtagccaaagtcacctgcatcatcatttggctgctggcaggcttggccagtttgccarctataatccatcgaaatgtatttttcattgagaacaccaatattacagtttgtgctttccattatgagtcccaaaattcaaccctyccgatagggctgggcctgaccaaaaatatactgggtttcctgtttccttttctgatcattcttacaagttatactcttatttggaaggccctaaagaaggcttatgaaattcagaagaacaaaccaagaaatgatgatatttttaagataattatgkcaattgtgcttttctttttcttttcctggattccccaccaaatattcacttttctggatgtattgattcaactaggcatcatacgtgactgtagaattgcagatattgtggacacggccatgccyatcaccatttgkatagcttattttaacaattgcctgaatcctctkttttatggctttctgggraaaaaatttaaaagatattttctccagcttctraaatatattcccccaaargccaaatcccactcaaacctttcaacaaaaatgagcmcgctttcctaccgcccctcagataatgtaagctcatccaccaagaagcctgcaccrtgttttgaggttgagtgacrtgttcgaaacctgtccataaagtaattttgtgaaagaaggagcaagagaacattcctctgcagcactkcactaccaaatragcmttagctrcttttcagaattgaaggagaaaatgcattatgtggactgaaycgacttttctaaagctctgaacaaaagcttttctttccttttgcaacaagacaaagcaaagccacattttgcattagacagatgacggctgctcgaagaacaatgtcagaaactcgatgaatgtgttgatttgagaaattttactgacagaaatgcaatctccctagcctgcttttgtcctrttattttttatttccacataaaggtatttagaatatattaaatcgttagaggagcaacaggagatgagagttccagattgttctgtccagtttccaaagggcagtaaagttttcgtgcckgttttcagctattagcaactgtgmtacacttgcacctggtactgcayattttgtacaaagatatgctaagcagtagtcgtcaagttgcagatctttttgtgaaattcaacctgtgtctyataggtttmcactgccaaaacaatgcccgtaagatggcttatttgtataatggtgttactaaagtcacatataaaagttaaactacttgtaaaggtgctgcactggtcccaagtagtagtgtcytcctagtatattagtttgatttaatatctgagaagtgtatatagtttgtggtaaaaagattatatatcataaagtatgccttcctgtttaaaaaaagtatatattctacacatatatrtatatgtatatctatatctctaaactgctgttaattgattaaaatctggcaaagttatatttactttaaaataaaataattttattgcaatgtatttatcktcattacttaaaatagatgctaatttattttaaaataagactaccttgaatgagtatgaatatatttttatttaaattttgatacaactgatagtttaatactattggttatagattttttatcctgacattgaaaagttaaagaaaaaacattttgttctactgcatgtcatggaataaacacatcgttttgaatttttcagtttttcacataacaaagaaaaaaattaactcttgctataatgctagaataatacattattttacaagtaatttaataacagaatttttctaattgtatacattatcattgtaggaaagttagaagatatagaataacataaaaataaaagtcatgtttagcttccccggtcaaaaatcattattttaacatttgggaactttattttctacttttttcattcattatacacacatatatgtgtcaatcctgatactgaagtcatgatgtgtatagtactttgtatacagatctttcacttaatgtcatagcatagtagtttcctacccaattaaatatttttctaaaacattttaatatttgtataatactacaaaatatggacatacgctgatatagttaactagtcaccaaattggaaaattgagctttttctgatttttttagtatcataaattacactgagatgagcattcaagtatgtgaatctgagaaatttcccatactcctagaagtggtgcaactgaaatacacgtatgaacattttttaatagtctaactacctgttatcaaatatttcccagaaaacataacaatttacaataccaccaactaggtatgaatatatatcaccataacctcagaatggggtatttactaaattttttttttttcagacagggtctcactctgtcccccaggctggagtgcagtggtgtgatctyggctcactgcaacctcccactgctagattcaggcaatcctcccacctcagcctcctgaatagctgggactacaggcctgctccaccactcttggctaatattttttacttttttacagagatggaggtctcactatactccctaagctggtctcaaaactcctggcctcaagtgttcttcccaccttggcctcctaaaatgctggaattacaggcatgagccaccacacccagcctaaatttaagcagaaaagaaagatttaccgtaaggatccagctgccacatgcaagggccaggatgcaactgtgcctgaaaattgtacttttaacatttctgctcccatcggacagttgcttcattcttctatttaaaggatttcagtgcttctgaagttcatacagggcagaccgaagtgctcattctggtcaaataaactgtggccaaagggttggagttatgcgtaaaataattgatggttgctgtgggcaagggggtgtcatctcagagagaggccttggccactgggcagaatttccacaaagcagactatattaccttcacattcccaaatataaagtttttgtgaacaaatatggttccatatgccttatawtatttatattatttttatattatttttaatttcattaatgtaatgccagccactcaccccaaaggtcttctactattttcacaaaggatcacctcaaaaaaataaattttaccttatcccaagtgatagcataaatatcctatataaaatccctccaggcctccaggtcagctttataactgttttttttttttttcagtagttgaggattttttgtgtgtgtttgtttttgttgttgttttgttctgttctgttctgttctgttttgttttgttttgttttttgagacagagtctcgttctgttgcccagtctggagtgcagtagtgtgatctcagtccactgcaacctccgcctcccaggttcaagcgattttcctgcctcagcctcccaagtaactgggattacaggcacgcatcaccacacctggctaatttttgtatttttagtagagaygggttttcactaggttggccaggctggtcttaaactcctgacttcaggtgatctgcccgcctcagcctcccaaaatgctgggattacaggtgtgagccaccatgccctactcaatagtcattttaatccaagtgattgtaagcattttaaacttgctgaactatttcataggttatagttggcaagatttctgatagataattgtatttagatatcccctatatcatgtatttattaatggtgttaataacatgttccattcatcaaattatattgggattttaccccatctcacttgtgaaatagatgttactaaccttgatgattattctttctttttcagtgagatcaacataatcttggagttgagaccctacttaccaaaatgttaggataggrtgccattatgtattcttcatgaaaatatttacaggttaggtagactccttatttttggtacatttaaaaaatacatacagaaaagaawatttaccatagagatctaggtgcccaacagaatgcaaaagctacatttatattraaatatatatttcaatatacacccatttacacccatttctgaggtgtaaatttcaatatacacaatattaaaatttacctcattctaagcttttggggaaaaaaaggctagtcatttctaatgctggctctttctcattgtggaaattcatctttttggacatcagttacatcatttttcaagtayggtgagttggcttggtgaaagaaggcttttatattttatattttattttattttattttattttattttattttattttattttatttttgagatggagtttcactcttgttgcccaggctggagtgcaatggcatgatctaggctcactgcaacctccacctcctgggttcaagcaattctcctgcttcagcctcccatgtagctgggattacaggtgcctgccaccacacccagctaactttttgtatttttagtagagagggtttcatcatattggccaggctggtctcgaactcctgacctcaggtgatccatctgcctcggcctcccaaagtgccgggattataggcgtgagccaccgcgcccagcgtgaaggcttctatttagttaataattcactcattcatggatttaataagtgttgtattgtttccctactctgtgctgggtaacaagtgctgtgtaacatatagcagcttagcatgtaggataaacttgttgctcagctgctgtgagcagtgtgaaggagagccaagtgagaagcagcttgattgcaaatcacagaaaggctctcagagttttgataccacaggtttttcagtttcataactctgtatactggtgcatttttttccaacaatatgtgccaatctaggaagcccaagaagagaaaatagattgaagcaggtcacaaaagtgtgaatgaagaaaacaagtttcaaggaatttcggatacttggtatgaagagtgagatatctgagggtaaagaaagtaaatcaagagtaagagagatacagagagactgagtggacaggaggctggaagcagtcacacactgcccccaaggccagggttcagacctcacaggagagatacatacagtcagggccccaggaccatgttggatccactggacccagaccaaccagaggaagagggaacccaaatattagrgtgggaagcaagtcataaacagtagacagaatggtatggggcaagcccttaaccatatggattttatatagttcaggctgtatgactgtatattggagctaatcagagagtcaaattttccaaattcaaaatcttgactgagtcagttaacatatgacatctgtaactatatccagtcttgtctacttgtgtagtgaacactcatggaaccatctgaacagtgtccattctcccctcatcgcaggaatagttctgccccactcagggacagcaccacctcagaatgaaccattttcctacctaactccatccccaggccacagttaattggtccaggcttgaagtggaccaatcacagtttttcatgaggatttttcaaacaggcgctgatgaagagctggccccagwgttggcatttctgagacgtaagctcaacaccagccacatctctcaccacgtggaagaagctagtctgcaacagagtgaagtaaacagaaaaggcaagagagccctgaaggtgcttgagtccttgattctacctgcgtcttatgtccagctaaatccctgcccactcctctctaatcaagggaccagaatacagtgatctatagctaagatctgcaagtgtttcttcccgcttatgatcaataagaatttcccttttgtagtgtccagcacatcatccattggccacccagcagaagtgataccgtctacatcccaaaacttattggtccctatcttaataaggggtcacaagtgctaccccacttccatatgtctccttgtgagatggtaacagccaggacattcaatagtgtgtgttaagggggaagaggtgtggagatatagacgtaccaatagtgagagggggctgaggctactacactatctacwattgcaaattattgtaaactgaagtctctccctgagatggcacaggggtaaaatacacttctgttgcatgagcaattataaaaaatatgatttagaccatgaaatcataagcagagagaggaaattagtgctcctcaccacttgagggcccaaatgcatggcttgcatgttgcctgggctctctttacytgacagtgacctgggagttctctgggtatcatagagccagtgagcacagcatccaaacctgccraaatccaatggaaaaggccttcatttaccaagctaacacaacttacatgagaaattatataactgaagttgaaaagatgcatttcarcaatcaggaagagccagaattagaaatcagactgttttttttttccagaagctgagaataagagaagttagctttagtaatatttaattctaaatcattcctatactaggaagctttgtataataatcctttaagagtttaaagaccatgagatttacccttcaagcagtgtaataggaaaatatttatctatatgcacaagagaygtaaatttgatgaaaaaatgatgttaattttaaaactattaaaagccagtttgctattatgattattttgcttcaagtatccaaatgatgatgagccaaatatgcccctgagcccagttcttgattcattccacgtcctataaagattctttagaaaaattgaacaagatgagaaatagggatcctggctcaacctcccagtgagttgggatttatctcatggaactttttcccaagcttgatgaagttctgctgtgccatatggacatgtacagttgctaaatgataattttccaaaaataagcttcaattctscaaaatggcagatagaaagcagctggtgttactcaacagagataagccctcctagagctcaccacagagaggagagcatcatgtctgcagatgccacagcagatctgctgagaatcagccagcrccatgtgacacaagaacccacagatgcrgattcgtcctgactggtggctttcttctggccattgctgttacagagaagtttctaagcagtactcaatgcacacaaaactaagtagaggctatataggcaattcttcaaataagcaatcattattctcagtaattcttgtagtaagtggatggtaggaggaaaaaaaaaatacctttccactgatgatatcacctttatagctatttcttgagtctccctatcttttccaccttcttcaagaaatagtcccctattacaatttgcatgcccactcttgctgcagaatttgtataggggctcaactctcattattgccaactatatgatttggaccatggatgtgagaagacttcagcaaatcaatccatcacattcctctggctgcaatgagttgggcacataacctaaatgaacacaattatggtgaatttcctggt

SEQ ID NO: 13264 - DNA, 110711 bp, Homo sapiens
  misc_feature (1)...(110711): n = A,T,C or G, or insertion/deletion polymorphism (see Tables 1-2)
tttatcttagaaataaaaaaaatgaataatctctgatttttggcttctctggaccatgaggaattctatcaaactcagtatattgtgcacttatttatggkgtcttctctctgatcttatactgagctgaacaattgaaaacaactgaaactgtaattgggatatgacaccatgaggtgaatataggtcttacaggtgtgtatgtgttaattctttttactccaagattccgtttagtgacaataattgtttttttacttttacaaaacctcagctcttttataacaaatgtgaacatgaatacttaatacaaggagtaagaaagattaaatataagctataatacagtatttttttcatgttgcatatggattaatccttaattgcaactcatataaagctgattcttttctctggactttgatttgctcagtttgagtcctatcttggagtcacagccaacctaggctagtgaatatctactctactcagcaaagcaatgaaaaagtaacagcttaaaagtaacccaccgccacaccagccacttctacctttctgtggctacttgtagttttcattactcacactgttttccagggaaggatttctgggtgtgagagaaggagctgggtgggagaatcccagtagcattctcttttagctttctgcccctgcttttcagcacttttcttctactgtgttttaattttcattctctttttatgagtttaagtacactttgagatatttaaggagatctgtatttatttttctgtgaactttttttttccttcaaggatgctggcctttttctatgaatttctagttcttcatgtgtaaaggagggaattatttttccagttcataactaaatcatccattatgcaattcttgacagggattgaaaacatcaggaaatgatgttttccattagaagagaaagcagtacagatattttcaaacttttaaaatggaacctggttgtcccatcataggcagtattgagtgcagaagacattactcagacctttcttaagaaagggctaatrtaaaaaatacattkattacatgaattgattcaaggcctgaaaatgatgattaggataaacatgacttttgtcactccactttgaagaaaactctccagatttctcctacaatataaaatggaaaccacagctttaaatggactctctgaggctgggaacagtggctgacacttgtaatcccagcattttgggaggctgaggcaggaggatcacttcagcccaggagttcatgaccagtccgggctacatagcaagacccccatctctatgttaaaaaaaaaaaaactttaaaaaaaattactacagctttatatataagatatatgktggcacctgctgtagtcccaggtacatgagaggctgaggtgggaggatcacatgagcctgggaagtagaggctgcagtgagccatgatcacaccactgcactcaagcctggccagcagagtgagaccatttctctaaaaattgtttaaaaatgaattccctgtttttctattcatattgcttctgtttcttggtccccatatccataaatacagccctctttagcagattctccaagcctagacacctttcatttctccctctccctcaccacccctttgctcatatccaaacaattgccagtccctccacctaaacatttctcaaatccatacaattctaagaactttgagaaacaatctcctcaccttctccaatcaccctcacatatctcacccagaaaggcatctaactatctcctagcctccaggaagggtaagtgctccacctgctccataatccactctcatcattgtgtagcaatgtttctaaaacacctgccaaaacatgttacttccagtggcttcccaatgccccttagaatataattcargtttcttaacttggcctacaatctgccttcctctccagattcaattctcaccatcttcttcccaawtctttaagctcagtgattctcaaagcatggtccctgggccagcagcatcagcatcacctgcaaacttgttagagatgcaaattctcaagccccaccccaaatctaacaaatctcaaactctgggtctaggactcagcaatctctcttttaaggagccctccaggtgattcttaggcctgctgaagtttgagaaccactgctgtatccatactggactatttctgttccaattcccctacttgcggataccccgacctctttctgtgaacctcaccaccctttctccacttaattaactccttctccttgtcatacaatctgacaagttcatgtaatatgttgaatctaccttgagatgtgttccaaactagagtcgctgaggggctaccagatattgatgaaaaatcccctgaagacagttaaagtggaagataaatctggaaagaaccttcctggcaaagtgtggcccctcaaggatccccccattcacttggtgcttacatagtgaaatgtgagcctgctggaaccctggtgctcatcctgctaaatacactcagcgcagatgattcctagcacaccacaggttgcacctgaagtcctgagtgggggaaccttccccatggtgagttgcaggaagtcaccaaacaaggtatcagactttcactacctgacttcattattaagtgcatcttcagaatgaaattgagaattttatttaaattcagatatacctaaatatttaatacttaaataagtataaatttaaaataataaattttctaaataatagaagtcatttcttaaaataatacaaatatctggtcctctagcatttctctcttctgagcagcactagactcattaatgccatgtagtcgtacccaggttttaaacagtggtttctatggcttaggacaatgtttcctaatgttctaaaatccatatcctctttttaaaaaacagctttattgcaatataatcataatctcttttgatttgttgctctttttctctatcgccacctctttttcttggcaagattcactgatagaaacaatctttttaaattaaaaatgtagcgattgtaaacatgatcaagatataaagtttgaaaattttaaacattacagagggtcgtacagtaaaagcaaagtctccttccatactcactgacctccccactctccacgaccccaatcttctgctctcaaagtaactactcttcagtttatgtctagattgtttatatatayayayayacacacacacacacacacacacatatgtggataatatgtaattcccctaattttataccttagaattataccacatgtatattctgcatcccccttaatggcattttgattatcaatggtgtgggactccctagatctatatatagtattgtgttacttactgtttaaacgtatagcattgaatttggtctacattagctctttgaaagccccactatacatataaggaaagaagggtccagaggtggtgataagtgatttcaaaagattaaagggccaactacaaatggaattggatcttgaatttaggccttttgaatttatctgtcctgctctttcaaagtcaacaaaccccttttacaatactgatgtacctgtggcctcttgaccaagtcaatttggcctattgccaagagcagatttagatggtgacactcgatacagtggcctccaaagtttggaattctttaatgctaatttaccatgctggggatttgaattactgattatggtattcgaataaaaactaaccacttctagggtttaaagttaatgwatayacacacacacacacacacacacacacatgcacacacacacacagagactcctctgcctaaagtgaagaatttttaaacaaattatagctaacacagaacttcaatcaattgcccaagaatacgcttctttctttacccccttcttcatgctatgctgcaaacacagtgataaggaacatgagctctagagtcacctgatctgagtccagatggaggcactgacacttagttatgtaaccttaagtgaattattactttacctctctaagcctcaaagcctcactttccttctttttagtcccatcaaacttgcagcaagcaattcactttacttctttgtaggtraggttaataagaagtaatgtgacaaggcatgcaaacgctgagtgaaataataatatgactattattatttcattattcattccatttattttttattcttctaatttttctttctcccaagtccatattttacatccatccatctaatcatatttattgagtcattattaagcacaaagttctatggatggcacgggaaaacccagtgatcaatgcgatggagtccttcccacaggagcctacaatctcaagcaaagttcagaattaattagtggttaatctttactgacttcataaaacgtatcaagcacagtgcagagcacttgacactcattatcacatttaattttaagctacctatgaggtggacgttcttttacagaagaggaatctgtagctcaataaagctgagtactttatctaggctggatccaaacccaggcagcctgactcccaaaccctgcatgcatgtctacatcacaccccaggcccctcagctctgtgagccctcctgacttcgattcctcctctgcttgcactcttttaacattagtcatcttaacaagaactctaatctatacaattcaagacgttacactgtccttttaatacaacccttcttccatagattttctagaggcagcatggtagaggcagctcagttaagggcccagattttggagtctgctgcttgacagctgcctgacctacagcaagccacataagcaatctgtgctgcaggtctcacctgtaaaattggggtaaggctacccacrctccagagattgtgttgataattaaatgcgttaacataggtgtcagcacaggcaaagcacacagtcagtactgcataagcggtgggcttcattattcatcctgtaattacgtattcatactagaatcatgtatcccataggtcagggaccaccttttctttccttaatacccccaggattggcaaatcttgctctctcaacaaatagtttactcggtggaacctaacagaactaatatttctttctgtccgtaaataaaaatagatcatgcttgaatgtgctactttgcccgaactccccaagtcttcccgcatcttcagttcctccccctccaacctggtgttyatcaggagaggggaaagagcatttcttgcctggcaggaactcaagacctagaagaaagagggcctaccctgccaaggaaaygaccttccccttcctcgcctctgctcctcttcccgtttcctgtcttttccttcttttctcctggtgtttccttctcccgttaactatggggacagacrcagctattcacaagtccgtctgggcagcacactccgaggtaaggcacgaaggtcaggagacaggttccsgtgccccaaatcctggagaagatgagttaaagctcttcgcttcgattgccttcgcccttcccgcgtctcgggagcaattcagtgtcgcctcacgtctggccttgcagaagtccggagttccggctctgaactggagctccccgccattcccgggccctccggtttctccctcaggccatctgaggaattgaggtaggatttcgcgggtgttaggagcaaactcccaccacaactcggtcccgggctccctctccgttgagccttgacctctgcccaaaaaacaaggaatcgtgggcgtgaaggcggccttgaacccgggcggcggggctcggcgggactcgtcagcgccctgctgcggcacccgggccgctcaggtaagtaggaggcgtgtgcgggcggggccgagcgggccccaatccgtacgcgaggcaggaaccgcccgccgcgcccccgagagctctcggcgccgcgcagtcgccgctgggcaccccgagaccatggggaagctcgtggcgctggtcctgctgggggtcggcctgtccttagtcggggagatgttyctggcgtttaggtgagtggcatcttgacagggcgtcttcgactctcyttctctcctcttccaagtgaggtcaggggctgcctggcgcccccttcctagcgggtaggaaagagcagctttggaacctcactcctccatctcacccagyaaaccgccccttgagactcgcttatggggaaagtgagctacttgcgtttccaaagactgccgagccgaattagtcccatttattttttgaaggttatgatcccccactttgctttctgaaggtcatgacccccttttactttctgaacgtgatgacccctttcccagctcgccctcaacattctgcttgggaaaaaaggacgtccattggaaacgccggacttgggagagaggatcaggctaccagttggatgtttacggctgactgagacattgcccaggtctggctaaccatgcagaagtactgggttatggaacctatcctagatttaaagagctggccagacagcagggcaaaccagctgaaacctgcaggcggtaactggcattttgtaggcatttgaccttttgaagtggaagatacaatggtgatagccagcctagaaatgtctcaggaaaagtcaatactgggctagaaagaagaacctttaagtgataatacacattcatgagtggatcgaaagcctctgcttgctttcagttgtctttgagtgtttatgtatttctcttagttgaagctggtcttcttagaggatcacgtctagaatctgttgaggtgcctggtgcctattagtaatacttccagtttgagagttttattgttacatttgctcccagtgcaaccacatggagaatcataaaataatagtaataataataaagtagatctaagggtatttttttaaataaatgactgtaagataagtattgagtctttctgaatatactttaataaaaattttaaattatccctgatattagaagaatgtggaaacattccttttcactctggaaacaagaaaattgtgttgaaaaataaatcggccaattgtttaaattgtggttggtttaatgaatttacatacttgcggagtaagtcagcataaaatttaaaaattaaagcaaaagtgatagagtttgactattaggagaccctgttgaattttgggaaagcagtttggaaggaaaagttcaaagggcaagactgtaggggattaagtgcagatttataacagacgatactttagaaaattagggctatttcgtgcatttaaattaataatattgttcaattactcatactattaaatagtgtcttttatttgggcagcagaattttccatgttgaatcatattatacagtttttcagcaataactgggtaaggttagctgatataggtaaaatacccacataatgtctacattatgtaaataaacatgaaaggaagtacctacttacttgttatgtcattcataaattatgataaagatagttaaccaacacgaagatgattgaagtccacatttaaacatacatkttgaatgctgtgccttgacttccagggytgggttttatcttctacagagaaagggtgaatgcctctcgagaagtggagccagtagaacctgaaaactgccaccttattgaggaacttggtatgtatgtgacagtaccaagaggagccagcacagcttcttggtcgtcatccacctgactgagccctaccagctcatttaattacctgtcactacttaagccctcccagtgggacatctgccccgtccactctgccccatgcaaggtcttsaggggtgtactaaatgacattctttgtgggtttttctcagcacatttccttactgacatctctccacattacctaaagaatgtcattgaccactccctggttttcccctcactgaatgcttctcctttcccatctgtggtatttcactctcctccttgtcctctgttacctttcctttttttgcttcctttcttctttccttcctccctccctttccttattgtcattcctggcttcaagtgttattttttttcaaataatatgactcagcccctcccctcaagaacctcacagcaggctgggcgcagtggctcacacctgtaatcccagcacttgggaggccgaggggggcggatcatgaggtcaggagatcgagaccatcctggccaacatggtgaaaccccatctctactaaaaatataacaattagccgggcatgktggcggcgtgtgcctgtaatcccagctactcggaaggctgaggcaggagaatcacttgaaccagggagtcatcggaggttgcagtgagctgagatcgcgccactgtactccagcctggcgacagagcgagactttgtcttaaaaaaaataataaacgaaggaacctcacagcctacctaccttcttttaaaaaaattcataaaaaatccatggcccagtccctaacctttcaaactgcagcccttcttttttagtcagttaaagggcagctccagctcaaactctccctaagctgaaatctattttacatttctgtcgttttctccctcatcctcccacccacaaccagctctgcttctagacttttcctatgtatggtacccccattctcaaaagattcagttcaaaatccaggaaccattgttccccgcttgtccctcatgcttctacgtgagacatgggctaatctcacctactagttaatgccacacctgcttatttgggctccacagctccaattcttcctgacattgctaacagaaaaataaaataaaatcaggctarattgtgttccctgttctgggaatatgttctttcaccttctcacctttgcttatgaaattccctccaaacttactgattcctctgtctctgcttactaaaatcagctgcaaaattcatctccttcctctgaactctcacagcactctgaagctccgattcacttatgacacctgccacatgccttgtattatagctagcagtgttctctctttcactatcagattgtaaactccctagggccaagaactgtgacttatttattagaatgtgatgagatagcttattttgggatatgattttctattttattgctatatttaaaaatacagaaaaagtacccttttgatttgagttttctgccttttcttgcctctcaatttctaaaaaataaagtaatctgaaccttgcactccctagtcttagaggtggtttgtgctagcagctgkaaagcagaagaaaccaaagaaaacgcctttcctgaattgtttttaaaaacctgagccccttcaagggattctgttggagaagggatatgaatatgtggatatctttgaataatggggatccttaccccactggctgacagcattctgggagaggagcaggacctcagaaggaatggttgcaaggtatctttagggacgctggaccctgtgttccagctaaggtaaagaccttgtgtcaatgcattacatggaagtagcagaattgtctaaattaaagggaccagtaactttggcaatgaataattcgatgatacgtagtgtagaatgaatgccagatggcctttccaaaacattctgcttaggtttagaacccaccacttaaaatgatttcataaccctaacagacaaacccagtaatgactcagattggattttccatcaacttagtggaataggrtatcagagtgatttaatttgattttaaaaataaggaaatgtgacatttactcatttgtttactgttttgtggtgtagtagtattcatattcactmtacaaataactgtcaaaatatataagcctgcaaataatcaagaggtataattagactagatgattggtagggtctagtctgactcgaattgtatcactcaactagatttgagaaggtaaaattacagttaatattgtgagtcttaggtcaatgttctgatttgccaaatattttgaagaaaatggcttaaatagttggaagcaggctgggagcagaagaaagaaatgccatgttacttctcatgtctattggcatatgtttggtgaactaaacaagttagaatgatgatgggtcatgtgtcagtaggacaatactgatatatatgttttgaaaaagctgctttatcaaaggcctggtgactatgagcagcctgttgagtcctttacaaacatctacatcatcctcataaccaatttgtaaagtggatgctgctatctatgctttgcagattaggaaattgacatacagaagaattaagttgcttgcccaatggtccggaactagggggtgatgggcttagcttatgagccaagatcgtttccttctatgcctttttactctctgttgtgtaacactaactttctgatctactgacaacacattttttattttggaagcttcaggaaagtattgcaacagtggaaaacagaaaatctgagatgcaaacagctgaaatattactagatacaggttaatcaaaacaaggcagtctagatatttaaattaagataatggataagataatactcacaaatcacaactggttgaggagtagaggctttacaaagccctgaaaagctgctgaaggattttaggtagggtatagtaggctgtaacagagctggagaaaaattcttatttgtgttttcaagacccagacttttgaggtttattttattggtagaagaaactcttattttgttttccttctccagcatttttttctgggaagaaaagttgaaaggtgaaatatatctttctctggaaatcatatctcatagatctttttgtattacgttcatctttttatccaaggcttttgagggtcaaggattgttttaaccaggacgttatctggctgcccttgacatctaatcaaagctgcacttgaaatatgaatacttcagtaggactttcactaggcaggattatcgagtaggtggcctctgtatttaatacctacgtatcttctcttccactsctttccattctatagcttcccatgtctccaatatatgcttctactccataataggttccatgtgttttcttagctggctatcagaaacttctctccaagatgtgaagtgacgataataaaattaactgatagtaatgctttgatgtgatcctttatcagagtgcctgtaggggatgactggagaaatgaagaaaagagtaaagaaatgaagttatgccaagtagcagtagggttgacaggctaagaagcagtaggcacctattcataagactgattttagacttagcagtgggattytaatgatagttgtgcataggctaataagtgtgtgggaaagtctcagaggaaggtatcctgggggcttttgctcccacaggtgccattgttgctgagatgcatggggcctgtcgtgcaggcgtagtgtaggtgacagctcctttttcaacttgttctcagtcaaaacttacttattatatgtctctttccatagaaaaaaatgctgaaaactagctcttactgagaaaaaagatctaactaaacwttcatattaatattcagtaatctttcatattcatttatactcattagtttattrctcaataatttcccaatatgattgtataatgtagcgttttaggctttacgttggaagagaaggaatgcttggcagagaggcctgtaataaaagaccttcacgattatgactttccagattttatcactgagtctatagagcagccttctatgggggataaagctgaatctctcaggatatgccctggaaattgttacttaaagagtaaatctaggatatgagtttattttctaggtatttgcctttttctcctgaaaatggggttctaaaaaaggatttagtatttgaggagtctgactcaagctttactatagagtagcatgcctgtgagattctccaaagttaatatggtttcccaagtaaatggttgaacaagtcaacaatttccmaaagaagtttccaaaagatatttgtagtttggactgtgagacgtattttttaagccttcatatatgcatttttctgattctacccttcttttgcagaaagtggctctgaagatattgatatacttcctagtgggctggcttttatctccagtgtgagtattttccatgctgctctcatgctcacatcaatagctgtatagacagtgcattaatgttgtcctctggagctgccagatggatccctatgctctcatcccacctcygggtaaaccagtcaactaaaaaagccaaaacagaattttggagggctaattagaacaccacaggaatgcccagctttgactgcctcatggtgggcaactccctgggggtagtggcatactcagtagggtcttgataaatgtgtattgatttccactcgattcctaggctagtctccagttctgtcctattgctatccattctcatcattgccctatttgactgggcttccgcttctggtagtcatcttcccactaactggtattcctctcaccatgtctgcctttatttggagctctgcaaatgtttgtggatcgaatattaaccacgttactygatttaaaactctaaacacgttccatcttgggttccctgccattcttaacaagtctttcaaagagaaatagagaacagactgcattttaattcccagtactgtcttcacaggaataatcaagaagttacaccagggacagcatttcggtaaacaaacaaaaaaatgtgtatttatgagatgttgaaatttttcatatattaatatttgttaaatcaattgcattttgraatggggatatgattttgaaaaagtatatttaccacattttcaatgtgaattctgattgctggaattggatgtctaatattccatttggggcaataaaataccaccaaagaacatggattttgaatttaaatatttttggccaaaaaaggggtacttataataaccgtggcctgaatttataaattcataagtacacacagtagaatagagtgaggctctcatttggaccttaaactgctgctggtgtcactgctggaactggtgctagtctgtgtgggcaatattttatttctttatttttccatcaaaatcaaggataaaacaaaatggtctagaaaagttttttccttgttgacctaaattttctattgtcagtttagatttttttttattatacttttaagttctagggtacatgtgcacaacgtgcaggtttgttacataggtatacatgtgccatgctggtttcctatacctattaacttgtcatttacattaggtatttctcctaatgctatccctcccccagccccccacaccctgacaggccccagtgtgtgctgttccctgccctgtgtttatgtgttctcattgttcaactcccacttatgagtgaaaacatgcagtgtctggttttctgtccttgtgatagtttgctgagaattatagttttcagtttcatccatgtccctgcaaaggacatgaactcatcctcttttatggctgcatagtattccatggtgtatatgtgccacattttcttaatccagtctatcactgatggacatttgggttggttccaagtcattactattgtgaacagtgctgcaataaacatacatgtgcatgtgtctttatagtagcatgatttataatcctttgggtatatacccagtaatgggattgctggatcaagtggtatttctagtgctagacccttgaggaactgccacacggtcttccacaatggttgaactaatttacactcccaccaacagtgtaaaagtgttcctatttctccacatcttctccaccatctgttgtttcctgactttttaatgattgccattctaactggcatgagatggtatctcattgtggttttcatttacatttctctgatgaccagtgatgatgagcatttattcatgtctgttgactgcataaatgtcttcttttgagaagtgtctcttcatattctttgcccactttttgacggggttctttgtttttttcttgtaaatttgtttaagttccttgtagattctggatgttagccctttgtcagatgggtagattgcaaaaattttctcccattccataggctacctcttcactctgatgatagtttcttttgctgtgcagaagctctttagtttaattagatcccatttgtgaagtctttgcccatgcctatgtcctgagtgttattgcctaggttttcttctagggtttttatggttttaggtcttacatttaagtctttaatccatcttgaattaacttttgtataaggtgtgaggaagggatccagttttggctttctacgtatggctagccagttttcccagcaccatttattacatagggaatcattttcccattgcttgtttttgtcaggtttgtcaaagatcagatggttgtagatgtgtggtgttatttctgaggcttctgttctgttccataggtctatatatctgttttggtaccagtaccatgctgttttggttactgtagccttgtagtatagtttgaagtcaggtagcaatgatgcctccagctttgttctttttcctkagaattgtcttggctatgygggcccttatttgattccctatgaactttaaagtagttttttccaattctgtgaagaaaatcattggtagcttgatggggatgacactgaatctataaattaccgtgggcagtatggccattttcatgttattgattcttcctatccatgagcatggaatgttcttccatttgtttgtgtcatcttttattttgttgagcagtggtttgtagttcttcttgaagaggtcgttcacatcccttgtaagttggattcccaggtattttattctctttatagtaattgtgaatgggagttcactcatgattggctctctgtctgttattggtgtataggaatgcttgtgatttttgcacattgattttgtatcctgaaactttgctgaagttgcttatcagctgaaggagatttgaggctcagatgatgggattttctaaatatacaatcatgtcatctgcagacagagacaatttgccatcctcttttcctaactgaataccctttatttctttctcttgtccaattgccctggccagaatttccaatactatgttgaataggagtggtgagagagggcatcsttgtcttgtgcaggttttcaaatggaatgcttccagtttttgcctattcagtatgatattggctgtggatttgtcataaatagctcttattattttgagatacgttctatcaatacctagtttattgagagtttttagcatgaagggctgttgaattttgtcgaaggccttttctgcatctattgagataatcatgtggtttttgtcattggttctgtttatgtgatggattacatttattgatttgtgtatgttgaaccagccttgcatctctgggatgaagctgacttgatcatggtggataagctttttgatgtgttgctggattcggtttgccagtatttttttgagggaggattttcgcatcaatgttcatcagggttattggcctaaaattatctatttttgttgtgtctctgccaggctttggtatcaggaagatgctagcctcataaaatgagttatggaggattccttcttttctattgattggaatagtttcagaaggaatcgtcccagctcctctttgtacctctggtagaatttgtctgtgaatccrtctggtcctggactttcattggttggtaggctattaattattgcctcaatttcagagcctgttattggtctattcagagattcaactttttcctggtttaatcttgggaggatgtatgtgtcgaggaatttatccatttcttctagattttctagtttatttgtgtagaggtgtttttagtattctctgatggtagtttgtatttytgtgggatcagtggtgatatcccctttatcattttttattgcayctatttgattcgtctctcatttcttctttattaatcttgctagtggtctatstattttgttgattttttcaaaagagcagctcctgcattcattgattttttgaagggtttttcatgtatctatctccttcagttctgctctgatcttagttttttattgccttctggtagcttttgaatttgtttgctcttgcttctgtagttcttttaatcgtgaataaccagatagcatcatggtgatggatcaaattcacacataagaatgctaaccttaaatgtaaatgggctaggtgtcgattttagatctttcctgcttcctcttgtgggcatttagtgctataaattcccctctacacactgctttaaatgtgttccagagattctggtacattgtgtctttgatgtcattgatgtcaaagaaaatctttatttctgccttcatttcattatttacccagtgtcattcaggaacaggttgttcagtttccatgtagttgtgtagttttgagtgagtttcttaatctggtgttctaatttgattgcactgtggtctgagagacagtttgtgatttctgttcttttgcatttgctaaggaatgttttacttccaattatgtggtcaattttagaataagtgcgatgtggtgctgagaagaacatatattgtgttgttttggggtgaagagttctgtgtatgtctatgaggtctgcttggtccagagctgagttcaagtcctggatatccttattaaccttctgtctcgttcatctgtctaatattgacagtggggtgttaaagtctcccagtagtattgtgtgggagtctaagtctcttggcaggtctctaaggacttgctttatgaatctgggtgctcctgtattggatgcatgtatatatactttttaaaatatatattttttattatactttaagttctagggtacatgtgcacaatgtgcaggtttgttacatatgtatacatgtgccatgttggtgtgctgcaccaattaactcatcatttacattaggtatatcttctaatgctatccctccctcttccccctaccccacaacaggccccagtgtgtgatgttccccttcccgtgtccaagtgttctcatcgttcaattcccacctatgagtgagaacatgcagtgtttggttttttgtccttgcgatagtttgctcagaatggtggtttccagtttcatccatgttcctacaaaggacatgaactcatcattttttatgtctgcatagtattccatggtgtatatgtgccacattttcttaatccagtctatcattgttggacatttgggttggttccaagtctttgctattgtgagtagtgccgcaataaacatacgtgtgcatgtgtctttatagcagcrggatttatattcctttgggtatatacccagtaatgggatggctgggtcaaatggtatttctagttctagttctagatccctgaggaatcgccacactgtcttccacaaggttgaactagtttacagtcccaccagcagtgtaaaagtgttcctatttctccatatcctctctagccctgttgtttcctgacttttaatgatcgtcattctaactggtgtgagatggtatcccactgtggttttgatttgcatttctctgatggccagtgatgatgagcattttttcatgggtctgttggctgcataaatgtcttcttttgagaagtgtctgttcatatccgttgcccactttttggtggggtgtttttttcttgtaaatttgtttgagttatttgtagattctggatattagccctttgtcagatgagtagactgaaaaaattttcttgcattctgtaggttgcctgttcattctgatggtagtttcttttgctatgcagaagctctttagtttaatgagatcccatttgtgaattttggcttttgttgccattgcttttggtgttttagtcatgaagtctttgcccatgcctatgtcctgagtgttattgcctaggttttcttctagggtttttatggttttaggtcttacatttaagtctttaatccatcttgaattaatttttgtataargtgtgaggaagggatccagttttggctttctacatatggctagccagttttcccagcaccatttattaaatagggaatcctttccccatttcttgtttttatcaggtttgtcaaagatcagatagttgtagatgtgtggtattatctctgaggcctctgttctgttccataggtctatatatctgttttggtaccagtaccatgctgttttggttactgtagccttgtagtatagtttgaagtcaggtagcgtgatgcctccagctttgttctcttagcttagggttgacttggcaatgcgggctcatttttggttccacatgaactttaaagtagttttttccaattctgtgaagaaagtcattgatagcttgatggggatggcattgaatctataaattaccttgggcagtatggccattttcacgatattgattcttcctattcatgagcatggaatgttcttccatttgtttgtgttctcttttattttgttgagcagtggtttgtagttctccttgaagaggtccttcacatcccttgtaagttggattcctgggtattttattctctttgaagcaattgtgaatgggagttcactcatgatttggctctctgtttgtctgttattggtgtataagaatgcttgtgatttttgcacattgattttgtatcctgagactttgctgaattkgcttatgagtttaaggarattttgggctgagacaatggggttttctagatatacaatcatgtcatctgcaaacagggacaatttgacttcctcttytcctaattgaatatcctttatttctttctcctgcctgattgccttggcgagaacttccaacactatgtagaataggagtggtgagagagggcatccctgtcttgtgctggttttcaaagggaatgcttccagtttttgcccattcagtatgatattggctgtgggtttgtcatagatagctcttattattttgagataygtcccatcaatacctaatttattgagagtttttagcatgaagggctgttgaattttgtcgaaggccttttctgcatctagtgagataatcatgtggtttttatcttcagttctgtttatatgccgaattacatttattgatttgtgtatgttggaccagccttgcatcccagggatgaagcccacttgatcttggtgcataagctttttgatgtgctgctggatttggtttgctagtattttattgaggattttcacatcaatgttcatcaggaatattggcctaaaattctctttttttgttgtgtctctgccaggccttggtatcaggatgatgctggcctcataaaatgagttagggaggattccctctttttctattgattgggatagtttaggaagaatggtacyagctcctccttgtacctctggtagaattcggctgtgaatccatctgatcctggactttttttggttggtaagctattaattattgtctcaatttcagagcctgttattggtctattcagagattcaagttcttcctggtttagtcttgggagggtgtatgtgttgaggaatttatccatttcttctagattttctagtttatttgcatagatgtgtttatagtatcctgtgatggtagtttgtatttctgtgggatcagtggtgatatcccctttatcattttttattgcatctatttgattcttctctcttttcttctttattagtcttgctagtggtctatcaattttgttgatcttttcaaaataccagctcctggattcattgattttttgaagggttttttgtgtctctatctccttcagttctgctctgatcttagttatttcttgtcttctgctagcttttgaatgtgtttgctctggattctgtagttcttttaattgtgatgttaggttgtcgattttagatctttcctgctttctcttgtgggcatttagtgctataaatttccctctacacactgctttaaatgtgtcccagggattctgatatgttgtatctttgttctcgtcggtttcaaagaacatctttatttctgccttcatttcattatgtacccagtagtcattcaggagcaggttgttcagtttccatgtagctcagtggttttgagtgagtttcttaatcctgagtgctagtttgattgcactgtggtctgagagacagtttgttataatttctgttcttttacatttgctgagtagtcctttacttccaactatgtggtcaattttgaaataagtgcaatgtggtgctgagaagaatgtatagtgtgttaatttgggtggagagttctgtagatgtctattaggtctgcttggtgcagagctgaattcaattcctggatatcctttttaactttctgtctcgttgatctgtctaatattgacagtggggtattaaagtctcccattattgttgtgtgggagtctaagtctctttgtaggtctctaaggacttgctttatgaatctgggtgctcctgtattgggtgcatatatatttaggatagttagctcttctcgttgaattgatccctctaccattgtttaatggccttctttgtctgttttgatctttgttggtttaaagtctattttatcagagactaggattgcaacccctgcctttttttgttttccatttctttagtagatcttcctctgtccctttattttgagcctatgtgtgtctctgcacatgagatgggtttcttgaatacagcatactgatgggtcttgactctttatccaatttgccagtctgtgtcttttaattggagcatttagcccatttacatttaaggttaatatcgttatgtgtgaatttgatcctgtcattatgatgttagctggttattttgctcattagttgatgcagtttcttcctagcctcgatggtctttacaatttggcatgtttttgcagtggctggtactggttgttcctttccatgtttagtgcttccttcaggagctcttgtagggcaggcctggtggtgaccaaatttctctgcatttgcttgtctgtaaaggattttatttctccttcacttgtgaagcttagtttggctggatatgaaattctgggttgaaaattcttttctttaakatcgttgaatattggcccccaccctcttctggcttgtagagtttctgccaagagatcagctgttagtctgatgggcttccctttgtcggtaactggacctttctctctggctgcccttaacattttttccttcatttcaaccttggtgaatctgacaattatgtgtcttggagttgctgttctcgaggaatatctttgtggcattctctgtatttcctgaatttgaatgttggcctaccttgctaggttggggaagttctcctggataatatcctgcagagtgttttccaacttggttccattctccccgtcactttcaggtacaccaatcagacgcagatttggtcttttcacatagtcccatatttcttggaggctttgttcatttctttttattctttttgctctaaacttctcttgttgtttcattttattcatttgatcttcaatcattgttaccctttcttccacttgatcgaattggctactgaagcttgtgcattcatcacgtagttctcatgccatggttttcagctccatcaggtcctttaaggacttctctgcattggttactctagttagccattcatctaatcttttttcaaggtttttaacttctttgtcatgagtttgaacttcctcctttagctcagagaagtttggttgtctgaaaccttcttctctcaactcatcaaagtccttttccatccagctttgttccattgctggtgaggagctgcattcgtttggaggaggagaggtgctctgatttttagaattttcaatttttctgttctgttttttccccatctttgtggttttatctacctttggtctttgatgatgctgacgtacagatggggttttggtgtggatgtcctttctgtttgttagttttccttctaagagtgaggaccgtcagctgcaggtctgttggagtttgctggaggtccactccgaccctgtttgcctgggtatcagcagcggaggctgcagaacagcgaatattgctgaacagcaaatgttactgtttgattgttcctctggaggtttcgtctcagaggggtacctggccatgtgargtgtcagtctgcccgtactggggtgtgcctcccagttaggctactcaggggtcagggacccacttgaggaggcagtctttctgttctcagatctcaagctgcgtgctgggagaaccactactctcttcaaagctgtcagatagggacatttaagtctgcagaggtttctgctgccttttgttcggctatgccctgcccccagaggtggagtctacagaggcaggcaggcatccttgagctgcggtgggctccacccagttcgagcttcctgaccactttgtttacctactcaagcctcagcaatggcgggcgcccctcccccagcctcgctgctcccttgcagttcgatctcaaactgctgtgctagcaatgagcaaggctccatgggtgtggaaccctccgagccaggcacggaatataatctcctggtgtgctgtttgctaagaccattggaaaagtgcagtattagggtgggagtgacctgattttccaggtgccgtctgtcacagctttgctttgctatgaaagggaattccctgaccctttgcacttcccggctgaggtgatgcctcaccctgcttcggctcacactcggtgcgctgcacccactgtcctgcacccactgtctgacaagccccagtgagatgaacccggtacctcagttggaaatgcagaaatcaccagtcttctgtgtcgctcatgctgggtgctgtagattggggctgttcctatttggccatcttggacagatgcatgtatatttaggatagttaactcttgttgaattgttccctttaccattatgtaatggccttctttgtctcttttgatatttgttagtttaaaatctgttttatcagagactaggattgcaactcctgctttttttttttttgctttttatttgcttggtagatcttcctccatccctttattttgagcctatgtgtgtctttgcacatgagatgggtctcctgaatacagcacacagatgggtcttgactctatccaatttgccagtctgtgtcttttaatcggggcatttagcccatttacatttaaggttaatattgttatgtttgaatttggccctgtcattatgatgttagctggttattttgcccgttaattgatgcagtttcttcatgtcatcaatggtctttacaatttggcatgtttttgcagtggctggtactggttgttcctttccatgtttagtgcttccttcaggagctcttgtaaggcaggcctggcagtgacagaatctctcagcatttgttgtctgtaaaggattttatttctccttcacttatgaagcttagtttggctggatatgaaattctgggttgaaaattcttttctttaagaatgttgaatattggcccccactctcttctggcttgtagggtttgtgccgagagatcagctgttagtctaatgggcttccttttgtgggtaacccagcctttctctctggctgcctttaacattttgtccttcatttcaaccttggtaaatctgacaattgtgtgtcttggagttgctcttctcaaggagtatctttgtggtgttctctttatttcctgaatttgaatgttggcctgccttgctaggttggggaagttctcctggataatatcctgaagagtgttttctaagttggatccattcttcctgtcactttctggtacaccaatcaaacgtagatttggtcttttcacagagtcccatatttcttggaggctttgttcgtttcttttcactcttctctcatcttgtcatctcactttatttcattactttggtcttcaatcactgatatcctttcttccacttgatcaaatcggctattgaagcttgtgcatgcatgaggaagttctcatgccttggttttcagctccatctggtcatttaaggtcttctctacactgcttattctagttatccatttgtatcacttttttcaaggtttttagcttccttgtgatgggttagaacatgctcctttagctcggagaagtttgttattactgaccctctgaagcctacttctgtcaacttgtcaaactcattcttcatccagttttgtttctttgctggcaaggagctgtgattctttggataagaggcactctggtttttggaattttcagcttctctgctctgctttctccccatctttgtggtttttgtttggtgacctacagatggggttttggtgtagatgtgctctttgttgatgttgatgctattcctttctgtttgttagttttccttctaacagtcgcgcctctcagctgcaggtctgttggagtttgctggaagtccactccagaccctgtttgcctgggtatcaccagtggaggctgcagaacggcaaatattgctgcctgatttttcttctggaagcttcatcccagaggggcatccgcctgtatgaggtatctgtcagcccctactgggaggtgtctcccagtcaggctacatgggtgtcagagacccacttgaggagacagtctatctgttctcagagctcgaatgccatgctgggagaactactgctgtcttcagagctgtcagacagggacgtttaggtctgctgaagctgtctgccgccttttgttctgatttgccctgcccacagaggtggaatctacagcaaggcagtaggccttgctgagctgtggtgggctctgccctgttcaagcttcccggcctctttgtttacactgtgagcacaaaaccgcctactcaagcctcagcaatggtggatgcccctccccctgccaagctgcagcatcgcaggttgatctcagactgctgtgctagccgtgagcaaggctctgtgggcgtagaacccgccgagccagacacgggagggaatttcctggtctgctggttgcaaagactgtgggaaaagcacagtatttgggcaggagcgtaccgttcctccaggtacagactgtcacrgcttcccttggctaggaaagggaaatcccctgaccccttgcacttcctgggtgaggtgacgccctgccccactttggcttgccctccatgggctgcacccactgtccaaccagtcccaatgagatggaccaggtacctcagtcggaaatgcagaaatcacctgtcttctgtgttgatctcactgggagccgcaggccggagctgttcctattccgccatcttggaagcttcctttcagtttaaattttcaatgttatgccaaatataccactaaaagtgatgattctataactaggaaatttctttactgttgtgaaataatgtttgtccttcctactgtatgttttcttttttttttttaattttcactggaactaaaagttctgaatcattgctatacaggaagtatatattttcatcacaaataattttatgagaaatgttaacatgaagttttaaataatggatctccttttgtaaatgaacaaacaacttataggataaggattctgttgttttgcttgtttctaatccttctgcactgtaataaattcaggaccttgttcttttggtttctccttttaccctttcttgccatcctagaagatgtttggaagttgctgatttggagaataattctgtgcaatagatatttctagtctatttagggatgacaaacaggatattttcttccctgccttgggacttgacatgcttctctttgactccaagattactcccttcttcacactttgccagctaactcccacttctttgtgagggttcattgtggtggcactttacttcctcaggagagtcttccctggcactctcttgtggggtgaggtgcctcttcaatgttccctcttgaatattccctcacatcccctgagtttaggctgttatagaccacaccatacttaagtgcttgctctaggtttcaagatccttgaactcaagactttggaacatgtattgacatgcccaacaccgaacatactaccaggcatttgcaagtcctcgaatatttactgagttcatgtggtgatggatgagtatagtggaagagttcattgattgtccacatttacctgtagtttgttgggaaaaataagattcctgcatgtctagatgatgattttcatcactttcaccagtgaatggtatgaaaagaattgcttacagtcattaacacacagttggtttgctgccacaaattcctacctaactgctttacacagaaaactaggtgaatgtgaagccatttatcagaagtgtttctttgatcatcacacttaatctagaccaagcttgtttgcagtgccctgcccttatctatctatcagattattttatttctgtaacatccagtcttttcactagctggctatgctccaccttcccccaagctaccaaggtacttgccattgtgttctgtcttgagctgccttcctgagcaatactgtttacttccaaacctttctgtatgtgtggcagagagagtctgaacaataaatgatctgagtgatttaggcaaatcactcttctaggcctcatttccctcatgtgaaagggaagatgtgagataagatgcccctaatatatttatatgtatataattattatatattttttatttttaacatatgtgagtgtgtatatatatacatacatatatacacacacatacatatatatgtatacatatacatatatacgtacatatatacacacatacatatatatatgtatacatatacatatatacattaaattttttcttcagtactactattatctgagccattgagcttggtgacaaattggttatggggaaaagagtagactgaaaattgaattttatgttctgatgttggggagcatagtgatgtccttaactgagaagaatagatataaatgagaggatggattcgaggggagagtgttgattttggttttgactagttgattttgagctgccctttgggaggaggttgggaaggcaagctagagttacagagttacaaataaatgtgcagacttgaaagtccttgatataaaggaaatacctgaatctttatgtataagatctgcaaggaaagagtatagagtgagaagggaggagggatcgataaaaacagaaggaggyataaatccaagagtcaggaagaggagcaggatttctatctgggaactcaacttttgacgttttgataagaaagaagaaggtatactgtagtgtcaaatgccacagagaagcagatcagaagtagaaaagttatcaaaataaagtaatttggagaccatttatatgatctttataagggtatttctacaaactggtgggagtggaatactaacttcagggaattgagagttggagcagttcacattaggcaataagatcaggtgatgtttctaagaaatttgatggtgaggggaagagagataaatgcatatatgaagaggcagtaaagttaagaaaatatttatttcaaggaaggaaaccttgtaattttttaggccaaagaagaagctgttagtgaaaaatgagtggtaaagcaagagagagagggtgtaatctctagagacagaccctagagaacagggaaccaagaaagcaggtaaaggatttaatctaagaacagaggagggacatttcttacttgagaaaagagggagaaagaaagagaatgaataaaactgaagaagaattactgggacagaaaggaaagaattataggaaattcatgttaaatgacatgacattttcagagaagtagtaagtaaagtcatccactcataataaagaggaagaaagtatgggctctagaacagtggtcccagcattttgggcaccagggaccagtttcgtggaagacaattttttccacagatcatggagggggagtggggaatggtcaagataaaactgttctacctcagatcatcaggcattagattctcataaggagcatccaacctagatcccttgcaggctcagttcacaatagggtttgcactcctatgagaatttaatgccactgctgatcttacagaaggtggagctcaggcggtaatgctcactcacctgcagctcacctcctgttgttccttgtaaggcccagctccttacaggctacggacaggtaccagtctgtggcacaggggttggggacccctactctagaagataatgaaataaatttagaagtgagacatgaggaaatccaatagattgcctatcataatgagccaaaaaaatcaataaacagtactaaatgtctggctgaagttgggatagtgactttgtagtggagtttttcaatctgattttagacttgccctatataagagctagaccaaggcaaagggagttcgcacagaatgtgataaggaagcaaagggtgtagctattgatgacgacaggattatggtctggaagcagaagtttgtggctagggacatgccaatcccttctccagatgtgctgacttaaggagaataaagagggaacagtgcctcctctgatgagcttcagtagtgccggtgttgtctgggaaaagccaggtttccctcagacaacattgggacatacgaattgggcatagaaggactgttctaaaaaaagtttgaagatatagctggggttgttcagaaaagattgactacctcaagagggagcagtggaagagccagtaatagtatcataagtgtatgtgtacgtgtgtgtagaaaggacagggagagggaaagaggcagaaagacaaggtgaaataggaaagagagaattgcaatagactgtaaaagaagataaaggtagcagagaagatataaagttattgatattgatatatatccagtgatagataggggacatggagaggaagtggactgttttgtaactggtgtagaataaaccaaccccaaggtttgtcacagtggactcagatgcagcaaaggcttcatgcattcaggatgcctattgttgattaatagctacctgatcctaatagtagaaaggaccactgtccaagttactggaataaactttttgtgatgtttgagtaaagcattcatgtcagaattttcagacatacctatakgaacaaaataggtcaaaaatagtcaactatataagactggtatccttatgttaattcttagccagctatactgtttgccactacatgatataatcratgtaggaatgggaacaatacaattaaactatacaccccttctctctgctttgaggaaggttagttatagaataccaggaccggaaataatcttataatcatgtatttgaacttcttcattttatagatgaggaatgtgaggtacgggcatgtgaagggattcacacaaagtaacagcctagtctcttctgttatatttttttggcttaactccttttctctaaattaaaaactcttccttatcttgaatatggttctttctgtgttcatagccaatgtttagatgacatcagtaacaccccagatcagatcatggaaacagctgacagagtgaaaaagcccagtaatctaaatgaaatttagaactttgaacatttttatttggctttgagattttaaattccttatgaaaatattgttttgatatgtatatgtgtgcacacttgttctttatttttaaaagggattaaaatatccaggcatgccaaactttgcgccagatgaaccaggaaaaatcttcttgatggatctgaatgaacaaaacccaagggcacaagcrctagaaatcagtggtggatttracaaagaattatttaatccacatgggatcagtattttcatcgacaaaggtaaaacctgtatgtttaggrataagggggaaatgagggaaatagaaaccatttatctccagcccctcaatatttatgtaacaggaagagagaagatgctattttaccatacagatgtgtttttttwaaatgataaataggtataaaaccttgtaaacattgcattaaagaaggaacactagtatttttggccctatgtggcctcctcctcttccttctatccacttgtcttcttgtttgactgtcacaacctgtttgaatactgttctcagaaatctaacatgtaaactaaaggccctttagtttagttgtcactaaagacaactgtgagacgttaaaaaacataacataarggggaaaaaaacaaattagactcatcaaagttaaaagcttttgtgcttcaaaagacaccatcaagaaagtgaaaaacaacccaaagaatgagagatagtatttgtaaatcatatattagatgagagacttgtattcagacaatataaataattcttacaacttaacaaaacacaaataatgtaatttaaaaatggacaaagtatctacctagatagacatttctcctaagatacacaaaggcctgtaagcacatgaaagatgtttatcatccttagacattaggaaactacaaatcaaaaccagaatgagataccatttcacacccactaggatggtgataattaaaaagacagacaataacaaatgttggcaaggatgtagaaaaattggaaccctcatactttgccagtgggattgtgaaataatgtaaccactttgggaaggagttttgcatttcctcaacatgttaaacatagagttaccacacaatccagcaactctgcaccttggtgtatgctcaagagaattgaaaacctatcyatgcaaaaacccatatacaaatgttcatagcagcattactcctaatacaaaaggtggaaataacccaaatgtctatcaactgatgcattcataaacaaaatgtgataggtatttatacaatagaacactatttggcaataaaaagaaatgaactactcatgcatgctataatatggatgaagcttgtaaatattatgccaactgaaggaatttagtcactaaaagccacacattatgtgattccatttatatgaagtgtccagaataggtgaattcacagacagaaaaattgttggcaggagccaggggagtggggaaggaggaatgacagctaatgagtaggtgatttctttttgggtgatgaaaatgttctggaactaaatagtggttatggttgcacaattctgtgaatatactaaaacccactgaagtttacattttaaaagtctgaattcagtggtgtgtgaattatatctcaaaaatatattataaaaacataagttatcaatataccatatatgctttaaaaacaatagtttccaatattatttttgacttgttcacagttcataatttcaaacatttaattttaaaatatttttgggtctatacagcatgaagaaaattaagaacagggaaacttcactaacagtaaccacatgaaaggaggaccaaattgaagtgctagaattccatgaaatcttatatacacttttatttgcttagcaagctctgctttaaaagataattgaatctaacaatttttcattggtttatagtatacaaactattttcatatataatggtgtctttacttctcraaataaaatcctgggcccaaccttgacacttcctctccctggcccttttgatcaactcattataatgttttgtttaatgtatctctccaatatctctccagtctgaaatatctgtccatctctccccatcctcactgctaccagcagttcaaggccccagcatgccttccctgattctgcatgggcccccaactgtaccttccttctcataccacctcaattcattgtcatagtaaggatttctttttatgcaaatctgattatgtccctcttttcatcaaatttttcatattgttctgtcactctgaggataaaccccaaatctccagaacggcctgggttcctgggtgcttcccctgtaccttctggcacctgtatgctctccagtttcactggaaaccattctcctccagactctctggaccagccatactggatttcttttcattcagtgaagtgtctcatgcctcaggatctttacatctgctgttccctctgcctggaatgtccgtctgccacttctggctcactctttgtcatcattgaagactcagcttaaatatcatcttctcagggaagcctgcccaccatcttgttccaatttgtgtacctttctatatttcttctcaatgtacctcttttttaaaatcattcattacggtggtaactaattttttttttatgagatgaagttttgctcgtctcccaagctggagtgcagtggcacaatctmagctcactgcaacccctgcctcccgggttcaagcaattctcatgcctcagcctcccaagtagctgggattacaggcatgcgccaccatgcccggctaattttttgtatttttagtagagacagggtttcascatgttggccaggctggtctcgaacttctgacctcargtgatccacctgccttggcctcccaaagtgttaggattacaggtgtaagccaccactcccagcctacagtagtaacttttttttttaaatgttaaaggataggaattttctttccctctcctgctcttgctctatagcaagttcctaaacttaactgttactcttcaaatgaatgacactctatgaagaacgtgtctccccactctagtattctttgttttaatttatttaataatttttcctccttgttttcctctctcaaatataatcaccataaaagcatattgatttgtccattgctggattctgagagtctagaacagtatctgatgcacagtaggtactctatgaacacatatcaaatgaataaataaacgaaccctataggacaggcagagcacatagtaatattcaactttatagatggatacaatgaagtttagaggaatgcagtgaagtgtgacttcacttctgcaattagtaaatggctgatccasaactcagacagaggaggtctcacttctaatcctgtgtcttttactaaaatgagattaggactctatttaaataattttaaaactgcaactgttttgcctcacactgtacaagacataagattctgcattggagatggtataataagtgattagatttacctgaaactatttcattgcatgggatcatattagaggtagaggtggaggtgggtttggggctttttttctttctttttttttttttttgtttgtttttgtttttgtttttgagatgggacatgtttatacaataacagtcatataatcaggcttccataagttgagtatattatgattcacagcttatcttatttgtttgtcatctcccttaattatgtatttaattcataaggccaaaatattacatatagaaatagagayggaatgaggagatggagaagaaaagtactctcactaagtatatcttatttggaaagagggattcagtagatgcactagaagaaatgaaatcaggctagcacaagtgattgttcactattgtgtctagcaaaagactgaaggtccgtgttggggctgaaatccaacccatgttctgtttgccacgccctgagccttgraacagagctggatcagaccagaaggaagatttcctctgtgagcaagcacctttccttaatttgcatcaaagtgcccagtgtgtttcagaggtcctggttatgaattttgcatctcagggtttgggcttgttccatcacgtgcttaaaaactacatttgggaaaggaatagggaagatgaatacagatcaagtcctacagtgggaggatgggaccagaccctttaaaactccagagctcatcaaacctagaactcctgataagtcagaagacagcattctcagaggccaaattactaccctcaatcttgttcacagcagttcacattccaattgaaatgggtaggtgacatttctgaggtgggtactacctagaattagttagtttgttttatctcrcattcatatttacatgccatgtccattgagctcactaaatattgttatgttggcttgtgtcagaaattcattgtctagctgggaaatgttgcttattttaaggtgtttacactgccctgacattcactgagcttctgttgcaatgtagataattattgtacacacacaacatctcagcaaagttttgtttgcttgcactcacttctcttgctgaagggccatctggggaaaccacatccctgtttatgcatcattatagttctgtaggctcctgttagacaggttatgcatataagggtgaagtgactatggcaaaacatcttggctctgccactttgtggtgatgaaattgctgatggatcattcgcctcctgagcttcaatttcctcaactaaatctggattctggcatttgtctgacttacctatcatgtagactgtgagggtmaaatgcaagatgtaagaagaaaacttttggaagtgaccaagttttaaaacaagtctaatattagttgtgataggggtaactttcttggaaattatcccttttttccatgtagacaatactgtrtatctttatgttgtgaatcatccccacatgaagtccactgtggagatatttaaatttgaggaacaacaacgttctctggtatacctgaaaactataaaacatgaacttctcaaaaggtatggaatgaaagtattgtgcggttctatttactttgcacctctgctgtgtgctttgtattttttggttcagcaggctttcttaaacttttgttttgaaattgttttgatttttttctaaagctttctaatgattcccatggtgactcttcccagcgcctcactagaaattgccatgttaggtattgaatatgcctatattttcgagcattttgaaagcattttaatcctataaaggtgctcaattaaattcccagctctaattccattctctttaccacggcaactcaatacctactatcggtctctgtttaaacacctacacccttttttggttgtcctagtaggttgtgttctgtgagcctcacccactgggtgttataaccaacctccagatgagccacttctttgtttaattacagctttaaagtagaattttttaaaagyccttgggcacttataaaaattacatttgttaagcattgactatgtgccaggcactatgccagaatacttaatttaacttaattctcacaaagcctttaataataggcatgggtaaactaagacttagagaaggtttgggttagataacttgcccaagttacacaatttgtaagtggcagaaacagggtataaacccagatccatctgaattcaaagctgagctctcaattgcaatgaacatctttcttactgcattcattaaaataacaggcttttcagtggagaggctgcctgtttaaaggctgtagcaaacaataaagaattcatcttttatcaaatgggcttaacattaaaaaactggctccaaaacagtaaattgtttcatgggatagaagaataggaaaagaaaagaaagttcatcttctttcctttgctctctttctcaacatcatgtattaatttctccccacagaatatgggggaaacgagtgcagagcatagaagtaagagaagttgaagttattgaactctgctcctaatgcaccgtatggggttctgaggccatagcggagaacaggacttccacagggttgctgggaaactgtggacaagtcacttaattggtgcctcaatttcttgagcataatggggattctcatttgcctgacttacctaactagtggattgcgaggatcaactgctttagcataggatctcacaggaagagtctcccagaaagtgcagcctgagggcacacctgatatttggccacttcattagggagtacaatcccaggaagcagacttgagaaaccagtgtgaggcaaggaagggagaaggttatgggttgaattttgtgtccccctgccctccccaccccactccccctgccaaaaaatatgttaaaatcccaaccaccacttcctcagaaggcgacactttggaaattgagtcattgcagatgtaattagtaaagataaaatcatgctgaaatagagtacccttaatgcagtagaactggtgtccttgcaagaagacaggcagatatacagggagaatgctatgtgaagatgaatactgacattggagtgatatatctacaagccaaggaatgcctgggactactggaatgccttgctggaagaggcaaggaaggatccttccctagaaccttcagagataacatggccctaccaataacacggttttggattcctagcctccaaaactgcgaggcaatacatttctggtgtttaagccactgagtttgtggttctttgctgtgccagccctaggaaacacatgcagtgagggaggtacagcaaaggcgtcattaagccaaccgctgctaactgactgcttgaaatcatggacttatcctccagtaatcagcgtaagctgcatctcaggacaatctggtcaaggagaaaaagggagaagggtttatccaccagccccatctcctattagtcaaaggtttgcctcaagaggccttcattttcccacattcttggttgttgtgcatgtgcaagtctagttttgtggtatcctatgactcaatgtcaacatgaaatctggaagtgggaggcaagaggcccacagtaggcatgagctgagacactgctaggctgcccctctgggaagtacatcagacctgtgcagaactggttgaartagcagcagctggaacaaggtaggtgaggctatgaggatctaaagaggagcctgagggtacactggcacaggcattgataagcacttacaagggggcataacagagagctacagaaacaaattgtgaggcagtttaacctaatttatgatgtcaggcaatactttttggagtaaagaatgcttaagctgagatacaaaaggtgagtagccgagtgaccttgggaaagtcattatatgtcaaaacttcaaagtatttcctgattcacccaaattttcctccctaaaatttaatctaaaaatgtttaagcattattttttcaagtcactttttttttcttttcaaaaataaaaatgactttatttttcttacggattgtaagaataagacttgctctattttaaaatgtcaatgatattgaagaacgtaagaaagaatatcacccataattccatctactcagagaaaatataaaggtccagatgaactgggttatgctatgataacaggacagcaaaaccctaacatcttggtggctcaaaactgccaaggtttgttatgttttttcatgcatgctatgtatccagtgtaggtgatttagggactcagtttcatattatcctcattaagggccctaggaggaccacagtctctatcatcataaaagttgctcattactgtggaaacatgagggaaacatggtgaagcaagcagtggttcttaaaatcttccatccacaagccactcacctcatttcatttcatttcattggccaaagcaagtcacatggctgtgcctaactgcaaggggatggggaagtgtaattcctgaaggaggataaccatagctatcagtgaactgcactacaactgtcacagataaccatgatcaacatttacaagtcaacagattttggggtttgagatttatttgtgaatttatttcttttcactgatttctgtgaaagagaagagtaagaaaataacaaatggctaaagaaaacccatcagggcaatgcagaatcatgattttctgtggaattccttaatccatactagttcatgtatcctttttcaaattgatgaacgtattagtctatgtagagatgagtgattttgacaaggataaaggatatttaaatacctcatgggtctctttttccacctccctttcactttagtgtgaatgacattgtggttcttggaccagaacagttctatgmcaccagagaccactattttaccaactccctcctgtcattttttgagatgatcttggatcttcgctggacttatgttcttttctacagcccaagggaggttaaagtggtggccaaaggattttgtagtgccaatgggatcacagtctcagcagaccagaagtaagctcttttgtgtatttttctatcctttgcccttgacattttcgtggactcctttccttacgaggaagttacttccttacttaggcttacgtagtgaatatatgtgtggagggatcagttgtggccagggttcacactaaatctgtcatcctaagcaatccatttgtttccttggactttaggttcttcccagttaaaggagggatgtggacttaaggatataaggacctcattccaaatttttacataactcttgaaacacaytttcctaacacactacaaaggaagataaatgagcaatacccctgccccttatgaaagtacaaagtatttgaccacttatgctaagttcagttacacaaaagctcttaggagagagggaaggctaccttagattgggcatagggattgtataagtttcagacctactgacttacaacagcagaccattcaatgagaaaaccctattttaaacagcatgaaattttatgagaaaacacttttaaaaagtgtttaaaaattggaggtttttttataaacagaagtaccttgaatattaacatgtatatttgagataatgagcaaagatgatccctgtagaaaacacctctcagtgtccttcctcttttaaaatattgtgattgagctttatggtcatttgatactttttttcaagcactagtttttagaagtatatacacttytggccttgtaagagatccacttaccttcattcaatttaaggaaaaagttgtgacttcgaagtaataagattgagcctatatatgtcatctagaaacaccagtttcattatagtcataactcatattcaaagcctgtttaaagcacttcaagaatattaaaaatactaccccattatcttcttttactgtggtttagaaaaggattgcagtggtactttcaaggrgtgtgcatttttatacctcttctccaaaataaaagtgagtgttgtctctcattaccacttgcttaagtgtaaatgtcatttacttcaaaggtatgtctatgtagctgatgtagcagctaagaacattcacataatggaaaaacatgataactgggatttaactcaactgaaggtaagagtaccctgtctggcccacacaatctgacttcttaccttagtcccatacttgacccaggaatgtgccccttgaatgaggaaaacatggctatttgagagcaatgccagtgagattatgcatgcgtttctaaaatacagaagcaaagccccctaaaaacaccaactttaggtgccagaagaagctgtaggggttgtggggatgaatagggaagaaagcgaggaatcattgagacaatgtcttcactactccctctttgttgtaaggtgatacagttgggcaccttagtggataacctgactgtcgatcctgccacaggagacattttggcaggatgccatcctaatcctatgaagctactgaactataaccctgaggaccctccaggatcagaagtaagttcctatacctctctgagctcacaggcaaagctgcargaacaaatttgttggggtgacttggaagaatttaagccagtcacatttggtgttatagaactaaagaaattttacgtatgagaaaagtaaagtttttgacaggtagggagataaggttcgttaactcttttaggccaccattaacttttcaataactcttgctgttgggaataatggaaaaacataagctcgattattcatattgacccagattgccatatcgtatttccaatcaggagatagtctctgagcaggtaggtcttgcagttagacaaagagagagttgtatatggtaccatcttctttcacactgtccaacatgaagctaagattaaaggatttaaataactgtcgcctcaamataaaatgagtttttgcctgtaagttctaacatatacgatggtgttgaaaattgtcttattttcaagatatcatttgtgttattttaaaatatctcttctaaaacaatagcataatccattgaattttctacattaaaaacaacattataagacaactgcattttctatggcattaaggttaacaatttaaaaatctttagtgaatttatatatagctataaattctaggcacacatactcagagatttattcacaaaaatttattgagtacctgtaatgtgtcagacattgtacttatgtttaggatatatcagaaaaaatatacagagatccctgatcttaagaaagggggacaaacaatgaacaataagcataagaaataagtaaattacatagtaactttgaagatggcaaattttatgggaaaaaaggctcagcagagtaaaggggatcaggattactatatgcagcaggatgagcaggtcctactactaaagtcagagatsagagtaggcctcattgagaaagtacaatttgaaaaaaattaaaatgtgtgaatccacatttggtgatttgagaaactgaaattcaaattcaaacccagtaattggcctagtgggtaaattaggacatacagttatttctrcttccagtattgctgtctttcagttaaaaatatgattatttctttttttattaatgtattagtcacagcttcttaaaaagaacacaagaaatgtaaaaagaaacaaaagtccaacctaagcctagaaccagaattgttaccctaaactaggaagcaatccttgcctcagatatgtacccctaagagtgatagacaaaactttcctttaaaagcccaaccrcaatgtctgtcttaaggaaatgaaatatgatacataggattattggagaattgtttaggatctttttygtatctctattttcaagttgaattatttttaaaattttagataagactttttgtcacaattactgacaccctttaattttggttgaatctcatgttttgtacatgaaatcaaagcttaagtatttttgtctaacaaacctgagatgaaggatctcccttaagataaaaaaaagaacaaactctgttctaataagagatatcaatatagactcgtaactcataaatttctaattgttttcctttaattccaaaataaaaattttattttattttgtttgagtgaacttcatccagcctatttggaagcctgagtgcttaaatatacactgattagcaaagttaagtgtattaatcctgggatcaataacagtactaggcagtgatgtgtcaaatgaaattccaaagtagtatccattatttatgctttctagcaactttgcagatgtgaaggggctccagctgtgatgactgccatcccatcagttaccatgttgggttggctggataactgggtgtttcttcattattttgtcttgtttctctccccatactgtaatctcaaaggcaagattcttcccacagagggaggaccaccatccacttgagaactaaataagagcatcttaactccttctgtaagggatgcctgcactaaaaaaattrtgtaagtcatccctgaggaatttggctaatgtcagaaagccagttcactttggtgcatagatatctatgacattagtactttcatcagaagaagaacaatttattgaagatatacagattttagcttctgatttctgaaaaatagatttatcctagaatgtttgggaaggacatcatgaaacaggtgtttactcacataatatactaataaacgatcttttctcgacaggtacttcgcatccagaatgttttgtctgagaagcccagggtgagcaccgtgtatgccaacaatggctctgtgcttcagggcacctctgtggcttctgtgtaccatgggaaaattctcataggcaccgtatttcacaaaactctgtactgtgagctctagactctagatagtaaaaaaaaaaaaaaaaagtctacatattttgtaaaagtaaactgataattgtatgataagtggcactgtaagtaaatagcaaacaccaaccagtgagtgtggcttttcttatggatagaagtaaaggagcagacagagattccttgatagccatcaaattgcaagtcaggttaatgacagtccaacaagaagccaaactttacggatctttgttagcagccccaatgttctttctacaataaaacatgtggactatgtccagtgaggtctccgactcacctagaggtccttggtaactgggtccaagtttcctcctacagttttgacgttctgggtctcctacagtccagaccaagagaaaagctaatgttcaagtatttacaacccctgttctctccccgcagttgtgctgggcacagacagttaattaagtgtaccagtctgcagataaagaattagcatcatgtgattgcccaaagcccttagaacttgcattctcccagggtaccgacacataggaaattgggttctgagaaatctgacagttgggcctcagaggctaccttagggcagggagtgcttatctctaataggcccttatttgtattgatgcttgtatctgaaatacagttggccctctgtaactgtgagttctacatctatggattcaaccaaccagagattgaaaatatttggaaaaaaatggatggttgcatccgtactgaacatgtacagactttttttggtcattaatccctaaacaacacagtataacacatatttacataatatttagatgatattaggtattataagtgatctagagagtacctacataggggaatgaacataggttatatgcaaatactatgccattttatatcagggacttgagcatccgtggatgttggtatccatcagagtccaggaatcaatcctccatggttattgagggacaactgttttgctaacctactgggctctgaatcttagatgaagccttaaggcagttatctttgactgcctttatcttacccttctggtttattcaataaacagttattaagcaacctccagtaaatttggccctaaggaatctgaaatgagtagaatggttctggcctaatgtcctatcttgaagaccaaccttaaacttaatttgatgagaatgaatagaagtgtccttttttggtcccaaaccagtacaacctttagcaaacaaaccattaattaaagtcagagcacccaagcacctcccttccctttttgtgacttttattcgggagtggttggttgatgctttttctcttttggggagaccattttatatgcaaaagaacattgctcagttttatgtaggtttgctgaaaagttttgcagggtaaaattctccttttttccagtgtaacccattgtgattttgactataagactttgtagttttcattgcttcaaagaggaataaacattcagcagaatgctatagtcagttattagattttaaatttcaaaagcctagctatcaagagaacacagaataaaaaagacattaaagacataatttaagaaaataagtagagtcagttttgaagaatataatagtctttgttttagtccctagccctcatacttactatattataatgtttaccagactaggggagaataaagagagataggaaaagacaaagataatttagatgctggtaagttcctgagaattgatcctgctctgccttctcctcaggccaagttagaaaggctgggggataaaactttcctcaggaaatttgggtgatctgattgctgagggactaatgtgtcctttccctgggagggcctgggaaagtcacaaagccttagggattctctgtgctcagcctgatgaaaaaacagagaagaaatgctagtgtgatttactggggatggcatcacacctacacttgaacttggcacagaagcaaattcccacgtgcccagaggggtatgggggttagcagagaaagaactgatagacttaaaaaggtcttgctgtcaggaaaaagaaaataagtagtcatctgattcaaatgaagaccgaagtttagacggtgacatcaaagaccagctgtctcccatgatgctttagctctccctgctggattttagagaaaactcccaggattgggagggggctttggaattgccttatatattgatttgtgcttccaaacaatgtgtggggagtcaaaaacaaaattacatgaggctgtggaaaaaataagttctgttacacttcatggttttagctttttcagaattggaacaggataragtggaaagaacttagtcttttgctaatggacatgtgattagtatcttttattccttgttctgtggctaagaccaatggactattaagttggttttctcctggaaatgccagtggaagatccagcataatctcttttacacttcacccctgctcttgctccaagtaggtcagtctcaaccttcagctactgggatcccctcactcagtgtgtcctctctttgggagaggccttggcaaagtggttgaagcttggattcctcctggagtaggcaatttacccattctttccaaaggatagggttgttgattgtcccattatcatcctctctttgccttgtcatctcccttcaataagttttttctccccttcatagggaggcacaggtttaccaacaggcctgcagcctagacagttatctcaaccaattttccctttgcataagcacccccaatctttatgtgattatcttgagcctcttcactcacttggcttgggaaggagaagaatcgctcctcacaataaatgctgcattttgataattcattctcttctcttccctagtctttctgcttaattatcagagacatgaattgggaatacaagggtgagggttagaggtagatgaactcttccaggagccacaagcaagctttggttgtgatatttgacttcaagtattttcagcaattttcagaatgtggggtacttggtgctttgttgtttttatctttgagcccttcgatgctgattctataatcacagaaaaattctcattctrtattcctttggcatcaaacaggttttagtttcaggtagcagaaaccactctatctagtttttggggaaagtgatcaaatgcaggaactaatgcttcacaaaatgctggggtatttcctttgcgtttggaaataagacaaagattctctattttaccatgactgttgtttaacataggattggaagtcctgaccaatgctataagataagaaaaagaaataggctgggcacagtggctgacacttgtaatcccagcactttgggaggctaaagagggcagattgcttaagtctaggagttccacaccagtctgggcaacatggcaaaatcccatctctactaaaaatacaaaaaattaaccagcatggtggcacattcttgtagtcccagctacttgggaggctgaggtgtgaggatcacttgatcccagaaggtcaaggctgcagtgagctgtgatcacaccactgcactccagtctgggcaacagagagagaccctcactcaaaaaacaaaagaaaaataaattagaactgtaagaattgtaagggtagaaatagaactattattgtttgtagattacataatcatctacttgaaaataaaacaatagaaccaagagatataccattaggatactcaacagtgttgcctgatacaagctaaataataacatttaatagcaatgacaattatgaatttgaatcatagagaagatagcactcacaatagcaagaaaatctatacagcatctaagaaataaatatgttaactggccgggcacggtggctcacgcctgtaatcccaacactttgggaggccgaggcgggtggatcacgaggtcaggagatcgagaccatcctggctaacacggtgaaaccccgtctctactaaatatacaaaaaattagctgggcgtagtggcaggcgactgtattcccagctactcgggaggctgargcaggagaatggcgggaacccagggggcagagcttgcagtgagccaagatcgcgccattgcactccagccggggtgacagagcgagactccgtctcaaaaaaaaaaaaaagttaaccaagagtacacaagacctctgtggagaaaatgttcaaactctaataaaaggtctagaaaatattttgaatatgtagatacatattctaggctcctggataaggtgaacttataaggatataaattctctccaaattaatcagtaaattcaaagtctagtagaattcttttaaataaatgacataaacttatttatatcttaaagggacaactttgatttctagcaatacaacaggctaaataattcagaacaaaacagcctaatataaacaacaaaagataatagagaaaatatttttgaaagcatcaaatatcacacaagataatatagaatcagcaaatcataatttaaaggaaagcagaaatccagaaaggtaagcaggattgaattcggtcttgtcctgagggcatcctaactgattgatcttgtgctttgggttttaatgtctcagagggcaaggggaacagaagccaaatcacagttcatcctaaaatgaggagtctaataagggaccaacacctataaaaccaaaaccctctgaccccaaagggctaaatattcctctaaggttgaaataaatataaatctgttcaatatttcgactcccagaaacctaaaaagaaaattgtcttgggactgagaaaagtaaaataaatacatttaatattgctgattaatttaatattgatgaaataaattcaagattgttgttgatatccatctgcttatcatcactcagattttgagccaaattcccactgattgaacggaaaaaaaaaaaaaaaactcaagctgtaaatttagtataaagtcataccatatttgtagtatatttactcacctggcagaaacaaacacatatcctctctggattttatcctagatcttaagaaacctaacaaataattatctaagcaatgagcaacaaatcatagtaaataaataaataaataaataaccaaagaaacagagcaggagaaacaaaagccagcagaaacaagtgatggcagaaacagacttgcagagaccccaaatacagaaatgatcaaatagaggctcaataactatacttacagagtttaaagaaataaaagacaattttaaacccagggtacagtaaattgtataaaaaaattgcaacagatttgaaaaatataaaattgaactttcagaaatgaaaatctagtaatagaaatttaaaacttaatgagtagccaggaaacattttattattgaggtatagcagcttaaaaattgttcacatatacatttataaagggtctcacaatctgagggaaacattttccactttttaatttcaaagcacacaaaaagtgttactccattggaaaggctatgaggatgacttytaatcttcgggactcaaatgcctcgggatagtcactcaaagcctttttttttttttttttttttttttttttttgagacaggatttctctctgtcacccaggctggagtgcaatggcatgatcatggctcactgcagctttgacctcctgggcttaagcaatccccctacctgagcagctgggactgcaggcgtgcaccaccacacccagttaattttttttttttaatagatagggtttccccacattgcccaggctagtctcaaacccctgggttcaagcaatctacttgcctcagcctcccaaagtgctgggattacaggcatcagccactgcacctggccccacacaaagcctctaaatacaccctcttaaggtagatgactrgtgaggtcatgtaggttgcaaataaagacaggccaaaacatgctcaggctcagataaagttatgggttatgtgatacatgtggctaattattggaaagggggaaagggacctgaattcattcttaagtttttgaggtcagtttttcggaaacagtgtggggttgtgtcaaggacattagggagcaaaaaaaaaaaagaaaagaaaatgagagacagaaacaaaaacctttaatgggtgaatttaacaggaaatgtagcagatctgaagagataattaatgaaatgaaaaatagttcatgggagattatattcagtataacacggaaaaactgagagaggaaactctaaaaaagacatggaggctaaaagtgagaagatctagcataggacaaattggatccccagaaggaaaggaaaaaaagaaaagagttgggtagagaaaatattttaatcatgctgagacttagaaattcatacctagccatatcttggtgaaactgcagagcatcaaacacaaagactttaaaaggagccaagggtgggaagaactatattgttcaatcaaaatagactttaaaagtaaaagtattaccatggatagaagggaccacccagaagatagagtgattttaagtgtacatgttccttctaatacaaccttaaaatatacacagcaaaaatttgctgaactactacaagaaaaatacaaacagtcgtactgtcatcatgattgattttaacttggcattcattgtttattggtagaactagcaaaatttttttaaaaagattagtgagaatagagagtacctaaaacacacaatttgcaaacttaacctaataggattatatagaaccttgtgccaagtaattgcagatacacattatttcaagctcacaaggagcatctacaaaaattgactatatacctggctgtcwagcgagtcttgataatagtatatattgtctgactacaatgcaatcaagcttagactcaattttttaaaaacctagaaaatttgcatgttgaaaaattatgtaacatttctaaataatctgcgagtcaaaaaagaaaaagaagtaaaatggaaataagaaagtgattttaattgaataataaaaattttccaacagataaaatcttataggaaacagctaaaattaaatttaagtaaaatttatactcttaaatgagtacaatagaaaagaggaaaaactgatattaaagaggtaatatcatccttttgttgatagaagaaaacagcaaagtaagaccaaagaaagttcaagaagggaaatagtaaacatcagagcaaaaactaacatagtagatagctctaggattgttagcagtggtggatccatatgggtctgcagcaacttgattcttgcctcctcaaaggaaataatttacctaaggggtataaggtagagtgagagaccaaggcaagtttttgaacaggaatgagagcaggagtgaaaggaagaaagtatacttggaagagggccaagcgggcaacttaagagatccaagtgcctcatccaacccttcacttggggtttttatacattggcctggttctgaggtttgcatctctccttccttgatttttccttaaggtgggatttccacatgtgcagtggcctgccagcacttgggaggggctgcatatgcaatgtgtttattgaagttttgtgtgtgctcacttgaggcatttttcccttaccagttgagcattcctagaggaaggtcatataccagttaaactccaccattttgcctcttagtatgcatgctcgggcccactcacccaactcctgagaccttatcgggaagctgctgatcttgtttcaggtgttttctatctgttgggagcctgcctgtccctggcatcagctgcaaccaattactattttagtgagacagcttaacaatcacctggccatcacctgatcatctgatggttgcctgagattcatggaagcagcggcggggtgggtgcctcttttgccctgttcatgtctgccaaactacctactctaacattcccgacccaattctttgggaaaatggacaaaggtcagtcttctgtaactgcttcctgctgacagaaggacggtgatgattgttctgtgggtcttggcgtcttgctgtcagggcagggtggctttgtgggttggtgaaagtggtatccagcaaggtccaagggagacaggggcaggatttcgcttctttcatgtctcactgatgggcagtctagtggtcctctgtagaagtgtgactcttgaatattgagacgatggtatctctcactgaggatcatctgaagcttgatggcctgaaggtgtgaggagacaaatcgggttgctagatttagaagacatggcccaaaacggagcaaaagtaggagactaacaagtgggcctaaaaggggaataactcaggagaagcattttcagcttccttcccaatctaaccaaccctgagaggcttgttccagtaaactggaggctcaatttaggagttgtctgatattgtacttttcctgattgattgacccataagcaaaatttttcacctaaggctaaacaagtttctctctgtgctgctgttaacttgtctaactcctgataattttggaggactatagctgccaaagagtcaatttgttcttgcacagttgttaaggttttagccgtagcatcaatgttcttggctatttcccttgagggctggctatgggtcaaggaggcttttgtgattctagcaattctggttcccatactggctataataccaagtcctgtgagaaggagaattaattggatagccctcctcatcctggaaaagatggaatgcctgtagattggtgctggaagagagagattgccagggactatgaagatgtctagggatacatagcctatggtacaagttccagtccggttagtggggaggcactggtgaactggctggccacaaatatagaaggctccttgggttttaagataagtagagatgtaaaaatgaaacaagggggtgaggacagctccaagaaatgccaaggctgccaacacacccaggtagctggtggctatagtcatgcctgctaagacttatgtgcatgggctttggttctgtttagttcccttggttttattttcctaaaaaagagaattttgagtctggtccaatagaacccattcttctgtagaaatgagattggcaatttgcaggcattggttgtatcagcaggccggaaccagaaattttgaatactgcaggagcttgggtgtccctggcaaaactgggtggatttatccagcaaagttcccagaggaaaggtaatatttgaaggtttgggaaatcttgtgtgatggtagaattagttgtgggtgtacgtttggcaagttcgttggttaggatctacagtgagagtaacattgctaactgtactggaaagagccccaacatccattccatttttcttattggccgtaatgcaaataggggctagtcccattaaagtggtattagaaaagatggatccaaaattgggaggttctttgcagatatcagggaaatcttgctttacttttgcaagaaggctatttgcaggcccaaacatctcccattagcctcccattgatagaaaatatgcagttctgcctttatacttgtccaatctcttggtgaggctgaataagctctccctgccgttttagcagaagagctggtacataaccagcaattggtggagtaaggggatcctgtgctttggagcagttactgagctttttccaataatgggaaatcaggatggtagtgtcctgctagtaaaggggtgagattgagaaccaactggagcaggcccatagcaacctaaggtgactgtgaagagagaaactggtcacaaagaaagctgccactggaaggcctagtggtgtacaagttagggttaaaatagtgataataatcagagcaattgcaagtaagatttctaatattargatcatcttactctgaagagaaaggatgttgaggggcattacttatcttttcacttaaagaggaatcacagattttccagtgcctctcaagtgtgttctggagctgagggcattgcttccagatctggtgttttggagcctttccatggcttcactcaggtgtgatgtatccaactgacaatctctgatactttaatggctctaagggtgaagaggccccttcggactggagttagttgggaattcagagttccatctctccaagctttaataagaactagtgarcctggaggatacagaggctggtatttttccccttctgattttggctttctttgtaaccaaaattcctggagagcctgttggaaacctgctaaagaagagacacagtaggtgattttggcagttttttcatctagcattaagtctgaatataggaatggcttaccatataaggcctcaaaggggattaattgcaagggagtctgaggggcaatatggatccaaagtggggctaagagtaagaggtccacccatggctgtgctgttttctgacagagtttattgagtatgtgttcgagggtttctttagttctttccacttttcctgaaggttgtgatcaccaggcaaagtgaaggtacatttatgcttactaacggccctactaacctgttgagttacttaggaaataaaggatggaccattgtcactttgcaatgacctgggtagctcaaaccaggaaatgcrttcctttaggaggaatttagctacctcctgtgccttctcagtctttgtggagcaggcttctacccattttgtgaaggtatctacacagaccaagaggtacttttacctgaagcctgcagggagatgagtgaagtccatttgccagtcctccccagggtatgtacttctcctctggattggacttattaatggagggggcttccctctctgggaattatttatggtacatagggtataggcttgacaaacctgttgaatggttttgtttagtcccttcccactgaacacttatttacaaatttgtcctagactgtcctttgcaaggtggaagaagttgtaaaaactcttaatgactttccattgggaggttccatttttggacccatcttttctaataycactttaatgggaatagcccctatttgcattatggctgagaagaaaaatggaatagatataggggctcttcccagtacggtttgcagtgtgactctcactgtagaccctaaccaacaaacttaccaaacatacacccacaaccaattctgccatcaaccaagattccccacacttttctccatctacctgccaatttcttcatctctcctccaatttctccatctacctcccaatggaaagcttttccctgggaggctttccattgggaggtagatggaaaaattcttccaatctgtaccatccactggtttcttctttatacccatgttggctggaccaatctatttcttccttagtgtattggagaaagggcagttcactggggagagagaggaacaagtctcccatgaaggtatcatttgacatggctgcctcttcagcrtttttgtcagctaacctgtttccccatgtagtttaatagaagcccctgtggtgtccttcacaatgctctactgccacttcctggggcaaatgagcagcctccagtagctctaagayttgagacccatacttaataggagcatcctgagctgttaggtaccttctttccttccagatagccatgtgggcatgaagcaccaagaaggcatatttggaatctgtatagatggttattctttttctttcccctagttttagggctctggttagtgtgatgaattcggctagttgcactgaggtccctggggacagagctttagtctctacaacttggtgatgggactctgtagcataccctgcatatctagttccatccctgacgaagctackgccatctgaaaaccatattttgtctggattatctatgggctgatcctttaagtcttcccagctggcataaattttgttaagaatctcacagcatgaatatgttgagttatcatctcctggtagtggcagtaagagggctgggttaatggtggaacactgctcaactgttacctgtgggttttccaacaacaagacttggtactttatcaatgtgttgtcagtgagccattatggtccttttaaattcaataaagggtctatttggtgggacattaggagccagattgattgtcccattgtgataytgaagtcctcctcgagaataagggctgctgtacccactaccttgaggcaatgtggccaccattgtgctgctgggtctaggttctttgaaaartaacctacagcatgtttgactggcccaaaggtttcagttagaactcctagtgctataccttgccttttcagtgatgaaaaactgaaatggtttggttagtatgggtagctcaagggctggggcttgtgagagggcagtttttaactacctaaaggcttgctcctgattcttttcccagagattgtgtccctattagtcccttcttttaaagcctgatataaggatttaataattccaccacattccagtatccaaagtctgcagtatcttgtgatccccagaaaagctcaaaattgcttttgggtggttggtgtagtattctaaggattgcctgtatctattctgcagaaagcttgtgttctttgaggctcatgattatccccaggtattggattgcttgtcttagtagctgtgtcttggccttggacactttgtaccttctgtctgcaaggaaatttagatgttggattcctaactctcttgttggggagcagattaacaggtcatccatgtactgtaggagatgccctcccatataaagacttaggtcctgcaaatatctagccaaggcttgcccaaacaaatggggactatctctgaaaccttgtggaagcactgtccaggtgagctgttaacttcttcctttttcattctccaactccaatacaaatataaattgggaggatgggtctagggggatacagaagaaatttttgaagtctaagaccgaaaaccactgagcatctggaaatcttctagaattacataaaggttggggaccattgggtgtattcggactactgcctcatttatgactcacagattctggactaacctgtattctccgttagtctttttaacagttaagataggggtgttatagggtgagttacaggatattaatccatgtgttagaaatttttaaatcaggggctgaagtccctctttggcctccaactgaagaggaaactgccctctgcaaggataactagaaggatccttgagctgaattgctataggcatggccattacagcctttcctggtattcctggggcccagacctctggattaattggaaggtctgtgggcagttcatccttgtgtgtggtttccttgaggaataagattgcatttggaaaagggggtgttggccctggaggaaaggttaactgaactcctagtctaaacaaaatgtctctacccaaaagaggcataggacattctggcatcactaaaaatgaatgagaaaataccatttatccccacaggcagcaccaagaaggagcaaacctctatattatgggcaccccatttacccccattgcctggcaggatttgaggataattgcccagaaaaagaggtaagcactgagcaggcagctcctttgtccaaaagaaaccttacagtcatacctgccgtgtccaaagcagcccttagcttcatcccctcaatagtgatgttcaatccaggagctggccagaccatagggccccttcagctcaaggtcatcaggggttgggattctgtcccaggggccctttggccctcagagaagtctcagatccagtggctgagcttgtggcagaggggcaagccatgcggggctttttccyatctgctccactggggctgtttgccttccagtggcctgacttctcacaccaatgtcagttatctgggagggttgtctgagggcaacctggagggggctaatggacccgtagagcagccaatagttggagctccctcttttcctttcacttctccttttcctgaacactttcctcttcctcctggtcctggttgtaaaagactgaggaagctattttgagggtgtcaggcataggggtgttgggacccagtgctagtttctggagtttcttccaaatcatctggggctgcctgagttaggaartggtcctttaggaccagttgcccttctggtgtctctgggtctaggttagtatatctcattagggcctcttgtagcctccctaggaaagcagaggaggtttcaagaaggccttgatctattaaggccaatttattgtagttcacaggctttgttctgctagctttcattccttctaccagatagaggaatatgtggttccttgtccacatgccccactaggtattgtaatcccaaaagaggtccacctgagaaactgttgtgccccctacccgcccccacccccagagtaggcaccagggtcagtcatatgcattgcatttgcaaattattgggccacttccttaatggagtcacgttctcccttagacagagtttgccctagtatgactgagaggtccctccaggtgagtttaaatgttaagcctaccttgtggaaccctttcatgtatttgtcagggtcttccataaacttacctagttccattttaatttggctcaggtattgcatagtgaatggagtttggaccctagtggctctactggggctgctaacctcttgaagcggcataacttaagggggtggtgtccagaggatggccctggttagggaaggaaatgagccagggctgggagacttggatataatagggtagaaggggagtttgagctaagctctgcccttggtttctctggggcttgagccctggataaacacaataatggtctcccaaaccaaccagagggggctgcctgactgtggctgctatcattgctggatccattttacaagcctgacaaaggtcagggttgtttcttaggactatgaaggcctgtacataggagatttttgcccaatttccctgctgccagcaaaacaaatccagtcaatagatcatattaaaatttatgatctcattttctggccaagattcctggtccctgagcttggattcaacccaggctatattacagaaaaatgttagccttttcttttttagagtttgggggtcaaacttttcccagttcttgaggatgcatctaggggtgtgtcctgtcatatggagaggcaattacccatctgtgaagagagaacagaggagaaaaaaagaaaaaaagaatgcattccctcttattcccctatcatcctttcctaaacattgcatcccccaattcgtccttacagttccaaaataaaccagtctcaccaagtacccctaaccttggtcccatctcatcatgattacccacttgagaacaaaggagatactggagtaaacagggggccccttcttcatccttggggtccagaatgaactggtcttattgggaacccctaaccttgctttccttcatccctattctaatggtaatctgtgcctatagcttgggaccagccttcatctctgtcctatgagtacttttgtctgttgtgcctgaagccttgggctggctcatatctgtctctatgaccttatggtgacctcacttggagcattctagcaacaaaatgattatttcttttctgatattcctattttggggggcataaaatttgaataaactttaatgaaaaaggcaaattaaatgtaaaaacattgaaattattcttcaggctttcaaagaagttgttgggttttttaaaattatactttaagttctggggtacatgtacagaatgttcaggtttgttacataggtatacatgtgccatggtggtttggtgcacccatcarcccatcatctacattaggtatttctcctaatgctatccctcccctagtctccaccccctgacaggccccggtgtgtgatgttccccgccctgtgtccatgtgttctcattgttcagctcccacttatgagtgagaatatgcagtgtttgattttctgttcctgtgttagtttgctgagaatgatgtgctttaagtagacgggaagactggttctcagccaacggctgcaaggggttggactttcctcccttcaaatatggccttgaaggtccttatacctattgagaagaatctggaagtgatcagaagaatggggaaaattttgtatttggggttccttatcctcccggggtaacatggagaacaaatgcttcaacaggcaagataatccctctgctacaggaggaaatgggaagaagcaagaagaattcccacggaaagccttcatgtgcttgcaaaaccagcagcccttggattcaaaagggcagcattttttgccttcttaacataaaggaggaatctccagaggacttggggcttggaagaataagggtttgcaaatggcaaaggaagaattttccttcctccctaaggattgcttactcaaaaaaaaaaaaaaaaaaaargtgggggggcagtggtagtaggtggggtccttaaaaagccacagagtgagatcctatgcagtggataaacagcatcaaaagacaccaaaaaacttggccctggagcatagcataaacgaaatgcatatggtaagtcataaggagctggcaragtcagggttctggtaagtgtctgtcctaraaatgagccaacagacatccacaaggaagcccatttctttgctgctatgcaaacagcaagagcttcaggcatataaataacaaactgggagtgtgtgtttaaggcagagtaggaagtcgtgtggcatgcaaagtgaaagcggggaaaaggcagacttgccccctggtgggtacgcaagaccatttcagaattcacagagagaaaacagaataggtggtgttggttttaggaaaaaagccaattttagtaggaaaaagagaggaaaccccagacattgcacagtcttaggctttagccctacccctctcatgagcctcctatccaggagagctgttattgtctcaggtctacttggtgcagtctccaaggttttattcacccctgtgagccaccatcagggccagctgagagatcagctatggggaccagagmtactgtgactgagaggaaccattttgggggttagttaataagcaggagaatgaaaggggagaaggaaaccatgtatgggtatgggggttggatgcctccagcctaagaaggcaaggcatagagatgtcttaccagtagagaatatatccaagtcatggtagcaaagtatttttgcactggcaaatctgtacagctctacaacagctcaattcttgcctcctcaaaggaaagaattcatcttacttgtataaggcagagtgagagactgaggcaagttttttagcaggagtgagagtttatttaagttttagagcaggaatgaaaggaagtaaagtacacttggaagagggtcaagtgggtgacttaagagatccaaatgcctcatgtgacctttgacttggggttttaatacattggtatgattctggggtttgcatttcttctcccctgattcttcccttggggtaggctgtccacatgcacagtggcctgccagcacttgggaggggccgcatgtgcagtgtgtttactgaagttgttcacatgctcacttgaggtgtttttcccttaccaatcgagtggcaggttatataccagttaaactctgccattttacctcttagtgcgcatgcttggacccactcacccaagccaagatcctgagatcttatcaggaagctgctgatcaccagcttcaggtagtttctatctattgggagactggctttctctggtgccagctgcatccaattattattttagtgagacagtttaataaccacctgaccatcacctcatggtcacctgacattcctggtggtgggcagtgggagggggaggctctccttccctgcacatgtctgcctaactacctactctaaccccaataccggaatcccaacatgaaccccaacatcctcacttcctggtattcatgcccttgcatatccccctacaacatcaaatagggctgacctgtttaaccaataggatactctagaaatgatgatgtgtgattgtcaaggtcagatcatacaataacgctaccatttccaccttgctcccagaaagaatgtgttatgataaacatttctgattatttttagctgctaagttccaaagtaatttgctacgataaccagtacaattaatgaaatagaaaatgaacatataatggagtgattcaacaaaccttaaaagttcattctttaaaaagattgataaaaactaatacccctgtgatgagacaatgaagaaaaataatggctcaaatatccaattttagaaatgaaaactaaaacatgtagatgctatagacagagagggaaagaggagtcaatgaatcattttatgccaacaaatttgaaaatttaatgaaatggacaaacttctagaaaaaatatatcatactctattaattagggtaagacgaaattactataacacatagaacagaaatatagtagcttaaaaatcatggatgtttatttctctctcatctaacagttcttgtgagagttattagtaggggagtttctcttgagggggtcattcagagaccccactcatcaaatccttcaggaaagagaaggcacactcagaacggctattgagggaagttctttaaggggactattgatgtaaggatgggaaaactaagggaaattaacaagacacaatacaatactccagtgctagcaatgggatagaagaggtggggtgaggggaaggccaggagctcttaccatctctaggtttgaaggaataaggagtggaagcagatactggcacaagaagagggtagacaaagtggagactctcccagtagatgctgtggccattggtagaaggatgaagccaacctgtgacagctcagcacagagggcatggagggaatagatatcctgacttaacttattccaccctttgaactagaagccagaaggcaagggagctattggtggagttcataatgcctccagggacggagcattgagggggctgcatagagagtgaatcttgagcagtgagtggctctttcatattgctaaccattcctaggtgactgcggttatctgcatggttgaatctaggtcactactgtgtctgtgttctgtcaaagtggaagaagaaagactagagggaatgtaaagaagtacccaatgtcttaaggcccaggaccagcaatggtactcagcacttcaaattcccttctaatggtaaaatctagccacctggccatacccaactaattgcaaaaaagaaatgggtaatgtcaaatgactggagagacatgttcaaggaaaaagaaaataaattttagtgagcaattagcaatctgtgcctgccatttggccaccaaatagccatctgcacccttctctcacacattgactccctcatccctcaccaagggataaaaccccaacccccatccaatttctgcacccacttcaaagtacagtatctccaggtgatgttctgacctccacgttaggtccactagggctgcatgaggaaggctagaaaacaaaattattatccaccaacacatctagattacaatctagagtgtgatcagagtaactataataagcagtcttaggaaaagaaaggaagaagggaatacacttaatagtcactgaaaagttgtttcttttcttttcacattgcatagcaatgagattattattccaccagagaggaagtgagatggtcccctgtcctgaccatggtgtacttccccatgttctttatgatttcaaattttgccctttggaaattcttcctagtctgttatgctttaaggccacctctgaagtgggtcttgaaaagaccatgtaattttagtatccatttcctacaggtataggtctgagagtctgaggacattttcaggccatgcttctggttgcttttgaaatatcaataccttagaaacttgataggcttctgggtctgtttggttccatgtgccagcaatgtcacccagatttcatttcagagcatggtgttaaagccaactttacttcctggttaccatgacccatttccctctctcatttaaatgctgtctcttttgaggccatcagaatatatgggcaagaagaagcaacacctttaatataatctcccatgactagttttcctaatttggaggcattgggaagggctgtgagccataacaatcttacctcctggtgttaaggacatagcaccatatttctagacattctctgtagctttttcctttatacctgctagttctctctctctctctctctctctctctctctctctctctctctctctcttttttttttttgagacagagtctcactctgtcaccctaggtggagtgcagtggcgtgatctcagctcactgcagcctccgcctcttgggttcaagcaattcttctgcctcagcctcctgagtagctgggattacaagcacacaccatcacacctggataatttttgtatttttagtagagacaaggtttcaccatgttggccaggctggtctcaaactcctggcatcagatgaccagcccacattggcctcccaaagtactgggattacaggcatgagccaccatgcctattctactagttctcatttgaaaacacaatttttcttttactgacctctgctaaaagcatcaaggaatggccaacacacatcaacattctggttgctctctgggtaaatgatcaatctttcaagttactgccagagagagttttacaaaatattttgtgatgacagtacaagagtccccatttttgcagcctgtgtgtgaaatctgtttcctcagttctgctctaacgacgtatttatctaggttcaagtttctatatttttaaggtcatgctaagctgttgtaatgaagactccaaatatagtggcttacaggacgtagacattgctggaaggtagtgcatcacagtgggtaaaagcacagatttgggagtccaattttctggatttgaatcccagttcagtcacttactaactgtgcaaatctggccttctctgagcctcagtttaaaaaaaaaattaggtaataatagttactactaccttcagctggtaataaatctttaaaattgaggtaataatattacctagcattggtaagaatattaaaagagttaatacatataacatttagagttaatgtatgttatatgacaatgccatagaagtatctgctaatttttttagaacatttatattctctttcacataagagatctcagataattattccaaatcagtgtgaaaattctgatacttcaggggactaagagctttccattgagttgcttacactctatggggcattgtcattagcttcctgatcaaaattcgctcaccttcacatcagattccagccatggaaagaagaaagagaggatgagaaaacaygtcaaatatctttgggcccaatttggaaatggcacaaactacctccactgacattctattgataagagaatagttatacaattatagctaattggaaggaagctggaaaatttagtttagctggtggtatggtttagctgtgtccccacccaaatctcatcttgaattgtaatccctataattcccaagtgtcaaggaaaggatcagtgggaggtgattggctcatgggggcaggttcccccatgctgttcttgtgatagtgtgtgagttctcatgagatcttatggttttataaggcagttttccctgctcttgttcacactctctcctgctgccttgtgaagaaggtgcctgcttccccctctgccataattgtaagtttcctgaggcttccccagccatgcagaactgtgagtcaattaaacctcttccctttataaattacccagtcttgggtctttctttcttttctttcttttctttcttttctttcctttctttcccttctttcctttctttcgctttcttttccttccttccttcctttcattcattcattcattcattcattttgagacagagacagagtctcactctgtcccccagactagagtgcactggtgtgatctcagctcactgcaacctccgcctcccgggttcaagcaattctcctgcctcagcctcccgagtagctgggattacaggcgcacaccaccacactgggctaatttttgtatatttagtagagacagggttttaccacttttggccaggctagtcttgaactcctgacttcagatgatccacccaccttggcttcccaaagtgttgggattacaaacgtaagccacggcacccagcctcaggtatgtctttatagcagtgtgagaatggactaatacagctgggtagcctcttgccaagaacggaaggattttggtaggcagttagtacattctactacagttccttaaactgactcgaaaagagcttggaatgtattataattctataatgattgaggaaattaagttagtgaattagtataaaatatctttatattaaaagaaactaaaaagtcaaaacaatgaaaggtctataaacattgaaatggataaataaattatagtagattcatacaatgaaatatggacagcaatttatcccacaactagagatacatgctaacaacatgtatgcattttacaaataatgttgagctaaagaaaacaaaagcaattcatgtagtatgattttgttgtgggggaattccaaaataaaaatcaaacaatgttgtttgaagatgcatacctaggaggttaaactagagagaacagaaaggtgatgattatcataagagttaggacatttgttgcttcagggaaagctgtcaagggaaggtacaggggaggcttctgggttgttagtaatattatattttaacctggatggtgatttacattggtgtttgttttrtaactgtcctatagaaggatatatgtattttatacactctcaggtatatatgatgtatgtcacaattttctaatggatatgagagagcaaagtcagcttcaaaaaataaagggcaagggtaggcctaataataaattagtttagtatttgtgcaagaaaaaacaaatagaccaattgaacagaagagagatctcagaaaacaacatatttatgtatgcagaattaatataagataaagttagcagcaccagtcaatagggaaaggatgttttgtttaggagatggcattgggagaatggtctcactctaaggaaacaaaactatatcttatccaacatctctagataactacctaagaaaggtggactctggatgggttaaagatcttaaggtgaaggataactcttagttaatagaaggcaataaaggagagtatctttatgacctaaaggtagggaagaacttctgaaacaaaatttaaaaagcattaaccctaagactaaaaaacctgattgaatttgaatcatcaaaattaaggatttccactccttgaaaaacaccatggcaaagataaactgacaaggtattagtaagtagactatattaggaactcttaaaaataacgaagtggggataataaccccaaggaataacagacaaatggtgtgaagaagcaatttacagaagagggggaaaaatgacacacatgaaagatgctcagaatcctagtaatcagagacgtgccaattgaagcagcacttttaaattactttatacctattagactagcaaagaattaaaaggcttgatattgccaagtgttgatgaggaggcggggatgtaggggaccttatgcatcattggtggcagagtagatagttgtacccgtgacagttaagatccagagctcaaggaaccacaagaactgtaggctccagagccactcctgcagccacaggcctccctgcaaaacagatgcttgcaatattgcctctttcctcagttatttctaaatttaattttgctcaagtcctggctaacttagatacaaaattacatcctatactctggcttcaaggcagttgaaggaatatagcctttagtttctatctctgcagggcaggtatgcacactagaagagtgaggtccaaccccccagttggggttcaggaactggtattttataaaaactccatacattattctaatgtatgagccgatatttaacaacacttcaccaaaaggatgctggaaaagagcttgaaggtcctgatttagtgtcctcactacacatcacagaagtaagacctaggtgcacactaagtattattgatgtgttcatgtttcattgtcacaatacagcagaaatttgtctacagcaagaaaacaaatcatttactttttgccaaagttcatttttattgtgcaatgagattttctagaagagtgattcactagaaatgtaaatgaccatattagcacagccaagggcaagtcatccaactgagggaaaccaagaggaatgtwcttaagcagaagcagagaatgtaatgaaaatttttaacatattcagtttcatattctgtctaacagatgtatcagaaaaagctcagtcctttagggatgactttgggaaatggtgaatgaataggtatcacatacttgtgttcatcaagctccaggctttgcataccagaggagttctgtggtttctgacagctaactggtraatcacataaaccatagaatgtaattgattctatcaagaagtaaaatcaaatgaagtatagatggagcattctgtggactgctatcaattttctctaaagaaaaaaagaattggcttctgccatgaatctgaagattgtctgtgggtaaaatgcaaatggaaagtaaattgttcatgaatgaattctagaaaagcccactggtattcatagagagagaaagtaaatatctatatagaaattttgggaataataaagtcagatgtgccctactattaataggtttaaacattttgatcatttccctatctttatcttgctttactcactactttccaggacttttcctaccaggcactgtcaataaatcatgtgcttctgaattcctctgtctcccattctagggaaccagacagacatcaaatatgtatctaagttgcccaagacaggagccagatactcactttatcagcctttgtggtacactggacaactgttttccatatattccatttctcttcttgctgtgccactcttagtgggctgagtatacatctctgtgttattaaactcaggaatggccatgtgacttagtttggccaatgaaatactggtagaagtaacacagatcactttcagatagaaattttaagagccactgtagttcactgtgtctcttttctctttgcccccagactggtaatgttgtagatatagcttgctctgccagactggaccctggattagtgataatcagaagcagagccagagctaacttgcaatggacaagtagcatgagcaataaatgttaaacataaacagtaaaccattgctgttaccagcctctgttgcagcatgctgcagtagttcattctttttcatttgctgtgtgtggtatttcattgtatgaatatttcacaatttatccattccactattgatagacacttatatttatccaagtttttgtacattatgaataaactgcaatgaattttcttgtaaaatgtattttaatgcatgtatgtaaacatttcttttgactatatagaattggaattactgattaataaatcacatatatgtgcagcttttgcaagtactgtcaagcagttttccaaagtggttgtagcagcatactccttcacgaataatgttggagagttctasttgcttcatttctttgccagcacttaataatattagttttccttctttaacttttaactatttggattgttatgtaagaatatctcattgtggttttatttgcatttcttagataactaatggagttgaacactttgtcttatggttgttggccagttggaatccttgtttgtgcagtgaatatttaacattttgttcatttaagaaattaggttgacattatttttcttattgatttgtaggtatgaatcctttgtgcatacatgtattgaaaatatattctattttttagagtctttttcttaatcacttctgttgatgaacagaaagtctgcaattttaatgaaatctaacatcaatatttttgtttatgaatgttgctttgaatatcctcttttaaaaatctttatgtaccccaaaattatgaaatatgcttccttgtgawcttataaaatatttatagttatttttcacatttagatttttcatccacccagaatatacttttggttgtcctgtgagtaggaatcaagattcattttggccatatgtatatccaatatatacagcatcattttattgaaaagaaaatcttttccccactcattgcagtggcactttatcataaataaggtaaccatttatgtgttggtctacatctggacctttttttttttttttttgagatggagtttcactcttgttgcacaggctggagtgcagtggcacgatctcggctcagtgcaacctctgccttctggtttcaggcgattctctggcctcagcctcctgagtagctgagattacaggcgcccaccaccacgcccagctaatttttgtatttttagtagagatggggtttcaccatgttggccaggctggtctctaactcctgacctcgtgatccacccgccttagcttcccaaagtgctgggattacaggcgtaagccaccgcgcctggcctatatctggactttttgttctgttccgttggattatttgtcagtcattcaacaaaatcacagcgttttaattataatagatttataataaaccttgatttttggtattaaaatcccccaaatttgttcttcctcaaaattttttatggatattcttaactcttygtattttcacttaaatttagagtcagattgccaatttgtacaaaacctttctaggatttgtgttggaattttattgagctccttatagatcaatgcggggagaatgtacatcattaaattgccacctttccaagatctgaagttggtatatgtgtctctttaaatgtttagtttctgttagtgaagttgtagattttcgtgtagagattttgaacatcttctgttacatcctaagagtttagcagttctgatgctcttgtagatagtatcttcttaaaatttcattttctaattgtttgttactacacaagaacaaatgattctgtatactgactctatagctagctaccttagtaaatttatgtttttattttaaagtttatctgtagagtctttcgtatcatctacataccaagcacattgtctgtaaataatgagtgttctagatcttcttttccagccttgacatctcctctttctttttcttacctttagtttaatattgggcataagggataatcacaaatgtctttgttcctttctcaatcaccagggaaagctttcaaattctcatcgagtgtgaaaattgctgtaactttttctctttggcaaaatattcttcacctgattaagaaatttgcattctctttctagtttactaaaaatgtttttaattgtaaatgagtgttggatttttaaaatactttttctgcatctattgagatcatcatttttcccctttattctgttaattatatgttgatttaaaacttcaagccaaactcccatatggtgtataaaccttacttgattatgatattattatgtttttataattgtggacttacttgactaatattttaagatattaatgtccatgttcataataaagattggcctgtaattttaatttcccttttttgtaattaattgtcaggttttagtatcaaggttatattcacctggtgaaagacttgagagttatttcttctttttttattctccaaaagttagtgtaaaatttagcattttttcttccttaagtgtttggaataattcacttatgaagctacctgggactaaagatttctttaaggggrattttaaagtatagattacatttatttaaagaatatagaaatattacaattaaatgtttctgcytgtgtatgctttgataaatttagcaattcattcttttcatttaaatttgcagatttagtggaataaagtagttcataatatccttttgttacatatttaggatctgcggtaatatcctctttatttctcacatttagaatttgttttctttcycattttctttctgtcagtcttaccacagttttatatctttcattagtcttttcaataatcaacttttgaatgttttgtcctaagtttttattgtagtaaatttcacatagtataaaattcatcatttaaccattcaatgacatacaattcaatggcattaagtatgttcacaatattgttcaaccatcaccatgatcttgcgccagaatatttttcaccatctcagaaggaaacctatgtgcattaagtagttattccccatcctcctctcccctgcagttcctgacaactactaatctgctttctgtctttatggatttgccttttctggctatttcatgtaaatggaatcctataatatgctgccttttgtgtttggcttctttcacttagcataatgatttcaaggtgcatctatgttgtggcatgtattaggactttattctttttttataactgaatgacacttcatacaatggatagtctctcttcaagtttgttttttatttcattgattgctgattttatcttcatttccatccttctcctttctttggatttttaagctttttgagatgtgtgcttagacaattgaagtgaagtgacatagttctgttagctttcccttttcgtactttcagtttctgtttttaggtgcacgtcagttttggtttgcccatatctagacatacaaacttagggctcctacacttcctaattggatgactttgtatgaatggggataatcgtattgatcctatctccttgtccagggtcttgtgagagaatgtaaggtaaaagcattttgtaaactaacttccagacttggatagtaccttgtactttgcactgccattgctttatatctgcatagtgctttcacaggtttttaaaaatttaatacagcaaacccacaggaattatctccattttacagatgttatttctgctactatagaattttcaggaagtgaccatgaatttagtatttaaagcccagggtttttgggtttttttttcttccagctttactatagctgcctcatgcagaatggtattattggcattcttagaacattggaatttcacactttcagaaacttgagaacattgcaacaactgccaacagggctcagcatcctctgcagatgaacaacaccaagtggtatagttacccaatcaatccttttgcacttctacaaaattaagcttggcaaacttggctctggctttctaccaattcattgacagtttttactgactactccgtgaattaggctttttgtgggaaaataaaagaatgggttgatgtgattgttaccaaatatatttaggaagaagtatttgaacatgtgcaaataaatacttagcacatgaggatcaagggaggaaaggaaagggattctaatagtcaaggtgagatctgagtttttaaagaagtttgctttttaaatgtttggttatacatttctggtgataaaaaaattctaagtttaaaacaccttcataacttctcataacatttaaaatcttcacatagcatggactcatactcttgtctgcacattttaacatgtgtgaaataggaaattattgtataattaatagtttcttagaattgtgttgtagattaattatagtttttcttttttagtagtacataaaataaaagaataatagatagttatgtatttaacactgatggcattacagtaaataaaatatggaacattaaagtattccagaggattctgtaataacttttaaacattcattcattcattcatgtattcaacaatatttattgagcacctagattttgttaggtgctgtaccaggcgttagagctataacaacaagcaaggcatttttatacaggcttctggtctagtgagaaaaacagtaccgtgataaagtattaacaatacagagtggcaggaataataaagaagcagcatggtgcaatgagacatatgagaatggtatccaagatttagacatcaggaaaaactagtagaaataaattgcaaacaggtgcctgaaggagcaggtaggatttgatcatgttaagaatggggactagtattcataccctcgtgtaattccttcaccttgagagaacagaatgaatacaacatggaaaaaatgatatgtcactttgaaaattaggttacaaagagatggtgacttccatctggcttgttaaaatgagatcacagtcctggccaatgcctgggctacgaccttgggaaagaccctgaggcagaggcaccaggtaagttgtagtcatactcctggcccacagaaagtgagaggtgataagtgtttgttgttataagctgacacatttcaggcttgtttgttacatgatggtagataactaatacatctgtagggaagtggggtggacgtaggtatgagagggattgcaaataggcatgaagaaatttggaggcaaaggatatatttattaccttgatgcctgtgatgttttcatgggtgaatatatatgycaaaacttattgatttatatataatgacatatattgaattataaacacatataattatatttatatattataaatgtgtgcagtttattgtatataaattatatctcaataaagaygtttgtattttaaaatggggaataaaaagcttatggaaagacagtgtttcaggcaaaagagcaaatgaaaacaaaagcccagagcaagagctccagaaaaagcagaccatttcaaagtgtgcattgacatgggaaacctttgctcttggatttgaaagagataagtaggttaagggaaggaaggaggacaagattggttgtgaaaagaggtaaaagagaacaaagagaacaaatagtcagtgacttcaaacaaataccatggatttttgtgcaagaaagaccacttgggttctttaaggcccataggacaactgggtcagaaaaggagagagtggcatctctagtctactcccaaaccatctttcaatccctgctcctcctgcctcctttatccccaaccccttgccattcatttgtactttccttccctttacaaatatttgagcatttactatgtgccagaaactgttctaggagttagagagaaggtagttagcaagttaaggtctgtgacctctaaaagtttacatgctagtaggggaaggcaggtggcattaagtaggaagatgatttcctatggagtgctgtgaagacagtggtgatagagtccttaacaccaggtatggcacagcctcaatcagtcagttcagtcccagctgaacaaaacactatttgggagaagaatcctagagaccctactgtgccaggaaataataccttggttgctagatcatggtaaagtgagggaggattccagggaagagagaatggtcagtattgtggaggacctcttggagggtctgaggaagtggttatttaacaaccactgtagaaatatgtcattattctaataaccagtaattctgtactggtgctaaccatttgatatcagcactgaggtcttagtaactggtgcagagagagggttcaggagaagagggtgtggaggaagtctactctagatggtaatattgggaaaggcctctcagaagaagtgacatttaagctatgacctgaatgaagagaaagagaaatgcaaggggtagttgggaagttaagtcagggggatgggaagaggattctagccaaagaatagcaaagacaatgatggtgaagtgcaataaacttggtgtgtgtaccgaatggtacaaaagctaatgttgctgcaacgttatgctgagtgaattataagaaattaggtcagatgataagcacagcccagatcttgtggggcctttcaggccacaataagaaaataaaatgagaagccacaagagggaggattttaagcatggaaatgatataatctgatttacatttttaaaggattacgtgggccttggtaagaagaatggatttgtggggagggtgattagggagagaacaatggagaatctgttctagcctggagatgatagcagcctgaaccagagtaatggcagtggaaatggggaaaattgggttgattcaagattatttgaaagttgtagtggtttcaaagagctatctatacattctttgatatgtgggctaggcatttttgcactgctataaacacctgaggctgggtaatttatataaaaaaagttttaattggttcatggttctgtaggctgtacaggaagcatggtgtcaacatctgctcaggttctggtgaggacctcaggaagcttaaaatcatgggggaaggtgatgggcatcactagcatgtcacatggcaagagagggagtgggggkggggggaggtgctatagtcttttaaacaaccaaatctcacgtgaactcagagcaagagaactcactcattaccatgaggatggcaccaagacaattcagagggatctgccaccatgacccaacacctcctaccctgtcccacctccaccattggggatcacatttcagcatgagatttggaggggacaaacatccaaaccatatcaatatgcctcaaggcatatgaaggggagcctcaaaaggtgaagtttaattcttctcaccttgaatgtaaactggagttagcagtttgcatctaacaaacagaatatgacagaagttaggggatgtcatttcagaagttaggttaataaaagattgtggcatccattttggaggcatgctatctcactctttcagattgctcattctagtgaaagtcagctaccttgttctgttgtagttctgtagagaggcccacgtatcaagggactgaagtatcaagggactgaagtctctaaagagctgtgtgagtaatcttggaggctgatctcacctccttcacccactccagttgagccttcagataagatggcaattcacactgacagctcagctgctaactcatgagagaccttgagccagaggtatctagctgtrccatgcctgaattcctgacccacagaaatgatgagataataaatgtttgttgtttttaatggtgagactttagtataatttgttatgcagcatacgataactaatacaaaatagagcctataggactgactgatctgtttggtgcaagagggtgtgaggaaaagagatggatgaaagaagatatgtagattttggacttgagcaactggatggtagtgatgccatttattgaagtgtgagtttgggcaggggggattaagagttttcctttggacacattttgaaaagactrttaaacaccccagtgggcatgtcaaccaggtagcctgctgggccctgcccaaattccttatgcactgtttatgagcataagaaaatgattgtttggtttagcagctaaccttgtgaaatatctccaatcttccattctcaccttaacccattctaatatggtttgtgttcttttgactcgtgtagaatttgttcttattaaaccacctattgtatccatgttatctaattcagtagttacttctctgccataagcatactcaactcatagccacattggacacagatcatcattcccccycttttcsaatactcttctcttttggattcattggttctacttcttaggtagattcttctgctccacctggtgttaaccagggtggcttagccagtggtattcagttggtggccaggctgtggtggctgggcttgtctaatagcccacttcattcatttstgcttccttggtgccgatggttaagaggttggcttcagctgaccactttccctctccatatgttcatggcctttcatgtgaatgctccagtggagtggtcaggttttttacatagtagctcaaggcttaagagcaagtgttcagaaggagcagagagagagggcagtagytacaatgtgaggccaaagaagcttccccccagaaarctaaaggtgataagtaaagcatgttggtattggctggcaatattccacaagagatgaaaggacagatattgcagaagagagaaggtataactgggaccaaaagccttgagaaggaaasagacatggagcaaatcattcacagtaacagcagacagcagagaagagasacatggttgtacagaggcacctcctttgggtctttactcaaatgccccattatcagtgagaacttctctgactgctrttcttcagcagagggtattccttatcccctttcttgctttatgtgttttctccataacatatgtgcatatccataacacacacatgcatcacctagagcrttatatatgccacagtgacatgttttgctgatttctcaattgactccccccattggaatgaacgtaagcttgaggaagacgttttgtcctgttctgtagcatctagaacagcgcctggcacatagtaggtactcaataaatgccagctgcatgaggaaatgaatgagctgtgtggggratgtacttgagtgaactctaaagtcagagtggtgttgagagaaaaatgcttgaaatccagatgttggaaggtgacacagagtagtagcctggtgagaacagttagatcttaggggttcctactacagccctcccttccgcacctttttggctgtcaccatgatcaagctactgaatctctctgagacgcaaggaccgggatggcacaaagtgagtgctcaccaaagcttgactgtcctttcccatggcaatttacttcagcttgtttgatttcccctccccgactggactaggcacctattctctgtcttctctctttacagttggaaggagcaaaatgggacttttggctgaaagtgctgagctcctgcggtgggggctgaccgcaagccrcgccttctgtgcacctggtcggcccagctagctgcsgacccggcggggaggggyggggcgggccaatcggcgctgccccagcagggctgcggctgcaggcaggcagagcctcctagcccgtcggtgtctgcgcccatcgatccctttgtctatccccgaccatggcgaagctgattgcgctcaccctcttggggatgggactggcactcttcaggaaccaccagtcttcttaccagtaagttgggttgtggtgagggctgcagccttcgtcctcctcactccctgccagctccacgagcccccagaaagttgggtccaggctgttaacagaacatttacaagcaggtgctagatgcacactctgcgggggtttcataaatgtttgtccagccgtcatgtgtcacttgaaaacaaactcttgctcatggcctgagacatgggataaggaggcaattgccagsggtgtgagtgcccaggttgtcagcatacacgaattaatttttcatgaagatttgtgtgccctggctacagattcacttctcaacctggaaagaaacaaactaacctggctgggggttctcctgatattttgtgtattagagaaaggagcccctgtcgcttctgcgccttgactgcctggccatggcaaaccttccaggcttgaagattctcaaattgaggctactgagggccacagcaaaactgcgtgtggacccgagcaggtggagctaacgtgtgctgtgatggttcgcttcagtgggggcaggcggggaagagggaaccctggagccagcatctgatgtcctggggtttagctctgccccatgagtatgcgatttgggcaaatcactttacatctctaaccttagctgcttcagtaaactggaaatagtaatacacactgcctgcgacagagtagctattcaataaatgttagttccctgcttccctttaaagtatttaataaagggttaagtgctatacaaggggggtggggatattttaagaatgtatcaaaagtttcmtaacttttaacaggagttcaaagtctacagatcatcctagtctctaaggcttagtcaacaatgccttatttactttaaagtaaaacctaataaaaattaaatataaamaaattatatgagcttatggactaattagaagcttacattcagaatgggtttttrctatttattgtggatgtttttctaatttttttaagttacagagtgcagaaaaaaagtaagragcagttgktattcttggcttttaaatcatgtaaaaattacagyttgtgagtttttattaatcacagtgctggtggctgccaaaggagattataggtatagataaaaatatatagataaaggatgggttgcygagcctcctggagtgacccagacagaggaaggaagggaaattttacccactgttggaaacccctaaaacctagctactcaactgggtctggggaccagatgcctgagcatcacctaggggctccctgyacaggcagaatctcaagccctaccccacactattgaatcagaaccagcgtcatggaacaaactccctgggggattagagatcatgaatctgccccagggagagaaggcaagagatgatatcatgaggyctgcatcaggagcaagccaaatccycaggatagatgcatccttttttcttcagacttggagtgtatgtgtgtgcggctcacaggaagctatatatgcctgggctggagggaacttaaggaagcacacaagggatgcctcaagagatttctgagtttcccaggtgggagcagtacagagaaaagaactgagagagttcccctagaccacgagtctcccacmcacgagtctcccacctttgtagtcggctgtatgtgccgcacaagtccagggaatgccttggatgatggtagaaacagctcccctcccctaccccaacttgggctatggaatgttgcagcatctgtayggcaacttccttgtccctacattgctaattgcaatacgtgagtccactgagtttcccttctcagaaggaaaccacaaagytaacgttgggcctctcgatgcatttctgccattccatgcttactgtaggcaacacacagttgtgggaagagagtagttgtggattcctgatgacctgggttagatatcatttctgcaactttcaagttattttaccactttattccagaaaagttccagccagtttctccacccgaaaattaggggataataatacatattacagcatatatatatatayayacacacacacacacacacatacatatatttatatttatataaaacatataaataaaactaagwatatatatatatataaaaatcaggcatatrgcagatgtcctgtaaacgttagcttttatagctgtcatatgtgatctcaaaaatatagagtgatacttgaatatgtattataatcatacttcattgaaagtctgagataaggacaaataatcctccaaccctccagtctcccctatgaatgcaaccaacaccatcttctcagtctgatgtacttgcctagtatctccacaaaacacttcagtggacatctgcagagtaccttctctttgcaaacgttgtgtttctgctggaggttataggaatgaataggttgcagtattcactcaccaattttaaagtctactgggagcaaaagaacaaaaactgacagctgtgaaactgacaactatgacaactatggtaagaaagttgacagatgtatatgtgaaggttcctgagggtaaastaaggagttattaatcccaatgcagaagactggagaagctacaaagcatcatgagtmggggtctttccagtgggtaaygggctaaagagcattctaggtgaagggaaaagtgtgagcaaataaaaagaggtatgaaagaaatacagggaagagtccttagtatcatgacacttgatttcaaatcccaactctaccctcttaaataagcaaccacatgcaatttactcagcctctcagtgcctccatttccttacctacaaaacagggtaaatattcatctttttctcaaagrtggctaaaaagattaaatgaggaartatgtgtgagagcccttattggagcttggcacatagtaggccatgaaaagcaatttgaatgaatgaggcgtrtgtagtagcagaaaatagaytgattagagtgaatttggccccaagaagagtttgagaatcgatacggatttcttaatgcctaggcaaagatctctgcttttttctgcgagcagccagcatgtattttcaccgaatacttctgccttggtttggatgttcgtcctctccaaacctcgtatttgatctctaatgttggaggtggggcccaatgggaggtgtttgggtcatgaagatggatccytcatkaatagattaatgmcctccttgggagtgagtgaattctcactctattyatttcgagagagctggttgattgaaaagagcctggtacctctcccctctcttacattctctctcatcccatgatctctgtgagtactggcttctcttcatcttctgcaatgagtggaagcagccagagcccctcaccagatgcagatacccaatcctgaactttctaaccatccagaatcataagccaaataaaccttttttctttatcagttgcttagcctcagatgttcctttagagtgacacaaagcagactcagacaagttcacagcaaaggctgtatggtttytgcgcaragttcagagtctagtgaatcagagatatatctcagacattgacccttatctcttaggcccagaacatttggacttaagcctttgacaagatatttcctaataaattgaaaatgaggtagaamaaatatgagttggatgataataacacaggtgggtcaattttcaggtgcatcttccagcttttaagcagtgttctctgtagattttgcctggtcagagagctaaatgtgagctttgtgttcatacttraattccaatccctgctcagccactttataactctgtggccttagaaagccacttaatcttggtcaactataacttagggaaaataacacctcacggaggtgtttgaggattaaacgcgggcatatayggtacctgaactatagtagtaatgattatcctgttgagatatgacatgtttgggycacaaattggaacccaaatcaacaagtgctgacttaatgcccccttgcccaccctgggctccctttaactgtgattattctaygttttccaggctagagatcatcttctatgagagagaagcctgaattagaataggagctgaccagttctgcctttctccatcttttgtgaacccatatgtttagtgacccttgtgagtcaggcagcrtgagtattcttcccattggttttgagtctaagaaaagtgaatttgactatccttggtgtttttcacaartcttggcccattcagtgattttatgtccttgaatctctccttccatgccagtctttgtgttgtcctcggttatgaccatcacccttaacatcttgtacctgccctttggttccttgagggcatgctacaaatattcacyacactttccctagaccagagttttttcaaatggtgggtaacaaagtcaatttagtaaataattaccaacatttaaaaataaataaaacagaattgaacagaaaagttatgaatgtatgacacagattaggatgagtattgttttgtgaagcttgattcagatgtgtatgtgtatgtgtgtgcatgtgctgggtgttcgcaccatataaaatacttttcctactgtgagtctctgtctgaaaagtttgtaagccacygctttatcacttccccttttatttccttattgtcaatatttgcaattataatgtcagattttcattttgaaaatacctttccctttcttaggttatgggacagattccaactttcctttgaagcctgctttctaagttcacatctatcaatcaggaaaccacagtytcctcacagtccaagccttcatcatctattcattcatctctgtatttctagtacctagactggtgrctctttactctggttatacgttgggacaaactgtggcacttttacaaagcagattaytaagaggcactccttgcctcttacgtcagattttyttagacagcgaaaatgatagccagtggcctgatggtaggaatgtactcatttttttctgaatgaataaatgaaagatcaatcacccccaaattcctatcattttgtaccacgtcrgtaagaaktttatctagcgtgtctgttccgcctgtagcccatccgcctcctgtgagttcaagtcatcaggaggacaagtaaatttcttagcctatctgaagccaaataagatttctagggatatttggataattgtcactacttgctatgacaatactgtatcactagttctctaaaaaaaaaaaaaaaaaaaagtttattgtttaaatctcttggttgtgctaacgtcgtctgtttctttcaaatgcagcatcagtagcttcgctctgctcaggcagccggctggcacttccytctcacatctgttcatttttcctttgtcctttactcagacattttctatggtgtttatgcactcatatctaataagtcgctcctgtgtatgtgtgtgagtgcacctgtgtgtgtgaaatgcctttttacatgcaggccttgtgtatgattttctgaagttamaaatcctttcaacgtacctgtatttttcaagcactacatcacaaagcagatgcccagtccaggctgcsgagtcagattgggcagatgagtaggaggctgcccatctgtcagcaactctaaaacatcaatggaataaactggaaccatgttgccrtttacccggactttccacytaggagtccttacacactgatgaaattgctcctgttcctrccaaagtacacagagccctagagaggatattatgtatctcttakgtgtacctatccacctctgctaaataaaaactaaatattgtacccagagktccccacttgtcttgccctggccttgcctggaaaaattgcaggaaaaactctggagttgaaactcaggcaaagtayagtgaaggagaacttttgtggactgcctacctttgcaacttattataatttctgaatagttttgtgtgtgttttatttctttctcccccacagaacacgacttaatgctctccgagaggtacaacccgtagaacttcctaactgtaatttagttaaaggaatcggtatgtatgtgagaggaagaagggtctcatttgaacttccggtatttttttgctctttgtgtgattaatgtgcctgttcaattctgtccaaaaataaaattttgaatcaggagagtcagtggtagttaatgataaataccatgttgtttgacttttgacttcaccaacatactgccaaggtgttgggagttttggttgtttgtttttgtttgatcaatagagcaaaaaaaaaaaaaagaaaaaaagaaaaaagaaaaatagaataatgtttgattccatggcaatctaacctgaggagatggcagaagaggggagggagagccagataaagcattgaataaaggtaacttttttttagaaaggctctgacaggactttgcaattacyacaaggcttctccttatgcatctctcttttgatattggacaggaaaattttttccagaagctctcagcagatttccccttagatcttatttgtcagagctggaggacaggctggtgccctagttgcaaaggatgctgggaaagtaattatcaagcctccaatgtgggaggcaggccctgtcagcaaagataaaacggtaggagaatagcagctgggaggcaaccaacaagragagtccccgggctcaactctccagctggttccaaccaaccagctttgttatttgaagacaattggtttgagatcatgcttttgtgtgctttgggtgtttctttttytttyttttttttttttttttttttgttcttttagaattattcatctcagttgattaaggctcaggaggctagatcagatgacttagtaccactaaatttcactagatatcttatggtgcgattgttttctagaaaaatatgatattgatatcaaatatcactgggtttttgaaaagcaaactttccactaagtgtagaaatacctatcaaatagttcatttttctctagataaattgaaatgttaaaaatttacatgtacttaaagtataactaacttgaagacagtaatatttaaccgatgtttatarttagtagtaaaaattcatattcttgatcanctaaaatgtatccccattttaactcaactatttggaatttgcttatatcttcaatatggctttccaagggtttaattgatttggaagtattaagtatcaacatatatttgtaatttaccttgtatctttagaaaacaagttcttttcaaataatcatggcttttgtacgttttgtgaatttccatgaactttaagaggattcagtctttgaggaaaaagctctagtccatcaatttaaaacaaatatactaagtgtaaattttaattaaacttgttaatgaattaatatatttttaatttccatataatcgcattmatcaatttgaataaatgaaagaatgaattattctgaacctattaaagaagagtgatgtatagccccagtttcaagtgaggtgtgataaagaaatggatccacatcctgcaataatatgaaacaacctgtactttctgttctcttttctggcagaaactggctctgaagacwtggagatactgcctaatggactggctttcattagctctgtgagtgttttctttcacttttctgtgttctagaacgttttctaggactggcagtttaagtctttcacttaggctttctgtatacccatgcccactttcaaataaaatgaacagtcatggtttaaaagacaaattgtgtatgcatttacacttgtgctrtaattatgatcatgygtgttctatgcatatttgtgttcttcggyctacattgaaccayattacgttagcttctattgcagcaatttttttgtgagttcagtgtattcaagaattgttttcctctcaattgtctattccctaarcacttaaaattgccatattcaaatatttgctaaattaaatatacatttaatgtatactacttcacaggtcatttcaactttcacrtttttaaacaaatttcagaataagccctttaatttaaaattgttgataggtcccaattcccaattcccaagctttgaagacagaatccaccatatttgctgaaactgtcctgcatatagatcgctatggtagctgatatagtgcaaaacaaaagaagtccaccatctggcctagggatcataacataacagagttgataggaaacracagacaatcatccagccatttaaaaacctttgctaccccttgtaatttacttagtccagttttctcttacaaagatgrtagactagtcatcctgcaaagcaatgtcttgcaaactttcttgagcaacataaggtgtatttcaagcaaaatcttatatgggaacacaatatataaaacaacagctttattgttttgattgaaggctaagaaaggagtagttcctctggcccaccaaamctctgtctttgagatgcttccaaggacctaccagggaacagtttaaaagccataagcaatattctctctgtattccttgcttatatcattgaagactattattaattgcctttttggtctgctcttccatttttgatctttctcatggsctggaagctgtagtgtcgtgcacatatgactttgctgcaggggatgaaagggtttgtgtggggtggcctagtggagcatgtggcttccagaagacttctcctggggacccattacagaagctaactaagaggcttcctatgtrgccatctggctagccctgtggtttggagcagtcaacatgaacccatgggccatgcagcgcctctattagcatttgaagtactggtattgtgcttgatttttctcctccatggtttataagggattaaagtatcctggaataaagagcttcaaccccaacagtcctggaaaaatacttctgatggaccygaatgaagaagatccaacagtgttggaattggggrtcactggaagtaaatttgatrtatcttcatttaaccctcatgggattagcacattcacagatgaaggtaacaatatttactatttattaaaaccaaaaccaaacttaaaacaaaaacagaaaaacatgccaataaatgaattattttttctcattcaaacaaagcatagtcatgaataatgttcttactctgggttttaaacttaccctctatgttaattgaactttatagtaaaaccacttaaatacttgagaatgctaaaatatttaagatttgtaaagcatctaattttgtaaaatactaacattcacattatccctataattaccataataataatatccagccctgatcattatagcttttccattttaaacgattttcaagactcgggcatttacaggaacagatttttctaacccaaggcatctgtaagctayaggtccagtgacagaaagtcaccatggtcagctttctgccggtcccattatcttcaatgcctcctgtccgctggttcctctgttctgtgttcaaaatgctcctctgcatgttggtccctttcaacataacttggtgtcatcctttatgtctttactccctttctccctttccatttgctgtcacttccttgtctctgtattaattttcagccccagttgcacaatggtagcacctgaagagtttaaaaagactcgatgcccagcccccagcttgacagattccaattccgttagtctgagggaggcctggatcacagtagttgttaaaagtttttcagttgataaaaatgtcaggctagggttaagaaccacgttyatacccattacctccatttcatcatcagacgatccctcattcagttcctcttctggactttccccactgtgggtggctaaaattgctaccttgagaatcatcagtgatgttcctactaacaaatctcctctcttcccttcctccctctccttccttccctcttcccttccttccttccttcacctccttttgttttttgttttgttttgtttttgagatggagtcttgctctctcccaggctggagtgcagtggygcaatcttggctcactgaaaacttcacctcccgggttcaagcaattctcctgcctcagcctcctgagtagcggggaccacaggtgcatgccgccatgcctggctgatttttcgtattttagtagagacgggggtttcaccatgttgcccaggctggtctcgaactcctgagctcaggcaatcctcccatctcggcctcccaaagtgctgggattacagttgtgagccaccgygcccagcctacttcacctgcttttatgctgtttaccattttctcattcacaaaacttgctcttccctgatactgcagtgcacctagctgttccagttctcatcctactacaggttttctccccaattcattgttttgtcactcattgctacttccctgagcactaccccagaggtttgatcttttacttcctctatattttctctattttagaactttcaaaccagtgtcacactgcctgctttctaggaggacatccccaaataggggtattvttmttcttcttcttttcattagcccttcacttttaatgccgcaggtgcttactggacacttctatttggattcctttcctatagacactttaaactcaaaatgttgaaagtgattttccatccttttatctttccttctcttccccatgtgagacacacacacacacacacacacacacacacacacacacacatatacatatatatycctttcaatggactttccactcatccacccattcatcaccattatgttttattttaaaaatatttttaagtacaaagaaatatagtgtttgatgtgtggatactttttaaaataaaaatgaggtaatattacacaaccccttctataaattkcttctgcattaaacactacatcrtggactcctttatatatagcacatttgcagttgctttgccaaggcagttcgggattcagttgtgtgggagcactgtaatatagctcatctgctaacaaatatttaggttgttcccacctttatgctcwttgcaaacaatgccaaaataaactttctcgcacatgtattttctgagactatatccttaggatacatttctagaagtagaatccactgcacaaaatgtgaattcaggttwtaatcctcacttgaatttgatttcyaacaccctccttcctcagctgtattcagggcctttggattcttcctgtcaaatgcctctcatgacctttcctgccttttattgccagtggcatcctcttggtccagtcctttctctccacattgctggattactgctgtagcctcagctcatgttactccttggttcaaayaccccagtgagcaaagcttggatcttcatcttaagccctaacaagactgattctggctccctgtggtttcagccctctcactctcccactctctcttgccttcactctgctcccagcacaacctcacaattaagtgaatatgtccaggaagttctgccccggggcctttgcacactcccagcacaacctcacwattaagtgaatatgtccmggaagttctgccccggggcctttgcacactcccagcacaacctcactattaagtgaatatgtccaggaagttctgccccagggcctttgcacactttctcccctcaacctggaatgctctttccctagatatccacattattcgttctcttatttcacttargtttttgctctaacatcccytcatcagagagaacatgcctgactcccatgaagataatacttcgttactctctattcttttatcctgttgtatttttcctttgtagcatttaacrccaactaaaataaattaaacacttgtttgctgaatgggktaatgaaaatcattttagcagctttctctgttcaaatcttctcaattcaacctgccaaattttgcatcttaacatggtgaaaccccatctctactaaaaacacaaaaattagccaggcatggtggtgggcacctgtaatcccagctacttgggaggctgaggcaggagaatcgcttgaacctgggaggcggaggttgcagtgagccgagatggcgccattgcactccagcctgggcaacaggagtgaaactccgtctcaaaaacaaaacaaaacaaaacaaaaacgccaatttgatcatgtcagaggtttcaaaagacctactctttcttaaggcaaagaccataatctaacttttacttgccagytctgatcacacattcttgaccgcttagactggtcacctttgtgttcttaaagtcccacttatccaaggaagctgcttctgtttgtttgctactatttctcagatgttcttctatggaatgtatcatctcacactgtgtaaattacacctgatcacaccttctcatattgggagttcccatggtttttatccctttcatcrcaactgtgcatttcgtggagaccatttgaactggaaaacttaaaggattctttggagttttagtgtcagtgatactcattcttgagaatttttttttctcctgtggagttttgagttttcagagactgtcactggttcttccttgagccacttttgtttggaacaggagcaatcacmaatgcttctctctacaaagagatgaaaatattccatctgcctgacatcctaactactagctggaggtgggttgaaattggtttttggagagagggctgacagtgagagcttagttaatgtttcatttttgtttttaatctcctctcagataatgccatgtacctcctggtggtgaaccatccagatgccaagtccacagtggagttgtttaaatttcaagaagaagaaaaatcgcttttgcatctaaaaaccatcrgacataaacttctgcctaagtactgagatatatcacatttctattttcctttagctgtagcggatagttaatccacttttagtttttccttttggccagagtaggtatggctgttcamctctcatttctaatgatcacaaactcctccacatgctcttctgaagaaccttctgaggactcaagmccctcagagayggcccattcttttcctctcttgtttctcgagctgattggatgctggctcctggcctcaggatctccattcaagttattaccaggaaaaaaatcctcttcttcagaaccagacttagtatttcaaacccaaaccggcttcatagataaatttgacatcatgagcttatttatttatattaaaaagtagactcttagatgtttccatgaattagaaacacagacccaagaggagaccctgaatcaagtgcatctaagacctccttatactgcctccgctgctgtttgattgcacaaaatttatgcaayagcagatctgtggtaacactcarttccccctaggcaccttsttcaygtaacatatggtgaaataaaacactcaagaatctccaatctcagtcaacttcctcacatgccctgtgaagatttggcttgtaaggccagtgatggatttaggagaamaatccracwctatcttctgaaacatttacctccaactgattacgattttctagaatccyaacctatttttatataatttatgtacagcatttgactacctccatatctgtaaatctagatttgtactctttgcaggtacctagctaagggcctggtatgtagtgtgcactctgtgttaccaggaccccttcctcttctttcttatctggtggtttgaggatgaggaaaatgagattggagagaaattgagttactggatgaaggccaatcaactcactagtggccaagtaggaacccyagctcaggtcatcttctgccccatcaagatgartaaaagttcagagaacagcttttggtggaagagtttattcgtgcatttatttaacaaatatattttggagagagaataaggtcactgagtggagaatgtgaggaacaccaagatttaaagtagagaacagtatgtagaatggagaagctgggcaaatgataacactaataaatgagctttctctgtaagtcaggtgctacactaactaattcaaacagattattttattgatgttttacaaataccttctgaattaggtgttattattatatccattttggatttttaaaaagttgaggcctggactaattgttaagtttccccagatgacatcatcagtaaatggtgcagctgtgattctaatcctggtaacatgagttcagagctggtgctttaaacctctacaaaatagtgaaaaaaattatgtgttttaacatttaatcttggaaatctcagattggtctacgttaccggattggagtatttttttcttgakccagttgcaaaaatattggtcttaggcagcattggagactgaaaataaccacggtgccgtaattaactagagttctgctctctcaatccaaggattagctgtgtgtattttcttctttgtattttatggttttttataacattaatattccaataactaaatctattataatttaaacttgttattattcatatatcacaactgttattattggtcatttactgtatgccaggcatggtgtgaaggcctttgcattcattatttcattktattcttactctagcctttcaaggtatacagagaaaacagaggttcagaatagtggctcaaaatttagtgacaatgctgtggccccacattataaggatagcaagcagtgtcaggatgcaaatgaagtccatcagatttcaaagctattactctattaccctttaaaaatttgttatttatttacttattttactacacctgggggtagtaaattttcagcaataaaaagctattgctctaaaccrttccactctgcccctttctgtgaaaaacagacaaatgatagtccagcatactaatttaagaaatttacttttaaaaaagagagagtaaaatcagattgtagatttatgtctggagcccatccagactaatcctaaattccgagacctttttttttttttcatgttgtaatagtggctagcattgattgagggtttattgaatgtcatgctccctgcaaagcacacaacaggcattgtctcattgtaattcccactgcaactccacaaattaagatcctgacccttagttttctactaatgagctgtatgattttgagaatatcatttaacctctctttacagatgaraaaactgaggctctgcatgcctgtctaacttgcctgagagctcaragctgcgtcagagctgatgcgctggccatgacrcctctgcaatagagcagagataattttctcccagatcatgccctggggaacttccatcacctcaatcagcaaagaatgactcacttatgtgttccctattgtayccattaaagcagaaaaatagactcatatatcttacattttcagtaacagagaatcctaatcagaaaggaaaaaaaaaaagycatagcattctatttctgagcattcttgttcatggacatttcattcagtttagaatcacgaaatcttaaggctggaagatcaaccagtctatcatcctgctttcacagataagaaaactgaggtcctgacatgtgaaaagattgatttttcttagatcacacagctaatagtagcagagcttaaactaaaatgcaagtatccaggctgctggttcagcattttttcaatttcttatgggagttagttctatgtgagcccagatatgtgagcacatttttgccytgacaatgatttctggcttaatttaatttctactgaatttagtgtatttacacacagacacacacagatacmcacacacacacacacacacacacacacacacacgacgtaacactattttaagatacatataataggatttttatgttacagtgctataatcacctcctcagatttcttagaccaatgattgtctttaaggattgtatcggcaggactaatttcatattaattgtgttccattatagstagcacgaaggctccatcccayatcttgattttaggaatagacagtgaggaatgccagttaataatcctgtaatgttcaataccttcaccttatatattatgtgtgtatgttttaattgcagtttgaatgatattgttgctgtgggacctgagcacttttatggcacaaatgatcactattttcttgacccctacttacratcctgrgagatgtatttgggtttagcgtggtcgtatgttgtctactatagtccaagtgaagttcgagtggtggcagaaggatttgattttgctaatggaatcaacatttcacccgatggcaagtatgtgaactctctgaaatgtagtggatttactcagattctcaggagatatcttggaatatattctttttttaagtaatatgatacattttaacatgttaccctagtgagataaaattaggaaaaatgtaaaatgtcttaatttttcagggggtgaaatttatcaaatcaaaaatttcattgtgaaggcatactggttttatttcctttttggaaagaaagtacattttaagagggggaactgtgatgaagatttgatatgtctgaatagctttgttttgagtaaagatgtgagtgtataatgagttgaatagtatgcaggtatagatacgtcagtagtgcaggtttatgacaagatgaggaatttgtaccaaaatgtaaatcaaggcaatacttccttcatcaagaaagtattactgtgaaaaacaagtcagtttaactaagcagtgtgcttagtgatgtatttgatttataatgttatctcatggtgagctataacaaacaatttgcaaaccaacattggtctggagactgcattttgggtagcattggtatatacatgaaatatctatatccatccacatatatgccctttctcatcttgtgtcatcatcaaggattttagagtccrtaacatatgcttagagaaagcaacaggggccaggtgtggtggttcatgcctgtaatcctagcacttcgggaggccaaggtgggtggatcacctgaggtcatagaccagcctggccatcatggcgaaaccccatctctactaaaaatacaaaaattagccaggcgtggtggcgcactcctgtaatcccagctaccagggaggccaggcaggagaattgcttgaacctgggaggtggaggttgcagtgagctgagattgcaccactgcactccagcgtgggtgacagagcaagactctgtttttttttaaaaaaaaaaaaaagaaagaaagaaagaaaagaaaaagcaagcaagcaagcaagygagagsaacagggacagggacagcttttaattattcatatcatagaccagttttcaaaaaatagaagataattgagcagtaatttcttttttttgktggggggatgcacagtgcttagactaaccccagatctttgtggggtatgactaaagccacagggtcaggaccacactcagggcagaagaggaggaagacttctctygatccaagccaagcagcttttcttctctcatattttctctggattaaaacaaggggctgttgtycaagggctttcctgcaactttcccragagagaactcactagcccctgaaatgcagaacctgggccttgacactaaattgtcaaaccaaaagagaaacgctgtaatgcattttactcccagatactaaaagttagtgttagggctaagttcctcccatacygataaggacaactatgtcccctccttcagaaacaacttttcagagattaaacccctctgtcactgtaaactcactgagttctttcaraatttggtgtgtttgaggtgggttccattttccattccttaagcaaagttcttccctatgaataggtattacaacttcatcttaatctctcaagttgtgttacttctagtactttgatgtagctctttcttctttgaaggtatgtctatatagctgagttgctggctcataagattcatgtgtatgaaaagcatgctaattggactttaactccattgaaggtaagacgtattaacactgtaagtctgcagagtgataattagattctaattgatttgtgaaattaaatgtgaagaaaaaaggactgcttaattggggtgggtgagaaccaatttttcactcctttattaagagtcattagcttggttatgtgtttgttgttcatttttactcaactgcagagtggcaaacagcaaaccccacctcttacccgtgaaccttgcattctttctgctctagcaaattttaagcttggcattgtgttcccagatcctccttccatccctcccttcctgcctttcttctgatctccctctcctccaccttccttccctctcctcccttttctttctcttttttcctctatgttgatggaacagccaagaaatagcctcaaattgtactttatgcagggctgctctccacaatgtttatgaagtccacgtgctcacgatggctgctaggtgacctggctgcccctcacctctctgcctttacctccaaccattgtgtccctgccccacgtctcctgccactgtctcagaacggggcaccattccctctgctaggaggagaaaccttcctccagatctccatgaccccctccttcatctcctttcatttttactaaaacgtcacctcgatcttcaaaacctggaactgctccctcccgctacgtattttccctcgcctttcctgctttatttttccattcagcacgtattgctaacatactatatattttattcataccctttattacctgattccccaastagggtgtaagctccacaaggacaggctgtttttctatttgcttctggtacaattcacattgactagttggcacttaacaaatacttgttaaattactgcggtggggctgggcatgcttcagggattcacctgctgcccccaccaattctggtcatctgaaggttggagtcaaaatgggtgaaaacacaaaggagaggaaaaagagaccaagagcaaactagagccctaagaaagcagccctctacctcygaaaaacagcaagacgttgctttcctgccataaacgcccactgcaggaagcactgtcagcgccaattgtatgactgttcctgtcagcacatctgagagactgtcatgaggggcctcaytcagagaaaattaccttaaagcaacatcaaatgtaacatcgtgtttgacattaaaaatcactggcagggctagtttggtattagctcaagtaaaatggaatttcacacgctcatactggctaagggaataaaaaacaagctgcggttttaacaacaggtatttctgtaaaacaaaagttaaagaattttatgagamtagaacccaatgtaacagacattcaccacagaatgtcaaggctctgctctcaccagggygagactgagggcaaggccagtttcagcaacagaccaggcctgtctcccatcatgaaaaccccaaaaaggttctccatcaattgtcacattattctttcttttgaaagaccrtattaatwaatatcagttaattaatgcccgagagtgccaagtaatttgataaactagctgaggctattcttaaatttgtgatgaggtgtggatgggtttatgtccaattggatattgttcagccttaaaaaggaatgaagttcttggccgggtgcggtggctcacacctgtaatcccagcactgtgggaggctgaggtgggtggatcacgaggtcaagagttcaagaccagcctggccaatatggtgaaaccccgyctctactaaaggtacaaaaaattagccagacatggtggcacatgcctataatcccagctacctgggagactgaggcaggagaatcacttgaacctgggaggcggaggttgcagtgagctgagatcacaccattgtactccagtctgggcaacaagagcaaaacgccatctaaaaaaaaaaaaaaaaaaaaaaaggaatgaagttctgatacctgctacaacatggataagccttgaaaaacatgatgctaaatgacataagccagcaacaaaaggataaatattgtacgatttactaataggaagtacctagaacaggcaaattcatggagacagaaaatagaatagaatggtgattgctaggaacttgggggagagaagaatagggagctattgtttaatgggtacaggatttctatttggggctgattaaaagttctggagagggatggtgatgatggttgcacaacattgtgaatatacttaatgccactgagttttacacttaaaaatggttaaaatgtcaaatttttatatattttaccacgatagaaataattctctcctctctccaaaaaaagattccaggacttagtcaatgaattagtcacacttcaatgaacctcaatgcgcaaaaacctggartatttgttaacagagaatactctgtttttcccaaagagaataatttattatgttttcttgaccaaggaatgcgaatttttcgagttgcctttgtgggagtgtgagatgtgatacgcaggggtcttgcatgagttagcatggagaggaattatttatttgcaaggcaaagagttcattgctggactcagaacaggctccctgctagaytgtcagcacttccatggcatgagctgtgtctgctgggtacctggtgctctccaggtgttgcgttccttgcagagctcrtgtaggagctcagtaattgtgtcttgaatgaatgggaccccaggtttctgtgtccttctcccactcccactctcatctcaggtttcatctgccgtggaattcaccaattggctgtactgcttccaaagataagagcaaagccctgaracaaacattttcctcattcaaagacattatggtatcagartggtgtgctgacactgggatggacaggggtttagggatggagmaagcaagcatggagccgcctgtcttgcctgtctctggggtaagaaagactgatggctctgcatggtggcgagactgaggctctgccatgatgcttgagccctctaatccctccttgggcatgtgaggaacagctctcattttgagtaggaggcacagggaaacgttggttttctgcagctgtctgcttatgccckggctttttcaatgagtcatgaccagttatttacaggttctctgggcactgaggtatgctggcctctgaggtacatggtagatattatttctccaactgagaattagaggtaaacaaatagatgggatttctccccagtagaaggcagccaagatgatgaatggtggaattaagaatcattggtattatttatgatccttgtacaaagcctcgacagcaatctgtgcagtcatcaaatgcttgcaacttatatttagagaataaacagcagaagaacggggagttgaacaacatcaggaaactaaagaacaaacttttcctcaactacaaggcaaaaatgagaccctgggtgatcatttcttctctggctgcacagcctatgattagccattaaagagtccacatttcattgatattcttctgagaaagaatctacatttcctggttgttttctgaatgcttataaaaatatcattaccacatgccattttagaaggagatgttttatgatgcaccgaaaacttcttttttttttcagttttaggttcatgcacagatgttggtacaaatgattttgtctaacttttaacagtctttcttggctttctgtatcttcaccctacccaattctgccctggaaactgacaaaatactagcatagatgaaaggtcagagaaattttgtgagtcttattgaaatggggcagaattgtatccttggaagcagcagcgtggtgaccaaggacaagaggcaacttttctctgatayattttgctccatcacaattgtgttttactttatgtcttgttcttttcttgtttttaatcttttaagtcccttgactttaataccctcgtggataacatatctgtggatcctgagacaggagacctttgggttggatgccatcccaatggcatgaaaatcttcttctatgactcagagaatcctcctgcatcagaggtaagttttaaaaatgaaccagataagtgactttattcccagctactgttttttcagttgacaacataattctcaattcttggtttttttttttttttttttttttttttgkgacagagtatcgctctgtcgcccaggctggagtgcagtggcgcaatcttggctcactgcaagctccgcctcccgggttcacaccattctcctgcctcagcctcccaagtagttgggaccacaggcgcatgccaccatgcctggctaattttttgtattttttttttttttttagtagagacagggtttcatcctgttggccaggatggtcttgatctgctgaccttgtgatccacccgcctcggcctcccaaagtgccgggattacaggcgtgagccaccgtgcccggccaattctcaattctatgtgcaaataaaaggggggacatggatagatgatccaaatgatcagaaatgaaggcttttggaggtgctttagtcagagtctaggcaagaaacacatggcacacttaaattggataatttgaggggagtttaatcaacggactatacacaaaatgtgtggacacagtgtagggtaatcaacagagttataatgcagtaccccagggctagcaagggagggaggaaatgaataccagaagccagaacaggtagacggtggtgggtggagagggttgcctgacaggaacttggcctctggttaagggatcctcaaagaacataatgatgccatactgctatggtttaatcattcattacctgccttcctattcaactcccccttcctgtgtggcggtatacgcacaggtccatgcaatggaccagtcctggagcacactggccagcctctctagatcttcctgcaggtggcaagataaatagctggaattattctggcttagaagatctcatcttccaccttagttacagtactcaaaggtcccattttttgtccacggtctttattcagtgaactattttgggtacaagtaagaatttkcaacctacttcaatataggtatttgcacatttactgagttttcagtatctactaaggatacttattacttacatcatatatatgatatcatcttgacatatttgtctactgctgkgtattgttaaagctcagttttaagagtccatttcacctgcccaacaggaaaaaaaaaagtgttaaagcccgtatctcttgggttaaaaaaaaaagaaacaaatgtgtatttccatttacattatggctctcttaccttttatctctaggtttgcaggacaattgtgatcatgtttaatggcaaccctttgtgccttttgctagtttttagctattagggttgctgaatggtatgtttaatagaattgaagaaatgtatgctgtggagtgttcagtgctcagamctgagcagaatgttagattctartttgttcttgcttgttagctcatttagtaaccttgggtcatttgctatagcatggacttggtttgttgttctkgagaaaatacttcatttctaatgattgatctgcaaaggagtagcaaaaagtagtaacaattccttatccaatgcactgcccctagatgagtgatttagttttattaacaagaagcttagctaagccaaggtgtaccatcaactatttccctgtaactactacatgttaatgctatggcaacttcctaagacatctgtctttggtgccagctgtttttaagaggtcattttgaacgttcccacagacccttttatatccacgcagtggccttcaccgtctgccacatttgtgatgtagatatcctttcttcaagtcattatatattatcataaaggcttaataatagaaagctagagctgaaggggaatttagagataatctagtcccacccatttcattctacagatgagaaacaaatgtgagtggaagatccaagacatgacccaggtctcccacctcagtgtagtgcttttcatactaagttgaatcacacgctattgctattttttacagtcagaatgatcagatattggctatttcatatggttggcttaacatgatactacactgttrttattgatacaatcacatttctyctcaattaagtgaaggaaactgaacttacaaaatcttatacatttagagacaggaggttaagttcagaacacatgagtatggkacacagatatggttttttgagggccacattttttttcttgtctgcattttaaaaaccaggaattaagtgtaaacatccagttagttccctggcttacctgaaaatacatgaaaacggaccttaattactgcatggcaacagtytggctattgctgagtgtattagtcaaggttccctagagggacagaactaataggatatatatatatgtaaagggggtttattaagtattaacttacctgatcacaagatcccacagtaggcggtctgcaagcctgaggagcaaggagagccagtctgagtctcaaaactgaagaatttggagtctgatgtttgagggcaggaagcatcagcaygggagaaagatgtaggctgggagggtaggccagtctctcctcttcatgtttttctgcctgctttatattcgctggcagctgattagattgtgcccacccagattaagggtgggtctgccttttgcagcccactgactcaaatgttaatctcctttggcaacacgctcacagacacccaggatcaatactttgcatccttcaatccaatcaagttgactctcagtattaacyatcatactgagtaacagcttcctccctccacatttactgaaatccccactgctccctaatgtcccacatccaggatgcgctgctcatttgcatttcctgcctcatccctgtaggtctagatactctccacctctgctaaagatcacttgagatcagtacccacctgttcccaaatgaagaaacaggtgtgttaagtgtaattttggaacaaaataggatttatctcattgtataagattatatggcttcttatggaggatgaccctattatgcataaggttgttttaagtgacttaacaaaaatattaacccaatgttatttcttccacaggtgcttcgaatccagaacattctaacagaagaacctaaagtgacacaggtttatgcagaaaatggcacagtgttgcaaggcagtacagttgcctctgtgtacaaagggaaactgctgattggcacagtgtttcacaaagctctttactgtgagctctaacagaccgatttgcacccatgccatagaaactgaggccattatttcaaccgcttgccatattccgaggacccagtgttcttagctgaacaatgaatgctgaccctaaatgtggacatcatgaagcatcaaagcactgtttaactgggagtgatatgatgtgtagggcttttttttgagaatacactatcaaatcagtcttggaatacttgaaaacctcatttaccataaaaatccttctcactaaaatggataaatcagtyatgtcaattgtcagatattaaataacagtgtgtgaccccaaaagtacttaccctaaaacatgtgttgcctgraagcacatgtgtgtatcgctgccttgccatgtcttgttcagaagacacaggggagcagrgttagctcacgtgtctttrgaactccagtactcacccagggactccagttcacaggccagaaaacatatgcattatgaagttcccctctactccatgcacatagtaagtctgactatggcagtcagacttacttactcccattttcccttcgatatrtgactttttctcagtaaatattaacctgaaytattccaactccccttgtactcttgctttttcaattctcctgttgcaatgacacataggaaaatcttaaaattcttgggagtgttgtcacacctgaaaattatgagtctctatgatcttggcacaaattgtacatttgagtgtctttgacttggttaaaggaagtttgttcacttcgatgaytggatacagaatgaatcccataattgacatgggcgaagctaaaagtgtccccaaagactacactgttgttgaggtggtggtagtgctggtgggtttttgtttaatatttaaacttcttgttgtggaggctgaaaagaaaaaaaataatagaaaggtaaacaaacaaataaatagaaaagatcaacaacccctttggctatctactgagacatgactaggaagaaaacatgactttatcattttgttatagaarctgatatataaaggttacacattttcatttatttgtttttctgatttgaaggtataaccttcatgatgaattacttcttcagggtgttaaggcagtgactttagaaacaaatttttttcttgtttttgttttgtttttgagaccgaatctcactctgttgcccaggctggagtgcagtggtgcgatcttggctcactgcaacttctacctccgaggttcaagagattcttgtgcctcagcctcccggatagctgggactacaggcamacaccaccatgcccggctaatttttgtatttttagtagagacggggtttcaccatgttggccagcctggtctcgaacacctgacctcaggtgatccacccgccttggccttccaaagtgctgggattacaggtgcgagccaccacacccagccagaaacgaagtttttctaaggcacttgttatgatgatagtctggcatttycgggaaaatgttttgccaataaattgagaaccaccaacagttgtttaagaatcactgacttgaagtaataaacaggaacattttgtttgggtcaaaaaaccactttattcacagcaagattggagttactcatgattccagtgacataatatcccgtgccctacatgggctcaatttttctgagatkctgctcacagcccaggatgctgggttctctgaaagactgtcttgaaattatcaatgagtgtgatgcttagggaacacccccaacatatttcattatttagaaagaaagaatttcctgagtagttaggctccctaacatcttcaataaaatgaccacattctgttctttcttgttcttgatgatagataagcaaattccactgaagaaacaaaagcctatccaatttgacacagcacatactcaagatcactcaaaaagggacayggcttggttagaaatttcataacatacattgtgaaaaagaggaaaacagcttaattcatgtattctgtgattcccagatctaaattttcgcactgacataggcttagtcacatataaattatagtttgcgtgtgtaagaatgaatgaaattaatagccctcacttatttttaaggctttagaaagaatattgtttaaaataaccccatactctaygatggtcctgattcttccttagcttgcccctcgctatgtgagactghctacttaatggatttgtcacagaggttttcctggctgagagatatcagagactttgatggtgaagcagcgacaggggaacaaaatgacgggcgaggaagcttcgagtgcaggctttgctcttttaactttatgcccagttccataattgtgctttcaaatgtaatttctagctgccaatttacactttaccacagttaagacttagtttcatttccatgaaaaatgtgcactttgctcytgattgacagatatatgctttgacaattgatacaggtttacccagtcaaggcttgttttagttgaaggtgaaaatggaagagggaaaaaaaattgcttcaacagacctcagtatttctttttattgcattcgttgtctaacaacaataatactcattggcaagaaatttatttacactaacaaattaaatttaatcacaggtattkttagattggtcagaaaacaaaagaccactgtgatattttgcttgaatgcctctgaaaaccaaagagtaaggaatgtcatttgaaactttttgaacaatctagagaagtacatattaaccaagcacaagagaacaattcagacgtggcactattgtctcttccatgcaaatgatcagacatcaaaatgtacaaattaaaagcttaggtaacatgctatccatacttatcagacttaaaattattttcaaacaattcgtgttctttactgatatacaaagaaagctgaaaagaaatcaacttcttacagtggaatagaatttattctcttttattttcagctgcccagttttgtcagtaaggtgtagcaggtgtacaagtggttgcaacaccattaaaaaatataaaagcagtagttatattaaataatgttgaagaaaacatatacatatatatttaaggaatttcactaagcactaactaaatttcatgttgttgggaggtgttatctggctggagtgcctcttaattctttttaaggtaatttaattatttcttgccaattgttctttcttgaatgaatgattacatccttaacagaaaacctgggtgtataaataatacagctgaaagaaacagaagtgtacaccttccaacaacatacactcccaaccacttgtgttgtttttggcaacaaccaaaatgccattgcttgcacaaaaagtaaataaatgatcatatgatggcaacattcatcataagagagccagtaggcagtgactgtaagcatcacagccaccaattatgtcattttagaattgtgagcaaattcacaagaacacacagtgcaatttttagctgcatacatttcttctgagctccaactcagcaatatgcaatcttgacatcaaagcattagccaaatatttgaggaaattttcttactaaaataccaagtatctgataaatcaattttaccaaaatatataaacatatagaaggataagtgcatttagtagaaatacttacaataaaaaaatctcttaaaatctatgagccattcaatgtatacacaacgmaagaagtggcaataaggctatgattacagctccaggtcctgactgacctcgccaagttccatacacaatatattttttaatgccatgtgattgcagtgtgtgtgcgtgtgtaaggtgggagtgatattcacacatatgtagttctgaacatctacacaaacggcatgcacattgttgagaagttatctgttctcttattgcatacatcttactcactgttgaatccctagcagttttggggttgggttagggtcaagcataggaaatcatcatatttctttccttctccactcttgaggatctggaatcaggtcacagactgtgctgggtccacacgcttacatatgtgaaccttcaagtaactaccattccctcaataggcccacatagacaccacggacaagcaaataaggaccctctgtctaccataaatagaacttgatgctttcactttccaggagaagctgattctgtcggctttctctttgcccctccaacttcttagttgggcctattctatgctgctacttcaagttactcaaatgtgttttgtctggtgttatttttttctccagtgttttggaccaagactagatttcctgagactttaaatacgcaagacaaatgcaaacaaaatctgccaacatacccaggctgcttttcaggagtgaatcactgaagygcatttggatttcctataacactactttcttttgggaatgtacagccctcccccagctccccatcccccatcataatgtaaaccattctaakagaaaatatggatgttttggctgggggtggtggcacatgcctgtagtcccagctacttgggaagctgaagcaggaggaccacttgagcccaggagtttgaggctgcagtaagacatgatggcaccactgcagtccagtctgggtgacagatgacagaaaaaaaaaaaaaaaaaraaaagaaaagaaaatatggacattttatttctggactttatccttaaatgcttagctttagaatagtgcacaggtacatccttaataaaaagtaaatttgaaaagacaggaaaggactgtgcttttctcttccattttaccttttcattctgagaccactaaggtctttgcattaagtaggtgacgtgaaccctagtgrccactgcccaccaaaatgcccctcatctccagctctgtcaggagtacctttagttactcaaatggaaatatctcagtgtaatgatggggctacaacatatccaaagtatagatggttctctcagggctgctggggcagcttcctttagaatcctctagaacactattgttaaacactggatctcctcttgaagtttagtctgcataacctttaacacttaaacatgaatcagagtatctatataaatgcaaattttcatttcccttttataaaatgcaattttcaagcacatgctaattctggtgcacaatgaacccagacaaatttgtcttcagcacaaactctaacggccgaggtgctagatcaaaccacctgtgaccatttttgtagcttgggactgggatattttaagatttcaggctagtgatgattacagggtcacagatagtggcaaaggtaaatctggttcctcattttccctcttgccactttgtttccaacaacaatggagcaaaaggtgacagtcccattttgtgccagttgaaagctgagtttggctttagtacctatcatactgcaatcatgaactgctgtgggttaaaaaaagcttgtgatgttgagggtgtgaaatcaattgtcaatcccagctaaaggatgatagccacagaacagctttattgtcatgaaactaaagggggacttcatcaggagtgttagaatggatgaaatgaggtttcttccctaacttaacattctgcagaaaattcctgattcaggtaaaaaaagaatgagattagtattacataaactgtgagttacttgaagggagatggtcttaaacaaagtaatctgttataaaactaacatcctttaatgggaaaccctgacccagatacagctcatacaatgctttctgtctgcagcttggcctcctcaccacacattccctcccaacaaagcataacctataccccaaaacacttttggctattgttagaatcatactgagctctcctttagggaatcagttcatagcaaccagatattccctttttgttcattttctgataataaaaactgcagtttttaaggttgatgaaataacaattctgtgttaaattgtaaggacactgaaaaccactagcattaaagtaggaattgtgcaagacattggagccttgattaggtatcatgcactacagtcaataaaagaaataatrrgaaaacaaaatgtkcacaagatctgaggtctttcactttgctttcatacccttaatcagtttacatcttatgctttgtggggcaatcaaaccaaatgacttttacaatttcatccgttttaagtggtaatgttaaaataactcacttcggcctaaaattactataatttaacttaaaaaatcaaaatacttataatactaaatgattttaggaataagaatttgatttataacattgtcagttggacatttatctaaacattcaatatacaaagttataaagaaaaatacttctaagatatttaaraaaatgcaatataatagatcataaattagrtgcaaaaacaagacacttacagacatttccagtatatacatccattttcaaatattaccaaagtgtaaacataacttaagataatcatccttctatttctactcttgaatacagtgaaacttccagtgtgatccaggtcacttttttcccaaagataagcaaaaatggcaaaaatttacaatagcaagcactaatattaccagatttttactaatttagtgttttagtatttgaaaagttttgccaaattgtatcactcattaatagtggcttcttatttctcatgatgtkaaaaaataacaaagcaccagacatctcaagacattaatagagtatccaatayggcagtttcattatcatacccctaatgaagacagacagaaaaacataatggtgactttgataactgtaaaacacaatgttacttcatgtcaacgtttctgaggattgaatgaagggtctgtacctaatgacaaaagagctgacgcataaccgacaatactctggcaatgaaaagaaaacaggccttgggggtaaaacagaattaaaaatgtccagtttagataatttctgaattcagattttcagataaaaaaaaatcacactgttattaaaatacaagatggggctacaagggagttcccttaatctgttacactcaaaagccttgccgaggctctaaatatggaatacttctagtggaagatacgagatgctgggaacagagcagagattcccataaagtaaaagaagtaaaatactgtccaagaattcatgtggcctcaagtcttattctgaaacttgtcctttggaaagtggataacctcatttttagagtcaacgcagca

SEQ ID NO: 13265 - DNA, 29616 bp, Homo sapiens
tgtattttacacactcttttctgctcagtggctctctgtgtccactctcatgaggatgctgcactttatgtggccttatagaaccccttaaaatttggcagcctgaatcctctaatttctccttcctctttaagattgccattattattattattggctatttgcttttccatgtaaatttgtaatcatttttctcatttccaccaaaaacaatgcttgtaattttgttgtgactcccttacatctacaggtaagttctgtcctatagaaacataatgcaaaccacatgcattctttcaaacttgctagtatccaaattaaaaagctaacaagaaacagataaaattaatttaagttaacccaatggacccaaaatattattaacccaacagacccaaaatattaacctaatagatccaaaatattattttattatacaagtagactcaaaatattatcatttcaacatgtaatcatgtgtcatcttggaaaacatcagatccctgtctaggtgggcaaagatttttcttcgtaatatctcatttccacatttccacttggcacagaaactgcccccaaggctcaggatactaagatgcagtaggaatgggtagatgtatctggaggaaagtgactgaatgaaattgagacatcagagtctgggaaactcactagaactacagggacagtgtgggggagggaattgggagatgttgatcaaaggatacaaactatcaggtattcaggaggaatgggtctgaagatctcttgtacagctttgccactatggttgacaatactgtactctatacttgaaatttaccaggaaagtagatttttttttttaaatatggaacacttcacgaatttgcgtgtcattcttgcgcaggggccatgctagttttctctgtatcgttccaattttagtatatgtgctgccgaggcaagcatgggagagtagatttttttttttttttttttttttttttgagctggagtcttgctctgtcacccaggctggagtgcagtggcgcgatctcggctcaccgcaagctccgcctcctgggttcacgccattctcctgcctcagcctcccgagtagctgggactacaggcgcccgccaccacgccctgctaattttttgtatttttagtagagacggggtttcactgtgttagccaggatggtctcgatctcctgacctcgtgatccgcctgcctcggcctcccaaagtactgggattacaggcatgagccaccacgcccggctgggagagtagatcttaagggtcctcaccacaaaaaaaaaaaaaagaaagaaagaaaaagaaaccataggccgggcgcggtggctcacgcctgtaatcccagcactttgggaggccaagacgggcagatcacttgaggtcaggagttcaagaccagcatggccaacatggtgaaaccctgtctctactaaaaatgcaaacattagccaggcgtggtgacacaagcctgtaatcccagctactcaggaggctgaggcacgagaattgctggaacctgggagcggaggttgcagtgagccaagatggcaccactgcactctagcctgggggacagagtaagacttcctctcaaaaaaaaaaaaaaaaaaaaaacaataaccctgcgagatgatggatataactagcttgactatgatgatcatgtcaccatgtatacatacatcaaaacatcaagtgtaatacaccttaaatatatacaatttccatttgtcaatcatatctcaataaagctaaaagaaacctctaagtttcaactttattttcaraaagctgtgccatgcttacctcagtgcctaagtatactctaattcatggaaatggcctttaaaactgcagagagtggctgggtgcagtggctcacgcctataatcccagcactttgggaggcggaggtgggcagatcacgaggtcaggagttcragatcagcctggccaacatggtgaaactctgtctctactaaaaatacaaaaaatagctgggcatggtggcaggtgcctgtaaatctgagatactcaggaggctgagacaggagaatcgtttgaactggggaggcagaggttgcagtgagccgagatcctgccattgcactccagcctgggcgacagggtgagactccatctcaaaaaaaaaaaaaatactgcagagagttaaggccctcactggacactctccggtacctctgaggtcagtggatagagaagcagctccccttcttcttcctcgaaacaaaggcctccttccttcttaggtgtttgagacaaattctccacacaggtgcagctgagtgctgtaaagtcccactgagagttgaaggtccccactgccagtcacagttcggtcccactgagggttgaaggtccccactgccagtcacagtttggtcccattgagggttgagagtctccactgccagtcacagtttggtcccattgagggttgagagtctccactgccagtcagtttgggcttattagggtttatgctgtgcacggagaatggaacctaccaatcaactcttagtgaccagttagacagattcaaggcaaatttccctgctgggaaatcccaaatcccaaaatatgcagagaccaatagatgcctcaattcttccgtgtctccgtctaaatccttgggtcactgtgactcctgtagttatgtggcttgtaattccttgggccgtagaatggctatgataggccctgtgctaaggggactggtgacagttgagacaggaacatggaagctatagtagtcagggttctccagaaaaaaaaataatcaacactaataatgatagatatatagataatgattgatagacaaataatgatagatatataatgatatcacaaataatgatagacatatagttggataatgacagatatataatgattgatacacagatagggtatttatatattggcttatgcaactatgtagactgacaggtcccatgatctgccatctgcaagctggagacccaggggagtccacgtgtagttccagtctacgtgcaaaagtctgagaaccagtagagttagtggtatacgtaacagtccaaaagctagcaggctcatgccgggcatgatggctcacgcctgtaatcccaacactttgggagaccaaggcaggcagatcacctgaggtcagagttcaagaccagcccggccaacatggtgaaaccccatctttactaaaaatacaaaaattagccgggcatagtggcattcgcttgtaatcccagctactcagaggctgaggtacgagaattgcttgaacccaagaggtgaaggttgcagtgagccgagatcatgccacagcactccagcctgggtgacagagtgagactctatctcaaaaaaacaaacaaacaaaaaaagctggcaggcttaacatctaaagagtcaatgttttagtgagagttcaagagccagaaaagactgatgtccargcaaaaggaacttcatcttacattaccagttcaatgttttgttctattcaggtcccacctgattgaatgaggccgactcacattagggagagcaatctgctttataaattacactaattccattgataatctcattcagcaacacccccacagacacacacagaataatgtttaaccaaatatctcagcaccccatggctacgttaccattcctgttccacaaaaggaggaaacaaaagaacaaaaccacaccaaatgttgtggtaagttgacaaaatctgttccagcccattagtaaatattggccactgaagttcctgaaattcaacaattagtaagtatctctctcccaatagaaagccacgtcatttgtaaaccataacaatagcttttgtttttttgagacacagtctcgctctgtgttgcccaggctggagtgcagtgatcttggctcactgcaacctctgcctcctgggttcaagtggctctcctgcctcagccttccgagtagctggaattacaggcacccgccaccacacccaagtaattttttatatttttagtagagactgggtttcaccacattgaccaggctggtcttaaattcctgaactcaagtgattcacctgccttggcctcccaaagtgctgggattacaggcatgagctactgcacccagccaacaatagtatttttaattaggtcatcctgcctttacaatctctgcattttaaatactcaactaagagtacagccattatttgtctttcacccaaagtcccattcaagtgagaacaaaggaatgaataaataaggcataagtaacaaaacaacaaaaaaagaaaattagaatgcggtcaatttcatgcaatcatcaacaccaaatttcyagaacgtagtatttccaaatttcccgaacgtaaatatgtatgtggaaattaacaaaatgtggcaaaacaaaaggtcacttaaatttgcacaaatgaaacagtcaacatggaagctgatcggctttctgaaatatgggacaagctcaggacttcaaaatacttcggcgttggaagggctaagttatgatgtattaaaatgaaaataaagtggggcgcggtggctcaygcctgtaatcccagcactttgggggaccgaagtgggtggatcacgaggtcaggagatcgagaccatcctggctaacacggtgaaaccccgtttctactgaaaatacaaaaaaaattagccgggcgtggtggcggrtgcctgtagtcccagctactcgggaggctgaggcaggagaatagcatgaacccrggaagtggagcttgcagtgagctgagatcacgccactgcactccagcctgggcgacagagcaagactccgtctcaaaaaaaaaaaaagaataaataaaataaaataaaatagtagaaggtttaattaggaatatttcactctccatacctgaagaattcgtgatagccaggagtctacaatcaaaataacataaataataagataaaaataaaattaatttgaagccataaaaaaagaatgagttcatatgttttgtggaaacatggatggagctggaggccattatccttagcaaactatacaagaacagaacaccaaatacagcaggttctcacttataagtggaagctaaataatagaactcatgaacacaaaaaagggaaaaacagacaatggggtctcctttagggtggagggtgggaggcgggaaaggagcaggmaaagtaactattaggtaccaagcttattacctaggtgatgaaataatctgtacaacaaacccccatgacacaagtttacctgtataacaaaccttcccatgtacccttgaacctaaaataaaagttaaaaaaatactcaatgagcaacaatgtacattatttgaggataattatattaaaagcccagacttcaccactacacaaaatatccacgtaataaaatttcacttgcgctccttaaatttatacaaataaacaaaaaagtataataaaatagtagattctttctttagagatgacaaatagtgccagagaaaatgcctccacactctggcattgagatcatctccaggataagggtatactgcatgcctggtcaagtccaagtaaatatactcagaccatgaatctcagagatgaaacataggttcagaacagacaaagccacagagcttttgactaatggcccagtgaaggcaatgtctgcctgtatggtatccaccaccttatattctgtcccaagcccgtctatttggatgtagcatctggttcaaagatgaatttgaacaccattagacactggcttaatgaaaattcacttctcattcrtttctcatctgaaacataaatagaaatayaggtcttaggcaggaggatttcttgatgccagaagttagagactaccctggccaacatagaaagaccccatctctatttaaaaaaayatacatatatatgtcttctcttgggctccacccaagagcaacctggaactaagttattcggcaacgaactgttccactttgytgtgaggcaatagatgtggaaattccctgacgaggggctctgtcctcatacttcctgcggagcttattgtcgtaagaatatctgtcatcctgctaatgtgcattgaaaggagagcaacggggctgaggccgtgtcagcacgatggaccccaaacagaccaccctcctgtgtcttggtgagtttcagagtaaaagtgggttagaggggaagatagagaaatcccaaaataatcagggtgtctcttaacagtgtgactaggagattttagtggctgccaaggagattctgatctccttagtggaaaggccgtctttgtcaatgtatctataactttgtctctacccaagcccaagctagsttgtggggctcaaggtttaatatttgtattaaacctatagtgtgttatctgggattcatgatggtcccaaggttcttatcaaggagagacttagaggctggaatctgaaaggtaaaaataaagaatgaacctcaaaactgtgattgttgtggaaggaaaacatatgatagaaccccatatagaaatatggttactagtattttgttgaagatttttgcatttatgttcaacaaagatattatccagaagttttctgtttttgttgtatctctgccacattttgttatcaggataatgttggcctcatagaatgagttggggaggagtccctcctccaggatttttttcaatagtttcagtaggaataatactagctcttcttggccgggcgcagtggctcacacctgcaatcccagcactttgggaggccaaggcaggcggatcacaaggtcaggagatcaaaaccatcctggccaacatggtgaaaccctgtctctactaaaaatacaaaaaaattagccaggcrtggtggcgggcgcctgtagtcccagctactcgtgcggctgaggcaggagaatggcatgaacctgggaggcagagcttgcagtgagccaagatcatgccactgcactccagcttgggcgacacagcgagactctgtstcaaaaaaaaaaaaaaatgccagctcttctttatatatctggtgggattgagctgtgaatccatctggtactggtctttttctggtctgtcattacagagggtgatttgtcgtaaaggttggaaatggaagcttgatttttcataaatctctctcttccagtgctctgtctgggccagaggattcaggcacaggaaggtaagtgtcctgtaaatctctcccagcccctttagaccctcttgggagctctaggataaagaaattgargaatagcctgaagcaccattcttattttartccccattctagttgtttctgctgtgcttctcttgcataatttctatctcactttgttatctccaaacccttcagactcattaatgctcaggcctggatttatagttagtccttgcctgtgttagactgtccatgaaggatctgtaatttactgaatgctcaaactgcaagaatgaggaagtcaggagtcatctgcccaatatccttccttatgctgattctattttgttttagcaacccacttcctcccgtcacttcatttaaaaggatgctgccatagtctaaccctactgaacactctagcattctgtagtactactgcagtactaagcatgaggcagtcttagtgtactactgaatattctgccaccccaactactactgccttagcctcctaatgggtgtgagccccacgtccatccatgtcttctctcttccagctccttctaaagcctgaattatttgtgtgttgaacaatactcattcttcctatccatgagcatggaatgtttttccatttgtttgtgtcatctatgatttctttgaccagtgttttgtagttctccttgcagagatctttcacctccctggttagctgtattcccaggtattttattctttttgcagtaattgtgaatggattctattcttgatttggctctcagcttagatgtttttggtgtataggaatgctactgatttttatatattgattttgtatcctggaactttgctaaagttgtttatcagattaagaagtgtttgggcagagactgtggttttctaggtatagaatcatatcacctgcaaacagggatagtttgacttcctttcttcctatttggatgccttttatttctctcttgcctgattgctctagctaggacctccagtamtatgttgaacagaagtagtgagagacggcatscatgtcttttgccagttttcaaggggaatacttccagcttttgcccattcaatatgatgttgactgtgagtttgtcatacatcattcttattattttgaaatatrtttcttcaatgcctagtttgtcgaggttttttagcataaagggatgttgaattttatcaaaagctctattgagaggattatgtgtgtggggagggttgttctatttatgtgatgaatcatatttaagatttgtgtatattggccgggcactgtggctcatgcctgtaatcccagcactttgggaagccaaggcttgtggatcatgaggtcaggagatcgacaccatcctggctaacacggtgaaacctcgtctatactaaaaaacacaaaaaaattagccaggcgtggtggtgggcacctgtagtcccagctgctcgggaggctcaggcaggagaatggcgtgaatccaggaggcggagcttgcagtgagccaagttcacgccactacactccagcctgggcaacagagcgagactcctatatcgaatcaaccttgcatcccagaaataaagcctacctgatggtggtggattagctttctgatgtgctgctggatagtttgctagtattttgttgaggatttttgcatttatgttcaacaaggatattgtcctgaagttttctggttttgttgtgtctctgccatgtttttgcatcaagatgatgctggtctcatagaatgagctggggaggcattcctcctcctgaatatttttggaacgtttcagtaggtatagtaccagctcttctttatatatcagatgggattcagctgtgagtctgtctggtactgggctttttctggtctgtaggatttttattactgattcaattttggagctcattattggtctgttcatgtattcaatttattcttggtttgatctcaggagggtgtatgtgtccaggaatttctccatttattctggattttctagtttgtgtgcatagaggtgttcataatattctctgatgattgtayttctgtggggtgagtggtaatataccctttgttgtttctaattgtgtttatccggatcatctctcttttcttctttattagtctaactagtcatctgtcttactaattttttcaaaaattctactcctcgatttgctgatcttctgaatgcttkttcgtgtctcaatctccttcagctcagctctgattttggttatttcttgtttcctatgagctttggggytgatttcctcttggttctcttagttcctcttgttatgatgttaggttgttaatttgaactttttctagctttttgaagtgggagtttagtgctataaacttcccccttaacactgccttagctgtgtcccagagattctgctatatttacccaaaaattccagaacagactgcttaatttccatgcattgtacagttttgagtggttttcttagtatttattcctatttttattccactgtgctctgatttcgcttttctggatttgctaaggattgttttttttttttttgaaatggagtcttgctctgtcgcccaggctggagtgcagtggcgcaatctaggctcactgcaagctccgcctcccrggttcacaccattctcctgcctcagcctcctgagtagctgagactacaggtgcccgccaccccgccyggctaattttttttgtatttttagtaaagacggggtttcactgcgttagccaggatggtctcgatctcctgacctcatgatccgccagccttggcttcccaaagtgctgggattacaggtgtgagccaccgygcccagcctgctaaggattgctgtatgtctgattgtatgattgactttagagtatgtgccatgaggcaatgaaaacaatgtagattctgttgttttgggggtggagagttctgtagatgtctgtcaggtccatttgatccactgctgagttcaggtcctgaatatctctgtttgcctcaatgatctaatactgtcggcgggatgttaaagtctccccctattattgtgtggttgtctaagtctcttcgttggtctctcagaacacgctttatgaatccgggtgcttccatgttaggtgcatatatatttaggatagttaggtcttcatgctctttttttaattttttttttctttttctttttgattcagcagttgggctattacacactccttagcagattccgacttccgtggccactgtcctgctatggtcttcatgttgaattgaaccctttaccatgatttaatgcccttctttgccttttttgatctttgttggtataaagtctgttttgtctgaaattttaatagcagctcctgcatttttttttttttttggctttccatttgcttggtagatttttctccatttctttactttgagcctatggatgtcattgcatatgagatgggtttcttataggcagcataatgttgagtcttgcttttttttttttttttttttttgagatggagtctcactctgtcacccaggctggagtgcagtggtatgatcttgactcactgcaacttctgcctcccaggttcaaatgattctcctgcctcagcctcccaaatagctgggattacaggtgtgtaccaccacgcccagctattttttttttttattagagatgggatttcatcacattggccaggctaatgtcgaactcctgacctcaaatgatccacccacctcagcctcccaaagtgccrgggttacaggcgtgagccactgcacctggcctcttgcttctttatccaacttgccactctctgcattttaattaggacaattagtccatttacattcaaagttagcatttacatgtgcagattttttcctgtcatcatgttgttagctggtttggttattatgcagacttgtttgtgtggttgttttatagtgtcactggtttatgtacgtaagtgtgttttctwttggctrgtgatggtcttttctttccatatttagcrttcctcttaggacctcttgtaaggcaggcctgatggtaataaattccctcagcatttgcttgtctgtaaaggatcttatttctccttcacttatgaaacttagtttggctgggaatgagattcttggttggaaattcttttcataagaacattaaatataggcccccaatctcttctggattgtagagtttctgctgaaaggtctgctgttagctcgatggcattccctttgtaggtgacmtgccccttcttttttgctgccttttcacattttttttttttttttgagactgagtcttgctctgttgcccaggctgccaggctggagtgcaatggcgtgatctcggctcactgcaagctccgcctcccggattcacgccattctcctgcctcagcctccccagtagctgggacwacaggtgcccaccaccacgcccagctaattttttatatttttttagtagagatggggtttcaccatgttagccaggatggtctcaatctcctgacstcgtgatccgcccgccttggtctcccaaagtgctgggattacaggcgtgagccaccgcgcccggccgacatttctttctttcatttctaccttgaagaatctgatgattttgtgtcttggggatgctcttcttgtgtagtattttgcaggggttctctgtttcctgcatttgattcttggcctctctagtgacgttggggaagttttcatgaacaatacactgaaatatgttttccatgttccttgctttctccccatctctttcggggatgccaatgggctatttggtctcttttcatratcccatatttcttagaggttttgttcattawtttttattctttttcttcatttttgtctgactgaattagttcagagagccagtattcatgctctgagattctttccttattttgctttattytgccattaatacttgtgatcgcattatgaaatctcgtagtgtgtttttcagctccatcagatccgtttggttctttcaaaatgaccatctcatagattagcccctctgtcattttattgtaatctttaggttccttgcattgggtttcaactttctcctgaatcttgatgaccttaatttctatccatattctgaattctatttctgtcatttcagccaggtaaagagcccttgctgggaagcttgtgtggtaatttggaggaaggaagacactgttgctttttgagttgatggagttcttgctcagttctttctcatccatgtgggctaatgttcctttgagtgtgctgcaatttgaatttttttyttttttcttttaaccgtgatgtaatttgagcacagtcagtagacttcttttctggatggtttcagagggctggggcttcgcacagggtctttatttatagctaaattcttgtccttggtttcacagggaggtatattagcgagcatttttggtgttgaagtttgggctgcaatccggtaaatgatgcttcagcacaacggccagtaggtcattcctcatgattgccgctgtgctccctctcacgctctgaaagtgcgggctcctctcccacccaagtgctggctgcagatctgggctcggcactcccaggctgcacatcacagctctggggtgagctcagactttatgttccctccgtggcttgggggcagcaggggaagggaccttagcagcggttgtggcagacggcctttcacttgtcccttggaactccaccccagagagatgtggagccactatcagtgcgatgagccaagagtgrggcgactgcactgtgggtccaagctaggggccctgcctagtgatgagcaggggggacaggtgggtcacaggggtgacagactggcctcttctccttagggcagtttgcyggaggtgtggttgaagcactcagagtctttgctccttccccagtctgagggcagcaaggccagtaccaccgcagtggcagcggcagagtgaccttccgttgcctctgggagctccgccacagagaaacgcagactcacagctgctgggaacgctccgccagagggtggggctgttgtgccgcggaatcaagctggggcttggtgaagagcagggggttgagggctcacagggagaggagactgagctcctctccgtatggmgactgcggtgtgctggaagcatgaatgaaggccgggcgcggtggactcacgcyyggaatcccagcactttgggaggccgaggcgggcggatcacgaggtcgggagatcgagaccatcctggctaatctggtgaaaccccgtctctactraaaacacaaaaaatgagccgggcgtggtggcgggcgcctgtagtcccagctactcgggaggaggatgaggctgaggcaggagaatggcgtgaacccgggaggcgcagcttgcrgtgagccgagatcgggccactgcactgcagcgtgggmgacagagcgagactccgtctcaaataaataaataaataaatagaagcatgaatgaaggccccaggctccttgcttcttccccagatcacgggcagcagaggcagaacccttgccatggcagtggcagaggggctgtcagttgcctctgggagccactccccagggaaacacgagccaccaccagtgagtgtgctgagggcggggcagctgctctgcactcccgagctgggggctctgcctggtaaagtgggggtgggagctcacggggaagagagactggactcctctctgtctgatggctgtrgcataatgaccgggcccccacacatgaaaaagaattctgggaactcaaaaagccagtgtgtccccaccatggaccccttggattgtgtttcaaatttctcctyaatttcgaagagcgtcctggccatccagattctgaattctataaccctcgtttcattcatctcaatgtagctaagaaccagatttctggggractatcgagttgccagagttcttgtgttgattcttttttttttyttttttgtggcagagtcttactctgtcgcccaggctggagtgcagtggcacgatctcagctcactgctgcaaccttcacctcccgggttcaagcgattctcctgtctcagcctcctgagtagctgggattacaggtgtgtgccaccacgcccggctaatttttgtatgtttagtagagcccgggttttgtcacrttggtcaggctggtctcaaactcttgacctccggtgatctgcccacttcagcctcccaaagtgctgggattacaggtgtgagccaccgcgcccggccttggtgttgattctttctcttgtgtgagggctggtgttcctttaactgtgatgtcggttgagtacagtcgcttggcttcatttctgggtgttttcagatgccaggactctgcacaggatctttatttgtggctgaatttttcccttcattgtatactggcaaaatttttcagtgttgtattttgaagtgtgatccagtaggtggcacttaaaagggttggccagcatacaggatcttagccacaaggctcttttgtagttttgtttcgttttttgtttcgttttttgacacagggtcttgttctgtcgcccaggctggagcacagtggcacaatctcggctcactgcagcctctacctatcaggctaagtgatcctcctgcctcagcctcctgagtagctgggactacaagcacgcagcaccataaagagaaaatttttgtaattttttttttttttttgtagagatggggtttcaccatgtttaccaggctggtctcaaactcctgggctcaagcaatctgcctgccttggccccctaactcttgtattttgacaaagtcggcagtagtgctctgtggttgtgrggaggggtgactccctcgcctggtccattcttgggccttggaggagcctcctacagtcactggctctgcacccactgtttcctttgttaggattgttctgcccayggggctccctcaggcagggcatggtgggcagacaggctgtatccttccccggccagccctatggagggaggaccaccccgcacywctgcaggctgatgaaakcaggtgtttcacccctctgaacgttctgagaatgagggctcctcacggcttggtcgccacctaacgtggtgagtccttctcagcaagggtgattggagccacatgatctgccatctcagtgcttcccaggggaacacagagctactgggcatggtggctcacacgtgtaatcccagtactttaggaggccgagatgggcagattgcgaagtcaggagactgagaccatcctggataacatggtgaaaccccgtctctactaaaaatacaaaaaaaaattagccaggcgtggtggcgggcgcctgtagtcccagctactcgggaggctgaggcagaagaatggtgtgaacccgggaggcggagcttgcagtgagccaagatcacaccactgcactccagcctgggcaacagagtgagacttcatctcaacaaaaaaagaaaagaaaagaaaaacacagagctgcacaccccacagagttcaggcagaagggggtctgcagcgctggaagacccagcaagcctggcccgtctggctgcaagtggcaggggtgggtggagtcacccacttcaccatctgggtgctttccagggaagcatgcagccaygaccccgggcagagttcaggcagaagctgggccactrtgctggaaactggccttgagccttgtggagtaacggcaggtggagccatctcactgctcccacgcaccatgcccgtggcctctgcgggggctgtggtaacggcacccgactgctctggggtcaatgcctgcggaggtccccctggcttcagtgttgcctctgcaaaaaccccagttgcagccaggtgcggtggctcacgcttgtaatcccagcactttgggaggccgaggcaggtggatcacttgaagtcaggagttcaagaccagcctggccaacatggtgaaaccccrtttctactaaaaatacaaaaattatccaggcatggtggtgggcacctgtaatcccagctactcggaaggctgaggcagcagaattgcttgaacccgggaggcggaggagctgagattgcaccactgcactgcagcctgggcgacaaaacaagactctgtctcgaaaaataataacaataaaaaataaagatggcaaccatagacactggagactactagatgggggggaagaaagggggttgaaaaactgcctattgggtactatgctcagtacctgggtgacaggatcaatcgtactccaaacctcagcatcacaaattatttaaatttttctctttttttaattttttttgttgttgttgttgagacgaagtctcactctkttgcccaggctggagtgcagtggtgtgatctcggctcactgcaagctctgcctcccrggttcacgccattctcctgccccaatctcccgagtagctgggactacacgcgcccgccaccacgtcctgctaattttttgtattttcagtagacacggggtttcaccgtgttagccaggatggtcttgatatcgtcaccttgtgatccacccgcctcggcctcccaaagtgctgggaatacaggcgtgagctaccgcacccggcctaaatttttttttaaataaagaatggtaggttcttcacaccctaatgtatttttacttctcccacagagaaggaaaggaatggcttccccatggcragccacctcagtctgggctttcttttcttccaggggactttcccatgcctttcatatctgccamatcgagtcctgtgattcccttggatggatctgtgaaaatccagtgccaggccattcgtgaagcttacctgacccagctgatgatcataaaaaactccacgtaccgagagataggcagaagactgaagttttggaatgagactgatcctgagttcgtcattgaccacatggacgcaaacaaggcagggcgctatcagtgccaatataggatagggcactacagrttccggtacagtracaccctggagctggtagtgacaggtaaggaaacatccagggtccacagccctggtgtgatttttttcttatttttaatagagtatttttcaagaagttttagatttacaaacaaaaaaaaattgatgattgcttcagagagttctcagccatctggcaccccacttcccccagagttaacatcttacattagtatggcacatttcttaccattaatgaacaaatatcgacacattcccagctacagtctacagtttatttacattttcttagtttttacctgatagtctttctctgttccagratcccattcaagatttcacattgcggctgggagtggtggctcacgcctgtaatcccaacacttagggaagccgaggcgggtggatcacccaaggtcaggagttcgagaccagcctggccaacatggtgaattccccgtctctactgaaaatgcaacaatcgcygggcgcggtggctcacgcctgtaatcccaacactttgggtggctgaggtgggtggatcacctgaggtcaggagttcgagaccagcctggccaacacagtgaaacctcgtctctactaaaaatggaaaaaattggccaggcctggtggcacacgcctgtaatcccagctacttgggaggctgaggcaggagaatcgcttgaacccaggaggcagaggttgcagtgagccaagatcacaccactgcactccaggctgggcgacagggcgagactccatctcacacacacacacacaaaaagatttcacattgcattcaggtgtcatgcatctttttttttttttttttttttttttgagacggagtcccgctgtgttgcccaggctggagtgcagtggcacaatctcggctcactgcaagctccaacctcccgggttcacgccattctcctgcctcagcctcccgagtagctgggactacaggcgyccgccaccacgcctggctaattttttgtatttttagtagagatagggtttcactgtgttagccaggatggtctcaatcttctgacctcgtgatccgcccgcctggcctcccaaagtgctgggattactggcgtgagccaccacgcccggccyccgaaaatgctgggattacaggcatgagccaccgcacctggcctcccaaagtgctgggattccaggcgtgagccaccgtgcccrgcaggtgtcatgtatctttaggtttgtcttggctgtcacagcttctcagatgttgctggttttccatgaccttgtcagttttgagggtagtggtccattattttcaagggtactcccactactggaaattgtcygatgttttgctcatgactagactgagttatgggtcattgcaggcaagaccacagaagcaaagtgccatttcatctcctcatagcaaaggtttaaactgtccatgggaacatgactgtggatgttgagctggctgttgttgaaagcctggctgaagtagtaactgtggccagacaccgtggctcgtgcctgtaatcccagcactttgagaggccgagatgggcagatcacttaagcccaggagaccagcctgggcaacatagtaagaccccatctgtacaaaaaatcaaaaaattagctgggcatggtggcatccacctgtagtctcagctacttgagaggctgagatggtaggatcacctgagcctgggaggtcgaggctgcagtgagccgtgattatgccactgccctcagcctgggcgatagagtgagaccctctctaaaataaataaattctaaaaaagaaaaaagaggctgggcactgtggttcacgcctgtaatcccagcactttgggaggctgaggcaggtggatcacctgaggtcagggattcaagaccagcctgaccaacatggggaaacctcatctttactaaaaatacaaaaattagctgggcgtggtggcgggtgyctgtaatcccagctactcgggaggctgaggcaggagactcacttgaacctcggaggtggaggttgcagtgagcggagatcatgccactgcactgcagcctcagtgacagagcgagactccatctcaaaaaacaataataggctgggcrcagttgctcatgcctgtaatcccagcactttgggaggccaaggtgggcaaatcacctgaggtcaggagttcgagaccagcctgaccaacatggagagaccccgtctctactaaaaatacaaaaattagctgggcgtggtggtacgcacctgtaatcccagtttctcgggaggctgaggcaggagaattgcttgaacccgggagacggaggttgcagtgagctgagatcacgccactgcactccagcttgggcaataagagcgaaactccatctcaaaaaaatatataataataacaataakaagaagaagaaaagaataaaggagaaaaggtctttctaatagctcactcttttctctcttaggcttgtatggcaaacccttcctctctgcagatcggggtctggtgttgatgccaggagagaatatttccctcacgtgcagctcagcacacatcccatttgatagattttcwctggccaaggagggagaactttctctgccacagcaccaaagtggggaacacccggccaacttctctttgggtcctgtggacctcaatgtctcagggatctacaggtgctacggttggtacaacaggagcccctacctgtggtccttccccagtaatgccytggagcttgtggtcacaggtaggtaccgcccagtccagccytgtgtctgggttggctgtccagggccttgccaccgggcaggaatatgaagaygtgcactgagagtgaagtgaagagaggcaaaggctctcactccaggacagtggagagagaaaggcttccccaccacactttccgctttcacttcctcgctagagttctccagacagggttcattgaaaacttagtctgtggagaacagaagggctaactcagtttgtttcattttatttatttcattttattttccgggatagagtcttgctctttcgccaaggctggagtgcagtggcacgatctcgactcactgcaaccttcgcctcccaggttcaagcaattctcctgcctcagcctcctgagtagctgggaccacacagacagggtttcaccatgttggccaggctggtctcgaactcccgacctcaggtgatccacctgcctcggcctcccaaagtgctgggattacaggcgtgagccaccgcgcctggccaggctgcacacattcttattaggattccaccttgttctggtgttgtagagatgtgattaggtatttagtgaattcaccaagtgaggagagaatgaaaagaaaacacaacctgcctggccgggcgtggtggcgtgagcctgtcgtcccagctactcaggaggctgaggcaggagaatcacttgaacccaggaggcagctgttgcagtgagccaagatcacgccattgcactccagcctgggtgacagaacgagactccacctcaagaaaaaaaaaaaaaacacggytgggcacgatggctcacgcctgtaatctgagcacattgggaggctgaggcaggtggatcacctgaggtcgggagttcgagaccagcctggccaacatagtgaaaccccatctccactaaaaatacaaaaattaaccaggcgtggtggtggtgggcgcctgtaatcccagctacttgggaggctgaggcaggagaatcacttgaccagggaggcggaggttgcagtgagccgagatcrcgccactgcactccagcctgggcaacagagtgagamtccatctcaaaaaaaaaaaaaaaaaaaamacacacaacctgcccataatcacctccttcccagtttatagcacttccctgggaagcacagttccttgcccgtgaacacagtcttgctgactgatcagtgtggtgctggcgaagcatgagctcattgaggggatgcttgagggagtcccattttggcaagcgaaaaggaaaatgagctcccgtttcagggctctggggttgggatggaatgraacacaaccaccaaccattcatctccttgaattgtgtctccagactccatccaccaagattacacgacgcagaacttgatccgcatggccgtggcaggactggtcctcgtggctctcttggccatactggttgaaaattggcacagccatacggcactgaacaaggaagcctcggcagatgtggctgaacygagctggrgccaacagatgtgtcagccaggattgacctttgcacgaacaccaagtgtctgcaagtaaacacctggaggtgaaggcagagaggagccaggactgtggagtccgacaaagctacttgaaggacacaagagagaaaagctcactaagaagcttgaatctacttttttttttttttgagacagagtctggctctgtcacccaggctggagtgcagtggagcaatctcggctcattgaacctcttgggttcaagtgattcttgtgcctcagcctcccaagtagctggaattacaggcacataccactgcacccagctaatttttgtatttttagtagagatggggtttcactgtgttggccaggctggtctcgaactcctgacctcaggtgatccacccaccttggcctcccaaagtgctgagattataggcatgagccaccacgcctggccagatgcatgttcaaaccaatcaaatggtgttttcttatgcaggactgatcgatttgcacccacctttctgcacataagttatggttttccatcttatctgtcttytgattttktatatcctgtttaatttcttccttcattgttcttctctttttttatttattttatttatttttatttttatttttatttgagacagagtctcactctgttgcccaggctggagtgcagtggcacgatctcggctcactgcaacctctgcctcctgggttcaagtgattctcctgcctcggcctcccaagtagctgggattrcaggctcccaccatcacgcccagctacttttacagtatttttagtagagacggggtttcatcacattggccaagctggtctcaaacttctgacctcgtgatctgcccgcctcggcctcccaaagtgctgggattacagatgtgagccactgcgcccagccttctttttatatttttaaatgtgtcttccccaaatataaatggttggtaagcatgccaaatatattcaataacccccctcctttatttttttttgttgaagtgaggctctccctatgttgcctaagctggtcttgaactcctggtctcaagcaatcctcctacctcagcctcctgctgtgttcatctacaaattgataagagtgaaagtcataatcctacaggaggattaccctatttatttcacaaaccctatttctaccggattttcatacaaggaatacaggcatgtgtttcacctcattaatttattttttcacttagttttgatgatattcacatatattatcaagtgtgcaaacattaaattcttgtgtacaaaactcaaatggtcttccaaataattccccattcttttttcttataaactttcacagctttacccttgacagactttactcaaggaaatctaagttggtcatatgtggctctttcactgattgctatttacttcattgtccagtagcttatgtatgaaaatataattataaaatgtaagggtcctacttccagtgaaactgaagggacttaggcccactkttatcctttactgagagcttatctctacttgataaaatttctactgtattcttggcttaactcaggtcctgtgattaaaaaaaaaatgcaaagtatttctaactttctttattgactgcttttcacactttatacaagttctggcccatatcttcagtttgttctgatttttttcaccaggtgtggtggcaggtgcctgtagtcccagctactccaggggctgaggcaggagaatggcgtgaacctgggaggcggggcttgcaatgagctgagatcacgccactacactccagcctgggccacagagcgagactccgtctcaaaagtaaacaaacaaataaataataaataaataaataaagggaaagtgccacaattttggatgaagggggttgagggactttacgtcaggtccaggacttggattacagagacacaatggggctagattcccagagatggataagattaaactcatataagtcgttttgctgacagaaggaccttgtttggaaaaagcgttttcagaataataaagttcctgagctcttcagaaaagtattttattgtcctgtaaccacagtaacaagtagccaccaaaactgatttttaacccatcatcaatgacaactcatctctgtgaagatgctctttttttttttttttttttttgagacggggtcttgctctgtcacccaggctggggagcagtgacgtgacctcggctccctgcaacctctctttcccgggttcagcaattctcctgcctcagcctccccagtagctgggattataggcacctgccaccacacgcagataatttttgtatttttagtacagacgggtttcgccatgttggccaagctggtcacaaacttctgacctcagggtgatctgcctgcctcagcctctcaaagtgctgggattacaggagtgagccacaaagcccggccactccatacgttttatattgttatgttaccatcagtcaggcagctccttgcttctaaaagtcatccaatcagactcatttcagtaaacacccaagcatgagtgacaaccaatcaaagtaatatcttcccaatgaccacacttttccagatgacgtcaagccacagaaggccctgaaaatccaacaatctctgaagtatacatttcccaggctgagcgcagtggctcacacctgaaatcccagcactttgggaggctaaggcaggcagatcacgaggccaggagttcgagaccagcctggccaacatggcaaaaccccgtctctactaaaaatacaaaaattagccaggtgtggtggcacgcacctgcattaccagctactgaggaggctgaggcaggagaatggcttgaacccaggaggcggaggttgcagtgagccaagatcgtaccaccgcactccagccttggtgacagagcaagactccatctcaacaacaacaacaaaaatggttgaaataaaacttctatgtgttgaacgattcctcttttaggcatagagtttcagttttacaagatgaaaatattctggagatctgtttcaaaacaccgtgaatacatttaacactgctatactgtacacttacaatggctaagatggtaaattgtatgttatgtttttactacaatttttttttttttttttctgagacagagtctcactcttgttgcccaggctggagtgcaatggygcggtctcggctcaccgcaacctccgcctcctgggctcaagccattctcctgcctcagcctccagagcagctgggattacaggcatgcgccaccacgcctggctaattttatatttttagaagagacggggtttctccatgttggtcaggctggtctcgaactctggacctcaggtgatccacccgccttggcctcccaaagtgctgggatcacaggcgtgagccaccacgcctggcctacaatttttttttaacttttttttctgagatggagtctcgctcttgtcacccaagttggagtgcagtagtgtgatctcggctcactgcaacctctgcctccctggttcaagggattctcctgcctcaacctcccaagtgtgggagatcagtcagagtagcagaagaaattataggaataggaagcagcaaaccttcttggaaggccagggaggttggcatagcttcagatagtttggctgaaagcagccagattctcttttcaggagccaaacagcttagggcgcagatacaaaggaatgcggagtattttatctaaatagcttgcttagtcatatggtcctaaaatcaacctttgatcattctcgggcaagatggccctctccagggaggtggcggggggcggtgaccaggttaattacccacaggtgtgttgactcaaagcctttgttaattaaatctgtgctaaataaatgcaagcgttgccagcttagaggggctgcactctctttggctcctagtgccggcagccccctggcctgctctttcactgaatattggtgtctgaggacgtgtctcatctgtcgtacagctgggatctgcagaacagatcccccccgcacccaagaagctgggattacaggcacccgccgccaygcccagctcatttttgtatttttagtagagacagggtttcaycatgttggtcaggccggtctcgaactcccggcctcaggtgatctgcccgcctcagcctcccaaaagtgcttggattacaggcatgagccactgcgcctggccttagaaaacttctttttctttttttttttttttttttttgagacagagtttcactctgtcgctacgctggtgtgatctgggctcactgcaatctccgcctcccaggttcaagtgattcccctgcctcagcctcccgagtagctggaactacaggtgcgcaccgccacgcccggctaatttcttgtattttcgtrgagacggggyttcaccatgttggctaggctggtctgtttcatgcgcgtccgtgtgaagagaccaccaaacaggctctgtgtgagcarcaaggctgtttatttcacctgggtgcaggyrggctgagtccgacaagagagtcagcgaagggggataggggtggggccgttttataggatttgggtaggtaaaggaaaattacagtcaaaggggggttgttctttggtgggcaggagtggggggtcacaaggtgctcagtaggggagcttttgagtcaggatgaaccagaagaaggaatttcacaagataatgtcatcagttaaggcaggaacaggccattttcatttctttcgtggtggaatgtcatcagttaaggcaggaaccggccatctggatgtgtacgtgcaggtcacaggggatatgatggcttagcttgggctcagaggcctgacattcctgtcttcttatattaataagaaaaataaaacgaaatagtggtaaagtgttgggatggygaaaattttggggggtggtatggagagakaatgggcgatgtttctcagggctgcttcgagcgggattaggggcggcgtgggaacctagagtgggagmgattaagctgaaggaagattttgtgktaaggggtgatattgtgggattgttagaagaaacatttttcatttagaattactggtgatggcctggatgcagttttgtatgaattgaaaaactaaatggaataaggaaaggagaaaaacaggtatwaaaggtctaagaattgggacgactcaggacatctgattagagagtgcctaaggaggttcagcatagccttgccagcaaagattatttatttacttcaagagttaagagtggcggtttggggatagcaccaggagatatcagctgtgatggcttggaaaaacagtgtaaaccagcagtgtaaacaagagcagggcatgtgtgagtagttgagaatggtgaataggagtatgactagacagaagatagtagggatgacaagttttttggggcacawtcyaagttggtctggtgtctggaatgagactggggcttaataaaaagsagygtctatacaggagctcaaatgtgctgtaccttgtagcattctgaggacaggcctgaattctgagaaaagaaagtggtaaaagtattgtccagtcttttttaagttggtggctgagcttggtgaggtgtgtttttaawagacyattagtcyrttctacttttcctgaagactgaggactgtaagggatataaaggtttcactgaataccaagagcctgaaaaactgcttggctgatttgactaataaaggccggtstgctatcagactgtatagaggtgggaaggccaaactgtggaattatgtctgacagaagggaagaaatgacctcggtggccttctcagaccctgtgggaaaggcctctacccatccagtgaaagtktctacccagaccaagaggtattttagtttcctgactcagggcatgtgagtaaagtcaatttgccagtcctrggcgggggcaaatccccgagcctgatgtgtagggaagggaggggacctgagcaatccctgaggggtagtagaatagcagatggaacactgakaagtggtttccwtgaggatagatttccaggatggaaaggaaatgagaggttctaagagatgggctagcagcttgtaacctacatggaagaggctatgaaatatcraccgaatagaatgggcctgtgaggctggaaggaggtattttccttggtctaagaaccatttgccttgtgtgggaagagattgatgggtggaagtttcagtgggggagtaggtgggagtgactgatgagaaggagaaaaactggctgtgggggacagaaattggcatgctagctgcttgtctagctaccttatcagcataagcatagatgtgagagacagaagttggaaagctagctgcttgtctagccaccttgtcagcataggcattgtctagagcaatgggatctgatgacttttgatggcctttgcagtgaatgactccagcttcctttgggagtaaagcggccttgagcagagtttttattaaggaggcattaaagatggaggacccttgtgtagtgaggaaacctctttcagcccatatgaccgcatggtggggcagaatatgaaaggcatatttagagtcagtataaatattgatgcatagtccttttgcatcagtgagggcttgagttaaggcaactaattcggcttgctgagaggtagtggagggggcagagcggtagcctcaatgatagatgtggaagatactatagcatagcctgcctttgctggtgagtggcgattaggcctggtggaactgccatcaataaactaaatgtgattagggtgaggaataggaaagaaggaaatgtggggaaatggggtgaatgtcaggtggatcagagagatacagtcatgggggtcaggtgtggtatccggaataatgtgggaggccggattgaagtatgggccagtaacaatggtgattgtgggagactcaacaaagagtgagtgtagctgaaggagccgggaagcagaaagtatatgcgtcaggtgtgaggaagaaaatagatttttggaagttatgagaactgtagagagtgagttgagcatagtttgtgattttgagggcctctaaaactattaaagcagcggcagccgctgctcacagacatgagggctaggctaaaacagtaaggtcaagttgttcggacagaaaggctacagggtgcggtcctggctcttgtgtaagagttccgaccacgctaaccatgcctaggaaggaaaggagttgttgttttgtagaaggtgctggggcttgagagatcagtcagacacgatcggcatggagagcacgtgtgtttttatgagaattatgccgagataggtaacagaggaggaagaaatttgggcttgactgaagtaatgggggctgtctgtgaagctttgcggcagtacagcccaggtaatttgctgagcttgatcggtgtcagggtcagtccaagtgaaagcgaagagaggctgggatgaagggtgcaaaggaatagtaaagaaagcacgtttgagatccagaacagaataatgggttgtagaggcaggtattgaggataggagagtatatgggtttggcactacggggtggataggcaaaacaatttggttgataaggcgcagatcctgaactaatgtgtaagccttgtctggttttaggacaggtaaaatgggagaattgtaaggggagtttataggctttaaaaggccatgctgtagcaggctttaatccttttaaagcgtgctgcggaatgggatattggcgttgagtggggtaagggtgattaggttttaatgagatggtaaggggtgcatgatcggtcaccaaggagggagtagaggtatcctatacttgtgggttaaggtggggggatgcaagaggaggaagcaaaggaggctttggattgggaagaatggcagcaatgagatatagc

SEQ ID NO: 13266 - DNA, 21848 bp, Homo sapiens
  misc_feature (1)...(21848): n = A,T,C or G, or insertion/deletion polymorphism (see Tables 1-2)
ctgccttggcctcccaaagtgcagggattacaggtgtgagccaccactcctggccccaaaattgtttgcataccttttgttacaatggatttactttccaaaaatgtccttggtatgtatgtatgtgtgtttgtgtgtttgtgtgagagtgtgtatgtctgtatgaatgtatgtatgtattatatataatcttcaaagaaggatgcaaagatatacatacacaggtgttcattttgctaaggtaggaacaccacatcaatacaagagaaaaaatagctttgtacataacaggaagaaactgtccatcatagtaggtaagggtatagagtcagaatgccatgattcaactccttctctgcaagttacctgcagcatcatcttgggtaactttcttctttttgkacttcaattctcccatctgtaaaatgggaataatagtactactctacctcatagagttattgtaagaattaagtgtaacgtactagtaacagtgaccggcacagaattacttgatccataaacattagttatatgatactaattatccccgttgttctaaaaggggagaaagctgcataaatgtaacctagaagtcagaggtcaacacaggcagcttctattttcatcctaaactaaacctaaagtgggcctcgattctccccacaaggaaacctagtacacaaaatactagttagcacatatattagtctgttctcacactactgataaatacataccaagagtrgataatttatamagggaagaagtttaattgactcacagttctgcagagctgggaaggcctcaggaaacttacaatcaaggcagaaggggaagcaaatatgcccttcttcacatgacagcaggaaggagaagtgcggaaygaaacagggaaatccctttataaaaccattcaatcttgtgagaactcactcactatcacaagaacagtatgagggtaactgcacccatgattcaattacctcccaacaggtccctcccacaacatatgaggattatgggaactagaattcaaggtgagatttgggtggggacacagccaaaccatatcagcaaagtagattgaaacattgagcaaataacaaaggattgaagggagatcctggacccaatagcatactttgtccatcctcattcaacttgcgtctttttcttagtttgtcgttacctctttattatgtggagaggatagagatttttctgcccacgtctcccccttccctaacattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctgggctcaagtgatccttggcctcccaaagtgctggaattacagctgtgagccactgcgcccagcccatatgcttaatatatgaaaacttttagtgattgattacattatttgaatataaagcttctctttctaacctgcaatttatgcttaaaaataagacagccagtctgattcctaaaaatttgatcttaattttctcaacaaatgccaaaaatcatctcagtcaaagttaatgaaaggtaaaatgagtactatagaaaggacatcaggtgtctcacagactgggctgtgaagaatcaaattattatgtttggacgttttggttacttctgttgatgcagttggtaggctttccctctaaaatgctgccatggatataacatcagtccaattgacccagttcccttccccttccccttccccttccccttcttcttctcctcctcctcctccttcttcttccagcaaatatcaaatttggagagacaatctggtagatttagcttgcgtaaagggtytgtctacccctagcttggtcacctgtggttagagggtcagggtgttgtagtactgacaggaccactggagcttcatacctccattttaggggtcattccaggagaagggagcagcactcccagaggtgttcattacacccttaatggttgtgggtctcaatgtgacaaaagcagaagagcatctctatcttttcttagctcttgtgatctccatcctgttgtaggagaaaatgtcctattatcccttattaccatgctctrtgtcagctcccataagaaatggaaactgacatctaagccagtagagggagacattccacaagagatggcgtcatctcctatttcttccccaccatatgctttcccactaaagatgaccaacaaattgcaggtgtcaccactgcactgctctcaggcttgccccaagagctctggtccagcctggcctccaactcgtcagtgttaatcaaggtaacacaaggaaaatatatacagagactaacaacttattacagtacctcaaaacctatgcatatttagacaacgagaatcagtattccttttagtcattcgttcatttatatattcatgaatttgctcaaccgatatttattaaatactggctatgtgccaggtgcatgacataaactgtacagtcattcaaaccaagtttcaagtctaaaagcccttttcctttgaagttcgtttccccctgaagaaagttagatccttaagttaccagtcccaaagcctcacctcccccaatcttaggctcaacactaattattgtaagtagttttcattttctgtctttccttttagacttaaggcttcgccaaggtctcccyggccccyagcaaactacctgstatgaagtagatgctctgtaaatagttgttaagcacaaattgccttgtgctatggagacygggcctgacatgagttgtaaaagtatcaacaagtgtattgacaatgggtatcggcaagtctttgcccttcaagccagagagctgctgggcaggacagattatctctgttttctctgtcactgatttactacccttgacttatgcaatracatcagctaatatgaagaacactgcactratgacctcaaaataactgaacaaatagtactccctttcccctccaccaatggcatcaacattctaaaaaaatttaagcatcttaataagcggtgtctctgcaaatatatttcttccctgaaaacatgataatattctttgtaatattaggcaatttagagtcccagtgtaactgtacataactctacagaaaaaagacatatctaacaagaactagaattacaaaaactcattatcactgcattgcacatgcttcacacagacatgaatactatacccacatatgagggtaaaaagataagtgaaagtaaaagctatgagtgagtgtgtcagcctgatacattatggtcccaagatgacaggctggccaaaatactccaaaagaacaaacacacaaaaagaaggtagaggtaaatttttataatgtttgtatcctgttgggaaatataatgtaatgggcacagagtgtggactgtagagtcagacagtcaggggtcaagtcctcataccagcacctactacctatacactctggggtagtttacttaacctctctgaacctgtttcaccatctgtagaacatagtggtttcaagaattaaatacgataaatgactaccataatttggcatctgaggcatgtaccaatgacagccagttcactcattcatcccgtaattatgtattgaacgcctactatgtctgtcttgctcaccaatgcattcccagcccctatcacactacccgtcactgaggagactctcaagaactrtttgtaagatgaatgttaagtctgtgctgttatggtgcatgcatgctggattgaatccatcctccttctgaccatgggaagaatgccaatcagagtagaacaaagtaggaaagtaaaggaaccttcactttagtgttgaacaagagtctattatatactagaaaaaactttacaaatttacagacttctgaaagttaaatgatgattctattgttagttgatcaaacatcagtcattgaaaatgtagtaatacgttacctcaaaagaaaaaaaaaaggttagagttttcttaacagataattctttttaaatctgtaagaatctgtacgtcactaaaataaaatcctgtctagattattaaaataaactttgttatcagttatattttcatggaaaatattcctgtatatattttaattaatagccacataratatttgctttttctgtcagatcatgtatccctttaaaaaccattaaagctaaagaaaaaaatcttaaaatataatatttactcattgctaataaagggaacacaaatttggaaagactcaagtgaatattttttcttaatttaaactgagtactttgtctctattaagctaagttaaaagaatttgggaggacaacctatgytaccaagagaataatttgtttctaggaatctgagttaaaagaatttgggaatgcaatctctgctacctggagargaaagaaatgtcgtgggtcccacaccattctcaagactctgtttcaaagcattgtttcaatacgctgatccaaaccctgataacctgccatctttttaataaaataatttataaatttaatgagaatgtttcactttccatacaaaaaayagaaaaatgctttgaatcaatgcacttactgggatttggattactgactggtgttcctattgattcttgtaggagttattaatcctgattgcaacacacaagtgaacagacaagagagataaattttgtggcttgtggraaatgaaggaaaatgggcctcatttagtctgtgagcatactaattgaaatagatgtatgaagacttcaccagtgttaaaataacattgtttttataaatcatatgatataaactatataacaataaaatagaatgttaaacatgtatttaatcatcatcataattttgattcagaaatctataatttattagttatcttaataatgtttagaatttgttgaacattttaccttatgtgaattaaggacaaaatattaaagctattcagcacaaaaaaagggtctttctgatgtgtatttttcatagaatagggtatgaatttgttattttgttattttgattaatgtctaaaacaaaagataaacacattatgatataacattactattgattttaatrgcccyttttgaaatagaattatgtcattgtcagaaaacataagcatttatggtatatcattaatgagtcacgattttagtggttgccttgtgagtaggtcaaatttactaagcttagatttgttttctcacatattctttcggagcttgtgtagtttccacattaatttaccagaaacaagatacacatctctctttgaggagtgycctaacttcccatcattttgtccaattaaatgaattgaagaaatttaatgtttctaaactagaccaacaaagaataatagttgtatgacaagtaaataagytttgctgggaagatgttgcttaaatgataaaatggttcagccaacaagtgaaccaaaaattaaatattaactaaggaaaggtaaccatttctgaagtcattcctagcagaggactcagatatatataggattgaagatctctcagttaagtctacatgraaaggatggtttcttggagcttccacaaacttaaaaccatgaaacatctattattgctactattgtgtgtttttctagttaagtcccaaggtgtcaacgacaatgaggaggtgaattttttaaagcattattatattattagtagtattattaatataagatgtaacataatcatattatgtgcttattttaatgaaattagcattgcttatagttatgaaatggaattgttaacctctgacttattgtatttaaagaatgtttcatagtatttcttatataaaaacaaagtaatttcttgttttctagtttatcacctttgttttcttaagatgargatggcttagctaatgtaagatgtgtttttctcacttgctattctgagtactgtgattttcatttacttctagcaatacaggattacaattaagaggacaagatctgaaaatctcacaarctataaaataataaaagagcagaattttaagataaaagaaactggtggtaggtagattgttctttggtgaaggaaggtaatatatattgttactgagattactatttataaaaattataactaagcctaaaagcaaaatacatcaagtgtaatgatagaaaatgaaatattgcttttttcagatgaaaagttcaaattagagttagtgtgtattgttattattaatagttatgaaacacggttcagtctaatttatttayttrtagaacagtttgtcctcaactattatttttgctgacttattgctgttaatttgcagttactaaaaatacagaaatgcatttaggacaatggatatttaagaaatttaaattttatcatcaaacgtatcatggccaaatttcttacatatagcatagtatcattaaactagaaataagaatacacaataatatttaaatgaagtgattcatttcggatcattattgagtttcaagggaacttgartgttgtacttatcagactctacatgtaagaacatatagttaatctggttgtgtgtgtaaaaacatatggttaatctggttaagtctggttaatcatattaggtaagaaaaatgtaaagaatgtgtaagacgaaatttttgtaaagtactctgcaaagcactttcacatttctgcttatcaactaaacctcacagagatagtttaatagtttaggctttaaaatggattttgattattcaacaagtggccttcataatttctttaagtgtttttctttaagtatatactttctttaaatattttttaaaatttccttttctctagtaaagccagaccatccatgctacctctctagtggcactctgaaataaaaagaaaatagttttctctgttataattgtatttgtaataagcagatgaatcacatttcttaaaatttgttttagagagggtaagctctgactaggaccatgacttcaatgtgaaatatgtatatatcctccgaatctttacatattaagaatgtatatagtcaactggttaaacaggaaaatctggaaccagcctggctgggttttaatcttagcaccatcctactaaatgytaaataatattataatctaatgaataaatgacaatgcaattccaaatagagttcatctgatgacttctagactcacaaaattgcaagagagctcagttgttgctcagttgktccaaatcatgtcgtttgttaatttgtaattaagctccaaaggatgtatagctactgacaaaaaaaaaaatgagaatgtagttaatccaaatcaaaactttcctattgcaatgcgtattttctgcttcattatcctttaatataatattttaagttagcaagtaattttaattacaatgcacaagccttgagaattattttaaatataagaaaatcataatgtttgataaagaaatcatgtaagaaatttcaagataatggtttaacaaataattttgttgatagaagataagactaaaagtgaaattcgaagtggagaggacacttaaactgtagtacttgttatgtgtgattccagtaaaaatagtaatgagcrcttattattgccaagtactgttctgagggtaccatatgcaataagttatttaatccttacaataatcttgtaaggcagattcaaactatcattacacttattttacagatgagaaaactggggcacagataaagcaacttgcccaaggtctyatagctgtaagtcaaccctacggtcaagacctacaagtagccgagctccagagtacattatgagggtcaaagattgtcttattacaaawaaattccaagtagaatcaayctttaataagtctttaatgtctcttaaatatgtttatataggagtctaatcaccaattcacaaaaatgaaagtagggaaatgattaacaataatcataggaatctaacaatccaagtggcttgagaatattcattcttcttgacagtatagattcyttacaatttcgtaagttccaatgtatgttttaggaatatgaggtcattactattcataatctgatacagctttatcctaagrcctctctttaaaaactacactgcatcatagcttttttgtgcagttggtctttctrctgttactgaacagtaagcaacctacagattcactatcaccaaccagccagttgatggatcttaagcaaattatcaagcttgtgataacctaaattataaaatgagggtgttggaatagttacattccaaatcttctataacactctgtattatatttctgcctcattccttgtagggtttcttcagtgccygtkgtcatcgrccccttgacaagaagagagaagaggctcccagcctgaggcctgccccaccgcccatcagtggaggtggctatcgggctygtccagccaaagcagctgccactcaaaagaaagtagaaagaaaagcccctgatgctggaggctgtcttcayrctgacycagacctggtgggtgcactgatgtttcttgcagtggtggctctctcatgcagagaaagcctgtagtcatggcagtctsctaatgtttcactgacccacattaccatcactgttattttgtttgtttattttggaaataaaattcaaaacataaacatattgggcctttggtttaggctttctttcttgttttctttggtctgggcccmaaatttcaaattaggatatgtgggtgccacctttccatttgtattttgccactgcctttgtttagttggtaaaattttcatagcccaattatattttttctggggtaagtaatattttaaatctctatgagagtatgatgatgactttcgaatttctggtcttacagaaaaycaaataataaatttttatgttggctaatcgtatcgctgaattttcctatgtgctattttaacaaatgtccatgacccaaatccttcatctaatgcctgctattttctttgtttttagggggtgttgtgycctacaggatgtcagttgcaagaggctttgctacaacaggaaaggccaatcagaaatagtgttgatgagttaaataacaatgtggaagctgtttcccagacctcctcttcttcctttcagtacatgtatttgctgaaagacctgtggcaaaagaggcagaagcaagtaaaaggtagatatccttgtgctttccattcgattttcagctataaaattggaaccgttagactgccaygagaatgcatggttgtgagaagattaacatttctgggttagtgaatagcattcatacgcttttgggcaccttcccctgcaacttgccagataagcaytattcagctcttattcccagtctgacatcagcaagtgtgattttctatgaaaaattctactatgactccttattttaagtatacaagwaacttgtgactcagaagataatatttacagagtggaaaaaaacccctagcatttatagttttaacatttgaggttttgaatgagagagttatccataatatattcaattgtgttgtggataatgacacctaacctgtgaatcttgaggtcagaatgttgagtgctgttgacttggtggtcaggaaacagctagtgcgtgagcctggcacaggcatctcagtgagtagcatacccacagttggaaatttttcaaagaaatcaaaggaatcatgacatcttataaatttcaaggttctgctatacttatgtgaaatggataaataaatcaagcatatccactctgtaagattgaacttctcagatggaagaccccaatactgctttctcctcttttccctcaccaaagaaataaacaacctatttcatttattactggacacaatctttagcgtatacctatggtaaattactagtatggtggttaggatttatgttaatttgtatatgtcatgcgccaaatcatttccactaaatatgactatatatcataactgcttggtgatagctcagtgtttaatagtttattctcagaaaatcaaaattgtatagttaaatacattagttttatgaggcaaaaatgctaactatttctacataatttcatttttccagataatgaaaatgtagtcmatgagtactcctcagaactggaaaagcaccaattatatatagatgagactgtgaatagyartatcscaactaaccttygtgtgcttcgttcaatcctrgaaaacctgagaagcaaaatacaaaagttagaatctgatgtctcagctcaaatggaatattgtcgcaccccatgcactgtcagttgcaatattcctgtggtgtctggcaaaggtaactgattcataaacatatttttagagagttccagaagaactcacacaccaaaaataagagaacaacaacaacaacaaaaatgctaagtggattttcccaacagatcatartgacattacrgtacatcataaaaatatccttagccagttgtgttttggactggcctggtgcatttgctggttttgatgagcwggatggggcacaggtagtcccaggggtggctgatgtgtgcatctgcrtactggcttgaacagatggcagaaccacagatagatgtagaagtttctccattttgtgtgttctgggagctcatggatattccaggacacaaaaggtggagaagagctttgttcatcctcttagcagataaacgtcctcaaaactgggttggacttactaaaktaaaatgaaaatctaatatttgttatattattttcaaaggtctataataacacactccttagtaacttatgtaatgttattttaaagaattggtgactaaatacaaagtaattatgtcataaacccctgaacataatgttgtcttacatttgcagaatgtgaggaaattatcaggaaaggaggtgaaacatctgaaatgtatctcattcaacctgacagttctgtcaaacygtatagagtatactgtgacatgaatacagaaaatggaggtaagctttcgacagttgttgacctgttgatctgtaattatttggataccgtaaaatgccaggaaacaaggccaggtgtggtggctcatacctgtaattccagcaccttgggaggccaaagtgggctgatagcttgagcctaggagtttgaaactagcctgggcaacataatgagaccctaactctacaaaaaaaaaaaaaataccaaaaaaaaaaaaaatcagctgtgttggtagtatgtgcctgtagtcccagctatccaggaggctgagatgggagatcacctgagcccacaacctggagtcttgatcatgctactgaactgtagcctgggcaacagaggatagtgagatcctgtctcaaaaaraaaaattaattaaaaagccaggaaacaagacttagctctaacatctaacatagctgacaaagagtaatttgatgtggaattcaacctgatatttawaaagttataaaatatctataattcacaatttggggtaagataaagcacttgcagtttccaaagattttacaagtttacctctcatatttatttccttattgtgtctattttagagcaccaaatatatactaaatggaatggacaggggattcagatattattttcaaagtgacattatttgctgttggttaatatatgctctttttgtttctgtcaaccaaaggatggacagtkattcagaaccrtcaagacggtagtgttgactttggcaggaaatgggatccatataaacagggatttggaaatgttgcaaccaacacagatgggaagaattactgtggcctaccaggtaacgaacaggcatgcaaaataaaatcattctatttgaaatgggattttttttaattaaaaaacattcattgttggaagcctgttttaggcagttaagaggagtttcctgacaaaaatgtggaagctaaagataagggaagaaaggcagtttttagtttcccaaaattttatttttggtgagattttattttgtttttcttttaggtgaatattggcttggaaatgataaaattagccagcttaccaggatgggacccacagaacttttgatagaaatggagkactggaaaggagacaaagtaaaggctcactatggaggattcactgtacagaatgaarccaacaaataccagatctcrgtgaacaaatayagaggaacagccggtaatgccckcatggatggagcatctcagctgatgggagaaaacaggaccaygaccattcacaacggcatgttcttcagcacgtatgacagagacaatgacggctggtatgtgtggcactctttgctcctgctttaaaaatcacactaatatcattactcagaatcattaacaatatttttaatagctaccacttcctgggcacttactgtcagccactgtcctaagctctttatgcatcactcgaaagcatttcaactataaggtagacattcttattctcattttacagatgagatttagagagattacrtgatttgtccaatgtcacacaactacccagagataaaactagaatttgagcrcagttactttctgaataatgagcatttagataaatacctatatctctatattctaaagtgtgtgtgaaaactttcattttcatttccagggttctctgatactaagggttgtaaaagctattattccagtataaagtaacaaacacagtccctagatggattggccacaaaggcccagttatctctctttcttgctatagggcacaggaggtctttggtgtattagtgtgactctatgtatagcacccaaaggaaagactactgtgcacacgagtgtagcagtcttttatgggtaatctgcaaaacgtaacttgaccaccgtagttctgtttctaataacgccaaacacattttctttcaggttaacatcagatcccagaaaacagtgttctaaagaagacggtgrtggatggtggtataatagatgtcatgcagccaatccaaacrgcagatactactggggtggacagtacacctgggacatggcaaagcatggcacagatgatggtgtagtakrgatgaattrgaaggggtcatggtactcaatgargaagatgagtatgaagatcaggcccttcttcccacagcaawagtccccaatacgtagatttttgctcttctgtatgtgacaacatttttgtacattatgttattggaattttctttcatacattatattcctctaaaactctcaagcagacgtgagtgtgactttttgaaaaaagtataggataaattacattaaaatagcacatgattttcttttgttttcttcatttctcttgctcaccaagaagtaacaaaagtatagttttgacagagttggtgttcataatttcagttctagttgattgcgagaattttcaaataaggaagaggggtcttttatccttgtcgtaggaaaaccatgacggaaaggaaaaactgatgtttaaaagtccacttttaaaactatatttatttatrtaggatctgtcaaagaaaacttccaaaaagatttattaattaaaccagmctctgttgcaataagttaatrtttycttgttttgtaatccacacattcaatgagttaggctttgcacttgtaaggaaggagaagcgttcacaacctcaaatagctaataaaccggtcttgaatatttgaagatttaaaatctgactctaggacgggcacggtggctcacgactataatcccaacactttgggaggcygaggcgggcggtcacaaggtcaggagttcaagaccagcctgaccaatatggtgaaaccccatctctactaaaaatacaaaaattagccaggcgtggtggcaggtgcctgtagtcccagctacctgtgaggtggagattgcattgagccaagatctcaacactgcactccagcctgggcaacagcgtgagactccacctcaaaaaaaaaaaaaaaagaatctgactatataccatggaaaagccaccactctgccacttaaataaacatcaggatcagagattccaagaggacaatctgsatcaagtcttcaccaagtgttttttaagcgaaataatgaaatagggagcagaatatgcctgttgcccatagaaacgaggtctattcttgtcctcaattaggcttttttttcttcatagttacaccagaactaaagtaaaagtggtttttctsttctttctacttctccccatgaaatgggcatatcatctcaacacttcactccaagtcgccacgggcaaccttatgaccctaggtcctccacccctaatgtatcatcattgccacccatttttatggtacttattgttcttaagcttatcctcttaatcttttcatgtaagcaaagctcattaatttctgtcttggaaatgctactactctctttaattactcaccaaatccaactttaacttttgacctggtttctctgccacaagttctgtcccactggagcccatactcacctaccrctttgccatcacatttaacagaaaactcttatcaacttacttcctgcttaacattagctccttcctatctatatccaaatttcttaaattcaaattttttagctggagtaaaaatggtcccagtaccatttcctgttcccttcactayaacctacatttttgtcacattaagtttttcccyattccaggacaggtcaggccctttaaaaatttcaacagctttattgagatataattgatataatttwaaaaatcctgcacatgtgtcatgctggagccctattgattccaacagggatggcgccttgtccaagaagagacccagagccagtgaatgggacatagggtttatttaggacttaaatacagatgtggtccagtgkcagtgggctggacaggaccgctactatttgtaaagagtatgtagtttatataacatttctacttagcactctccacttagcaacctccatttaacccmaaataaaaggccttggttccttgcacatcctgagttccaacggacaggcagggagttcaagtgtccttcacagataagaagtgaatctctctgggttggccattcccggattccttagcttagactctgaacacatattcttcttagaccatacagtcattctcagggtatgcttgagttaatgctgtcggatgcatctgtcatacaaagtgtttaacatatacgatttcatgattttggaaatatgcatacacccatgatatcactggcacagtcaagatattaaatatatccatcacctccaaaagtttccttgtgttcatttattttagtttttcatggtaagaacatttaatatgaaatattatcaacaaatttttaagtgcacaatactgtattattaattttaggcattatgttgtacagtagatctctagaacatattcatctactaaaaatgaaattttatctccatttccccctacctcccatcccctggcaactaccattctattttccactttgactgtttcagatacctcatataagtgaaatcacacagtatcctttcgcactgttgtggggatgtaaaacggtgcagctaccatgggaagaaatgtggaggcccctaaaaaattttttaaaaaattctgattatcatatgatccagcaatctcacttttaggcatatatccaaaagaactgatatcaggatctggaagcaatatttgtgcatctgtggtcattgcaacattattcacaatgttcaggtccttttatatgatgccctcattgcagcaatgtcttcctcccaacaccatctgacaaactgctatttgtttttaaacctcactttaactgtcaccgcccagagaagactttctaaaacctttgggcaaattttattactttttgacaatgaatgcctgaggcttatccagctttgattccagaaacatcagcctgtcagaatggctaattttcatgcatttgtgaatgctggatggctaaatccagtgattttcaaagtctcgaacatcctctttttaaatgtagaacccattttccaataaagccacaaacagaaactcaacatgcaaagttcttgaatatggaacttttggggcaatactgagagtcgcaaaagttcactgaatgaaaaatgcgggttgggaagactgcagtcatcagacctttgctcactccttacrtgttcacagaggatcaaatgaatccctagagcttgaagtaatgccatagaagaaaaaccactaaagtagataatctgatggtcaattcttagttaatgtacaaatagaaaaaacacagagaccactcccaggtaatatgtaagtctatctagaaagaaatgcactttcttggctgggcacagtggctcccatctgcaaacccagcactttgctgggatgaggtgggaagattgcttcagaccaggagttagaggccagcttggcaacatagtgagaccctgkctctactataaaacttgtaaaaacaaacgaaaatacagtaacgaaaaaagaaatgcactttcttaaggtgtcatttggtaagaaatgttatgtgtctgattttgcccatgcacaattttgaatataataaaaaaggtagcttcccctatttagaatatataaaacagtaacaacaagattgtataactcatgattttaagatgataatagaaagattagttgaaagtttttaatcccacactgtggtatgagaactattttatttttatatatatatatacatatataattatatatatgtatatataattatacaattaggactgaaagtctgcaacaaactataatggatgtatgcacttgggacataagcytctagttcctctttatttatgaaccaagagaaacagctaactcagggattgtttttaaactgactacagattcccaccatggggcaaaaatatgggtgacatgacacatcaccagctgcagtagctcagctcacatttctgtttaagcattacacacataatatcctgtatgctgatcatttaaacttactgacgcttgtaatcccagcactttgggaggccgarggggggtgaatcatgaggtcaggaaattgagaccatcctggacaacatggtgaaatcgaaacagtgtctctactaaaaatacaaaaattagctgggtgtggtggtgtgcacctgtaatcccagctactcgggaggctgaggcaggagaatcacttgaacccrggaggcagaggttacagtgagctgagatcacgccactgcactccagcctgggcataagactgagactccaagtcaaaaaaaaaaatgcagatttcttggtactaacctaggtttattacatcagagactctaagggcaaagagcctgagtctccattttaaaataaatgtccctgagagtgactgatcactggttggatttcagagttactgatagaggctacatttgtatttacctgagactcccttgatatttcttacctactatccttttcactcaaatggtgaccatgaggcaatattttgagcaaatagtcatccttaaagttaccttgaataacttcatggtgaccactgcctatgtttaagaccagacttgggtttaacatctctccaaatgctagaatcactatttccactatacttccgctagtctctggtgattctttggattggacttcaaattctcttgcagtgtagaaaagaattacagatgctacctctcatgtgtacatagagctgacatttcagtttttgaattccatcctcccccctcactattgcatgtgatctgatgctcttgcttgaacttcttgtggtgtgcagctctgcaccaaatagcaatgaattggtacatagtaatgcagacacatggaaagtggaatcactgattttttttttttttttttaagatggagttctgctcttgttgcccaggctggagtacaatggcactcgcaatcatggctcacagcaacctccgtctcctgggttcaagcaattttcctgcctcagcctcccgagtagctgggattacaagcatgcaccaccatgcctggataatttcacatttttagtagagacggggtttctccatgttggtcaggctggtcccaaattcccaaccccaggtgatccacctgcctaggcctcccaaagtgctgggattacaggtgtgagccaccatgcttggccaactgacatttattttaacaacattagttgtggtattaaataatgaaagtagcccgtattctttgcagacattttgggaaatatagaaatgattagacccatttataatttcaacacaagcagtggaatagctaataccttcatttatgttttttgtcttaccctgtacatgttttagtgcctgaatttttcacactgagtcacaaaaagttttccatattatttaacattcttctatagtatcattttctgtaatttgctttttaatggccatatgatattccattatgggaatttatttaaacgtctcctctcatttcacatttaggttttttccaacctttttctattaaagagagtactgacattaacatccttctccataaaccttttgtgcatatatattatataatatattgtatacattatttataatataaatttattttatattttaaaatatttattttataacatggtttacacattataaatgtatatttataatatttatttatttatttctaggataaattacttgaagcagaatatctggaggaaataaaaggttttgggctcagcgcagtacctcatgcctgtaatcctagcactttggaaggctgaggtgggaggattacttggcccaggctgcagtgagccctgactgtgctactgctactgcactacagcctagatgacagagtgagaacctgcctcaaaaaaaatgtttttggcattttaaacttaaaaaaaawatatatatatatatatagccaagtaactctccagaaagattgtaccaatttacctttgatgcacagaataacatatttaatttttattttgcttctccatcactaatattatgattaaaatattagtaattactttaattttaatatcttgaattagtagtacaagtaagagatttaaaaatgtttaatgactattttactatcttctgtgaattgcctatccacgtcctttgctcaattttcttttttttcttgttttttcttctcttctcttttttttgagacaaggtctcgctctgttccccaggctggagtacagtggcgtgatcttggttcactgcaacttctgcttcctgggctcaggtgattctcccacctcagcctcccaaatagctgggaccacaggcatgcaccaccatacctaactaatttttttgtattttttgtagagactgggtttcgccatgttgcccaagctggtctcagactcctggactaaagcgatctgccctccctgacctcccaaagtgctgggattgtaagcatgagccactgcgcctggccctttcctcaattttccattagcaaagtcatcttttatatgaattactcatttcataatatgtaggatagcaatcagaaacatggtattttcctctatayaaatattttaatttgtaagtaattacactgggagtcatatacttatgcaaataatcttaactggtacggatattcaccatcagacactttcttttcttctcccagccaagatgtgatgaacaggcaatacatctttttgtttgttttttgattcaattatatttatttctgccccaaactttttattttgaacagtttatactctacagagaaattgcaagaattttaataaatacctctctgtccttctcctagcttcaccctttgtttgttgaaaggagatactttagtgcagtattgcaacagcttatgtagacatgcaaccttgaggtcacagacctatgagggattgagacaaaggcaaatttagcaaatattttccagagtactctgctgcaataaccacgtacccaccttcagcaatgacctggtgaacagggagactactgcttagtaacggagcaattctcagctcaaatctggcaggttctaagttttcttgcctctgtggttttgaatggttgctcttactatgtgaaaatggaagacatcatgtcctgttcatgtttaagaattaattgagatttccccaggggcaaatacttcacgatactgctttcctcagtgatatttaatgcacttcctgccctcatccccaattaattaagcattttcctctatacaggagatttatgaagtacttggaattccattaaaaagaggtaatatgtgacttaaatgaatgcataaatacatcaaatataagatatctcagaaatggtttctgtgtgaattttgttatccacaagcaacttgtattattttcatggctacaagaaatttcaatgtggctgcttcccaagctgtttcccaagcaagtaataaatgttgtattactttatttgaatataacaaagctttaatttatgattgcatgtgcttacattgacaccttggcatttcccttcaggcttttctggacatgaaaaagatgagtgaatttggctggatgggtctttctgttctgattcaccagctgcaccccaagcatcagctaactaacttggaaatatattttgttttggtggggaatctatgacaaaatataattagatcagtgataccactgggccaataatgaaaagcaaatgctatgtacaatagtgtcatgtttatttatgaagtgtagtatcattatcccagaatgaataatgaatgaggcatggaacttaggtggttagaacctgtaagaacaatactgtgggcttcatccccaggtgtcctccttatcatcacattatttcacctccttaaattactatttactcacctgaaaaatcagttcataaaatgttctcaccttcattaaaagaacactagtaataattgatttccattaaaagtatccacatatttggggggaaacttgtaattctttattctaaagagtttccaggaactgaaagtaaatacataaacacaagacttggattaaaatgtaaataatatcttttaataagaacccaacaaggcatcttaacttcattatattatgcattctgtagaaagttcaaaaaagatgataagttccttgttttgttttgtttgagatggagtttcacgctgttgcccaggtttgagggcagtggcacaatc

SEQ ID NO: 13267 - DNA, 23672 bp, Homo sapiens
cttaagctagtggttcagcattagtgccttacaaatgttaactgctgttatctcattcatcttttgtaacaactgtgtgctgtgcaacaagggtgacaactggtatgcctgccagagctgggcaggtcacacaaacagacgaagtgggctgccagtgatggggcccaggcaggtgagacagtaagagcccccatttaaaggcattctgctcaacattgttacataataatctatggcatgaaactcacctatggaggcgagagctccttgttgctcttgatgtcaatggaaaaaattgaccatgacctacctggtccttaggtggggttaacagctattctgaaagaagaatgctgatttgacaagaactgggcgtgaagccaaccatgtggtctagaaaggacacaattgcctttaagccaaggcctaagcctatcaagactgagttaatgaggctgccccatcaagccagcggaggtcagccctcaccagccctggctggctctctggctgcagagttgctgagcagggctggagaacagaccaaatggggccagccaagttygcacatcctcagagccacccgctcaagtgtttagctctcctggggtgattgacttcagtgggagcgtggctctgccatgattcagacttctggcctccagaactgtgagagagtgaattcctattgtttcaagccacccagtttgtggtgattaattatggcagccaactaacattcctcttttcctccaatttcataagaacaggtgttgctcttcttgacactcagctgtgtgttctcttggcctcctgctccctgggggagtctccttccattaataaccacctttaacctccctttcagcttcttcccccaaacctgggaagtccctccttccaagccacagctccctctgccccacctccttcccagccttctcatcaagaagcaatctgccttgaccatctctttgacttctcagcctgctggccctgggctcctgctcccaccttcccacccagatcaccctggtggattccatggaccagtgaccatcctcatctacttgaatgttctgctgcatctgacactgacagtgayatcccttgtcctcccttgtttactgccctggtcctcctccttcccagccatcatcacctttgtgagctctctccctctctgctcaggcttatgccgagggtctcagcgttctatgcttcatcctcttctcttgtcctctccttgccccaggacacccctgatcccatgtgcttccttcattttatttcctgtctctgttcttgcctccaaatctctctttagacccattcacctgtgtcatctctgccagcaggcaccacaggcccttcaggctcactaggtccaaaactgaactcatcatcctccatacaggcttccaaaacctacccctcagctcacaccaggtccattctccttccttaatgtgtctcctcctctccagcctcacccccgcttccttggcccacaccaccatcatctctcgcttggattatcacagcagtgtcacttggtcctgtcttgatctccaggtgaccatacccgtgacagcccaagataatttatccctcctttacttacagaatgaagttcaaccctggttcccaacccagcaggacttccaagccctccatctggccctgatctggcttctctctgtcctcccttcctcctctctgatgggctcccggtgccccaycacccccttagcctgtactgctatcactcctgtggttctctcagcccaaaatgcagcctcccactgctgtgctgtaagctattctgtctgttcactcctctccacccagccagggctgataaaaacctagacaaggttcaaaaacccagatccaaggtcaccaccttcacaaagcttttcctattccattcctctctccaaccacgggagaatggaccattcctccctgtgtgtctttattgtggagacatgtgtcagagcatcgactctctatctttagttcatctattgagatattgatctctcttcttgaggccaggggtattttctgggacatggttagatctcaataaacattgatactggagggatgaaatgaaggaaggatggatagaaggctataaggatgggtggatggataaatggatggatggatggatggatggatggatggatggatagatggatggatggaaaaatggatagatggatgggtggatggatgaatggatggatggatggatggatggatggatgaatggatgaatatatgggtggatggatggaaggaaggaaggaaggaaggaaggaaggaaggaaggaaggaaggatggtagaagaaaggtagtaccagtatgctttagctcatgcaggcaaacagatgatgggcagagggaagcatggtggctgattacaggaggatcayagcagatgtttaaggcaagattgacagccccacaaagactgagaagagaagayaagaaaaatgggaaagttattaagacacaagacctagatcaggagctagargctggatcccagaacaaggcaagagcctaatgactcgagtagycaactcatcccagtttgccaaggtctttgccagttttagcactgaatatcccacaccatcggaaattmctcagtcccagcaaattggaatggttggtcaccctactagtaattaagaccagtgccccacttcagagcagaagcatcagccaggccctgagtgacatcttgtaggctcttgaactggtctcactcaatccccatgaggcccartaccatggaacagagggcagggaggctgagggccaagcagaggagcacctgtgctcagcagggcaaggcatcacaggggccaacattggtttccctgcccttctcccagaaaccacctccccactttgatcctttcccatgccctgctaggctctaggacaccaaattctcatattctagccactggccctccctaggcagtcaccctgggtgttatggactgaattgcttctcccgcaaattcttatgttgaagttttagccctcagtgtgactgtagagattgggcttttagggaggtaattaaagttaaataaggttataagggtggcactctaatctgataagattggtgcccttttaagaagaggaagagtaatcagagagctcgctctcttcctctgcccaatccctctcttggggggtgtgtgtgtgtgtatgtgtgtgtgtgtgtgtgtgtgtccagtgtgggctcacagggaagaggtcatgggcgaacagagtgaaggcaaccatctataagtgccagagagccctcaccagagaccaaccctgacggcaccttgaccttggatttccagcgtccagaactgtaagaaaatacatttctattgtttaagacatccagtgtgtgtttaagccaggccagtgtgaggtattttgttacagcagccagagaagactgatacactggggtgccatgcccccgagactccttccaaatctctcctttcaaaacgcaccaccctcastcctgattccttcagagctctttctgcatggcagtgggagtcatgarttacctcagactttcccccaaattctcaagacattccttaagatgtaagcttgggaaacggcatgtgatgtctttccctcgtgggtggtcagagcacagacagcacacacaggctggagacggcccacaggaaaggtgggctaaccacctttcccaaagtagtttcatctggaacccatttgggcggtgttacactagtttctgatggctgctctaagaagttatcacaaacagtggctcagacaacacaaaattcttctttcatggttgaagaggccagaggcctcactgggctagaatgaggatattggcagggctccactctttctggaggctctaggggaggatccattcctttccctctccagcttctagaagcttcctcactccttggcaccyggctccgacatcacattgacttttcccttcctgcttctaccatcacatcaccttcttctgactccaatctcctgcctctttcttgcaaggatccttgtgattgtaattaggacccagctggataatccaygacaatctcttcaagatccttaacttaatcacatctgcaaagtcccttttgtcatagaacgataacattcacaggttctgggtattaggacacggataacttcggggttccattactcacccataactggtatgcagtgctgatttccatcctgtaggtacggtttagggatctctaggtcaatgagataatggactcttgctcatgttacatggcataatgggaagaaagccaaacctagaaaaagagggactcaggttcccttgttagagcctcttcttactaactgtgggattaggggctgattccctgacctgctgtgttctgtcttctctccaattcaatgggaatgaactgtgagggcactgagcaaaaactaaggtctcaatacctagtagtagtgggacttgcctctggatacccagtagtgatcctgccgcctgtttctggatatcctacagtagcaatcccacctgtttctggatatcctacagtagtgatcctgcctgtttctggatatcctacagtagcaatcccgcctgtttctggatatcctacagtagtgatcctgcctgcttctggatacccagaagtgatcatgcctggttctagatacccagtagtgattgtgtttcctctagatacccagtaggtattgtgcttgcttctagagatgtagtagtagctggacttagctctagatacccagtgctcatctctagactgggctgagatcagtgtctcccttgaagggttattgtaaggatgaaaaaagataatgygtttaaagcacttggtgtagtaggtggtctttttaaaagtgtgaataaatactagttcttattatttctgtggatatccaacagccacataattgggccccaaagccatgaagaaggaagaggaaatgtcttaaaggttgtcgatggacagtgtttgctgaacatcaaaatcactttccaggtattacctctgatttgctctaccaactccacaccccacctgcagccacataaccttccatgatcacggccatgcacaacacaccatgtyccccaggcaaggggaccttagaaacataaccaggcttgagacagcactctgcacyggtrtcttggaaatgctcttaagagtgtatggctgagttagggaaccaggatttcaaagtagaaagggagaatctacccaagcccatagaaatcctgaatccactcctttctcagcaacaagcactggcctgggagtcagccacttatgcaccaaccccactctgcccctaattaaatgcatgactttgaaaattcccctcattcttctgagccccaattcagtgattggtgcaatcacaggcttggctacagtgacccattcattgcaggcatggtgagwctctcaatccctctcatttccactagaatctaactgttgggatctatgacccagtcagcatagcaggcctgtggggagctctcaggttcaagcatatgcccccyctaatctacaagaaattagctgcagaaaaccaaggaatagaacctggaaaaagagagggtttgctagagctgtccctttccctgtctctggaatgccaacaatagggaggctctttggtcttgtctctcaggagtgcccatgccattccaggaaaatkatggcccagctggtggygtaaggcttggggggcagcgagtgggcatcgtkgtsaaagcctcgggatcagggagctgcgtctgcaggcaggcctgctggccggaaacctgccaggaaaggaaggggctgtcycggggcggggccagggaggggtggagacagggccggctgtggtcagtgacaaatgctggctgcaatccagccagccctctgccctttctgagcccgagggactgccacctccactgtgtgcacrctcagctacgggacacagtaagtaccratgccgcaamgggaggtccccagggcttgagggcatgtgaggcgaggagaggatggactctagagttttggggtttggggtctgcaaagctctgaaggagtctcatctctgcagtttcaggtatccaaggcagcagaggtgagtgggtcccccgagctctgtgaccttatgctccacactaactctggcagagcctccgtttcctcataggtaagatggaaataattacaccctctggatggtgtgactgaagattaaatacagcgggtgctctcactcagcacatctggccatgtctgcagacacatttggttgccacaactggaaggggggtgggggttagtgacatctagaggccagcgatgctgctgatgatcccacaatgcccaggacaagatcacaaagcatcatcctgttcaaaaggtcaacaggatcaaggttgagagaccctgaaataaggccatggggacaaaatgtcggctggataggaggtgctcagtaagtggcagcttctgttgttttctgtgcctggagtcttgggsctttagaaatcaggaacaatgatccaatattatcggcttccgtgagataagggcatcttgcctggaggctgccacccaggccrgtcatggcagctgctcatgarrgacagtaacaatttggcagtttgttaaatgaacaaaatgtagaaataaagtaagmagaatttttagtttttctgaaggtagggcttttggccagatatgcagcaataaaagagcaaactgcttccttgggccagtgtccttgctcatagatcaggaaaccgaagcwtgaagaatacaggcggcagatgcctgaaggtaacggacgtgttcatggtgctgacggtgatgataagtgacagatgtagactcatctccaaacttgtcaggttatagacattaaatatgtgcaactttatgaatagcagtcatgtctcaatcaagtggttttaataaagaaataataggaagccagagctgagagacagggagggagttgttcaaggtcacctggcaagtgagctccggggcggggagagctcagctctgggtggccagcctggctttttccactgctcagtgtccagcttgcagtctaatgtctctgaattacagagaaggagactggtcagttcattcattcattcattctacaaaggtttatggagcatctctcctgactgcaagctcttgaaggtgagagcagcacaaatgagggtcccwtggagagagaggccggaatgaaaaatgtcaatgacaaatgcatatataaaggcacatgtgtaattgaaagagctttgagagaaagagtcaagggactgttccagagaatagccatggaaggggaaaaggtccagtgtgataagrtattgcaaagaagtgacatttaagcaaaagcctgcagcctatgcagaagttggcctcagtgagaaaggttgggggagggttccagtagagagggaaggtatgcaaaggcccagagttaggacagaacttgctgtgtttgagaaactgggaaaagaagagtgagcctgggggtatcacgtgatccagggcagagcaggtccaggccaggtgcagccaggtcacagcagccctagtgggttagagcacaaatcaaagtttagcatttatctgaaacacaggakttggccatgagtttcttaggcgaggaagcgctgtgaccatatttatgattgaaggagattcttttatatgctgtatatagaaagcctttcagggcaaagaaaggaagctactggggtagccctgggggagatgaagggagcttccactgggggcagtaagaaagccagggaaaggcggcagctttaagacctgttttggagatagaacggacaagctttgctgatgggctggagtggaacaggaagtcaagattacttcttctgggaagttctgttcctgggtctttaggatctagaggaagctgtgactttgtctctcatctctgcctgggctccaagcctcacatccctttttgtaattagaagatattggacagaccgtcctcactaacacaattcccacagctgagtccagggtagaactgggcaggacttcactgcccaacacgggaaatatcagtcagcagatttgggtttcggggatggtggtgggccagcgggaagactgaccagggcctacccatcacatccccaccacctcccacctcaattcaccttggcctgagatgacaggtgaacatgactgatcctctctcttccctctgcagaaacactaaagccagggaccaggagaggggcagcccaaccaagctttcaaagcactcagtagaggctggtctgggggatgggaggctcccagggcttcacctgtctctgtcaaagccatgtatttccaccagaggcccaagagtgcgatggcaaaccctggatttgaaactaagaaacgtaaaacaagcaytgaggactccactgcctcttgagtgacctctctgaccctctgtttcttctgcactgttaggataatgatactaactccatgttgttgtagagaagtataaatgagctaatacaggtgaaccgcctggggataccaggaggtgaggtcgaggaggaacgaggtatcactcctcagagccactcagagasaggctgtgcacgagtcagaggaacctggrttttaattccggttccatyactcagtagctgaaacaagctattccacttcacttagcctcagtctattcaatctgtaaaatagagtgagtttacttttggaaaactctgtaaaatagagagcttacttttggtgaaggtyaaacatagtaatatttatggagtgtctagtatgtctttaataattagtggttttactgaaaagtagagagagttggcccagagggagcaagatttctgggtctcaaacatgtagcccaggagagcctaagtgaacctggrgccctctccaaacagatcctgggggagactcagtgcacacccggagaagcagctcctccccatcggatctctagtgcttggcagggggcrgggtcttgagggggtgtccacaacacatggcagactgcagatgaagaaactgaggcccagagggggtgaggcttgcccagggtgacctagtagctgaatagatgggagaatggaggccagggcctcactgagactctctggtcagctgcccctgggctgtrtccaataaggaaactcccctgcttctgaagctgttctcgaaattatcagctcagtgtgaccctgtggggggttgagccacattgtttctttagmagcatctccatacatggctggttccaacccttggcaggagggaccatattgtgctgtaaaatagactcatttagagaagccggagattaaagcacccacctatgtccttcaaagctctccaggcaagtgccatggtgggaacaggtagggagtgtcagtggggggaagcccagactctgctcactcattatctgcagattagggctattgttggtggctactaagtcagggatttcaaaatcaggaagatgcagccaggaaaagaggaggcaggactctgcagaggaggyaggactctgcagagtcagagtgataaccgagtctgagtccaagctttgccagtgttagcaagcgactccatctctctgaacctcggattacccatctgtaaaatagagctagcagcaagatgtacctttttgggtggtgcagggctgaaggagttggcacagtgcctgaaagagggtgcgggcaatgcgcccaactgctgtggctgctgggtttggtgccrggttcgattctgcaggcagaaacttctacatgagsctccttctcggarggagctcaggrcacaatttggaggctgggctggcaagggtgacctgctggagctattcaacttcacttaaagacaggcctgcagtccaagcctgcccaattcctgagaccattctctctccactgctgagccccacggccactctgcaagggatttcccacccacctgtttggggccctttggagtttggttttaattgggtcacgggatgctgtgacaggctgcccctgcctggtggggatctggggtcactgatgacattgtgcccatggagagagcccagcagaaagggattccctccaaggcgacacacagggcaaagctcacatcagaagccaggcaggccctctgcacctggtaattagccrgccygggtgctgtcaggctcacacgtgtgtgtgtgtgtgtgtgtgtgtgtgtgtaaagcatgtaccctatggtacagttgagaatatggaggcctcagatggggcttttgccagaaactgccatgcctactgctcacacttccatagcacgtgcccccaagcaccccatggtgtaggtgctgttattatcactatcttacagttatggagcagtggctcaaggtgtaactgayttgcccaaaatcacactacaaggacacagcagggctgagatttgaacccaggcagtggcttcagagcctgagctgtttcctactgcagagggaggaggcaagacttctacccgtagccagatggggaggcatgggcacaggaayggctcttgggtgaagyggagggaggaagaggaggactgaaggcsaaggccacrtcaggagtgatgggakaccccacaaaggcctccctgagaagmgctagagacaaagatgagtgcctcctcatctggaagatgaaaagatgtctttgcctgcatgggctgcyrtcacaaagtcccaggggctagggggcttcaacaacagaaatttctttctttacaactctggaagctggaagtctgagattaaggcaccagcaggatwtgttccttccaaggcccctctccttggctcacaggtggctgccttctccctgtcttcacctggtcttccctctgtgcatgtctctatcctgatctcctctttttaatttttgtgtaaggacgtagtcatattgggttggggcccactctagtgacctcattctaactcagtcccctctttaaaagccctatctccagatatagtcacattctggggtattgaaggtaaggacttcagyatatgcattttgggggcacaattcagccagaacaggaggacrgtggggatgtccacatgaagaggttcaggcagaattcctttaggaggggaagatgtctctctgtgggacaagggtggcatggagcagcccctgggggaaggagaaggggacwgtttgcatactggtattctgcctaccccagggtggacactcactcagcgtttgctgaatgaacagggcaaggccagcagtgctgatggtsccaggcatgtagctggtctgagttcatagaaggaccacagcgccctgccatgtgccaaaccaggacaccagagtgaagrccagaagctcacatggaagcagcttagttccctggtaacctcgagatgctgatgagacagagcagagcagagggaaccctctccctccatatcccatcctccaaaatgtgtcccttgatgtggatgggtagacaggattcctgccctggcagccagacccctgccttgggtctgcacctcctctccctccttcctctccccgtcatccctraatcttgtcctcragccactgccaccctgtgtaaaccctcatgyccagtcttgsgggtgccatcccttctctttraagctgaatggaccaaacatacccattgagtgttgggtggggacatctctggaaagtcagcacctggaccagctccacccctctctgaggacaccttctttccctttcagaacaaagaacakccaccatgcagctcttcctcctcttgtgcctggtgcttctcagccctcagggggcctcccttcaccgccaccacccccgggagatgaagaagagagtcgaggacctccatgtaggtgccacggtggcccccagcrgcagaagggactttaccttygacctctacagggycttggcttccgctgcccccagccagaryatcttcttctcccctgtgagcatctccatgagcctggccatgctctccctgggggctgggtccagcacaaagatgcagatcctggaggkcctgggcctcaacctccagaaaagctcagagraggagctgcacagaggctttcagcagctccytcaggaactcaaccagsccagagatggcttccagctgagcctcggcaatgcccttttcaccgacctggtggtagacctgcaggacaccttcgtaagtgccatgaagacgctgtacctggcagacactttcccyaccaactttagggactctgcaggggccatgaagcagatcaatgattatgtggcaaagcaaacgaagggcaagattgtggacttgcttaagaacctmgatagcaatgcggtcgtgatcatggtgaattacatcttctttaaaggtaaggcccttgggcccaaacctgcactttctttggcttttctgctgcttttatctaaagaatacccaattccctcacatacataaaagacggggagtacgttaagttcttttgggtgcctgttgagaaaaattaagtaaacaagcagccagagaaggtaagatgaatgccttcttgctgtggatgggattagtgaggctgagatgctgtttcctccacggaggaagagctggttgctgtcttcgggcccctgrggacatctgaagccccagctttctacaggctctgaagtatgaacccattgtggccaccatggcaaagacaccaacaccttagccactcagggcaggacacagaccccagaagggcttaaagggcatttcccagtcccccgtatccctcagatcttggcccctctgccctcatagaggccaagactccctcagacaaatgcttgttcctctgaaatgcctcctcctgactyctcagcaagagctgacctctgcttatctccccgacactccttgtaagcattcctgctcgcctctgcagctcctgccagttgctgaccctggggaaagcaagagtggatagagaggagaagagaggagaggagagggtgggaagggttgcgaaggaaggtaaattgttaacacctccccttcctatggtcacagatcatgagtatctttggccatttgggtggctataacaaaataccataaactgggtggcttagcaacaacaaacatatatttctcatagttctggaggctgagaagtccakgatcaaggcactggcagatgcagtgcccattccttggttcatagagagtgccttcttagtatatccttgctggaaggaggaaggcagctctctgtggtctcttttgtaaggacaccgatcctgttcatgacagctccacccccatgacctaatcaactcccaaaggccccctgtcctaataccaccaccttgggggttaggtttcaacatatgaacaatgtggggacacaaacattgagaccacagcastgagtgtcgaacttggactctgagatttcctatcccctggtgcagggcagtccccattacaccagattgctgagggcagctgggaaataagctaaggacggtattgactggggtcttccttcgataacgattaagaagttggaaacaggccaggcatggtggctcacgcctataatcccaacattttaggaggccgagatgggcagatcacctgaggtcaggagttcgagatcagcctggccaacatagtgaaaccccgtctctactaaaaaatacagaaattagccaggcatggtggtgggcgcctgtaattccagctacttgggaggctgaggcaggagaatcacttgaacctgggaggtgggggctgtagtgagccaaaattgcgccactgcactccagcatgggtcacagagcgagactccatctcaaaaagaagaaaaaaagaaaaaaaagaaaaaaagaaataaaataaaataaaaagaagttggaaacaatcacttgtagcgttttgttcagaagttcccawaggaaggtcagagaagggtcattgaagacttcccaatgggaaaaaccattcatttccaggatccatactaacttctttctaaaatttaaatcaaaatattgsaatgaaagtgcaaacagagaagttcacccagatatcaggtagcattcacagccagccacatttttcaccctcttcacttggagatttggtcttgagtaaaacgttagagaatcagagaacaycagggrtccagggcctctgaagatgtgaaaaccaacctccttgttttgcaaatgtggaaggaaaagtcccacgaaaagtccaagaatgtgcccaatgttataaagagacttgccttcatattcaagaggttcaacagtcactgctctggggctgccrtaaagatggtctccgctggctatctttactgtcttcactccttttatttgcagctgagaatttctaattctgacacaaaattctttttcatttttcccttttttcatctttagctaagtgggagacaagcttcaaccacaaasgcacccaagagcaagacttctacgtgacctyggagactgtggtgcgggtacccatgatgagccgcgaggatcagtatcactacctcctggaccggaacctctcctgcagggtggtgggggtsccctaccaaggcaatgccacggctttgttcattctccccagtgagggaaagatgcagcaggtggagaatggactgagtgagaaaacgctgaggaagtggcttaagatgttcaaaaagaggtactttcagactaccccagggccagcctaaacccacacagccccagggagacacacacgccctaccagggccacacagcactggtgggaaggactcacccagccaaggagctgcctccaggcccagaggcatcctgtgacatccaagtcctgggggcctagcccagttggagggacaagagctggaaactgggttccttagggtggtgccagagtgggcagagacctctgggcagcccacrtccaagtccagagcaaggggaggctcatcctagaaaagaggccagaggagccataaccaccattgttccttgggttaaggagtccttttttaaaaccatcaaaactaagaatccagtgcattatgaatccaaggggtgaggctcagtgtgccaatgccccagaacagtctaagaaagctccttttccctttccaggcagctcgagctttaccttcccaaattctccattgagggctcctatcagctggagaaagtcctccccagtctggggatcagtaacgtcttcacctcccatgctgatctgtccsgcatcagcaaccactcaaatatccaggtgtctgaggtgggttcagaagctcctatgcatctgcttcccaagrkctattctgttctattctttctaktctactctaccccatttcattccattccattccactcaactccactccactccactccactccagttcactytattcaattccactccactccactccagttcactytattcaattccactccactccactccagttcactctattcagttccactccactccactccactccagttcactctattccattccactccattccactcctccactcctctcatccactccactctactcctccactccacatctccactccactcctccactccactcctccactccactcatccactccactcctccactccactcctccactccactcctccactccactccactcatccactccactcttccattccactccattccaytcctccactccactcttccactccactccattccactcctccactccactccactcyattctattctattccattccattctactctattctattccattccattgcagtcaactccactccactctctactattctattccactcctctcccctccactccattccattgcagtccactccactgcactccactcctttattctrttctrttctattctattctattctattctattctattctattctattctattctattctattctattctctccctctccctctcttttcccacaagtagtgaaagtttcactttgtgtcttatccttcatgtaatgggaagccatatccaccactgttccttgagttaaggagtcctgttttaaacaatcaaaactaagaaggcacttcctagctatgtgrtctccaaaaaayacttgactctctgagcttcctttctctcttctataaaattgaagaattacaccttgctcaaagatgccatgagaattcaatgacagacacatgcgaagtcaccccccagcacagtgcctggggcagagtagctgctccattgttccatttcctacttgctccatggctcagttgaacagatacttagaggttgatgcccataggcagaagctttgccatttgctatgatgacttcacctgcccctrgtggcctggtgatgcctggtgtctcccctgcagatggtgcacaaagctgtggtggaggtggacgagtcgggaaccagagcagcggcagccacggggacaatmttcactttcaggtcrgcccgcctgaactctcagaggctagtgttcaacaggccctttctgatgttcattgtggataacaacatcctcttccttggcaaagtgaaccgcccctgaggtggggcttctcctgaaatctacaggcctcagggtgrgagatgaagggggctawgctatggcccwtctgtatgctggtagctagtgatttacacaggtttagttgactaatgaggyattacaaataatattactctatgatgattgcttccacccacacractgcaacatacaggtgccttggggaaatgtggagaacattcaatcttgccgtcactattcatcartgaagattarcactgagatccagagaggctggatgacttgctcaagttcaccagcatggtagtggcaaagagaggtccagagtcctggcccttgatgcccagctcagtgccacaaagctcartaggagggatgttccagtggatgagggccaccaggaagcacaggtccaaggctggtcccacacttatcagcagcaacaactstcagttcatcctgcatgggaaaaatgttggaatgggagtctgaaatggggctactgtttcagtcctaaygtgctgtgtgacattgggacaacactttccctctctggacctcagtttccctctgtatacaaggatcagattcttgctgtgacccaagaactcctgaaatcatatagaaargctggggtgggccctgtcattcrtggttgatttcaatacactcaagtgccattcatcctttaagaaaaacatctggatatcaaggtggaaatggcccatttaatgattgattatatcattttgtggatatagttataatctgatgggcctggctgggagtggaagaagggaagccttttgcaaatagtagagtrtcagttgcaggtgccaatgrctaactttttgaattctatgttggcattaacaataaagcattttgcaaacactggttataactgtctttatggaggcagctctgggaatggtgacattgatagcttaccatgctccaggccgggtgcctggcccttcacctggatggtcgcatttgcccctcataagactcccatgaagaaaggcaccactrttatcccatctgttattcacagatgggaaaggcaaggcttgaagtggttaggtggcttacccagtcacatatcttctaagtggtgcagccagaatttggcggggggagtgcgaccaagaaccctacactcagtcctgtgctctgtgctrtggaggagagatgaccaggagcagaaacttcattcagggrcatctcaggcaccagctcccccatgagccagctaagttccctccctcccttcaccaagcaccatgtgtttcctcatgtgccraatgaagaggattagatactcaagaatggaatgagtgggtgagtgagtccttcgctgcacccaagtctgattttctgtgcgcctgctcaccccaccctgcatgttctaagcatgcttccataaggctgtgccccaccctctgattctagagtctggactgtatcagaggtgagtgcctactagaggtaacaaggtcaggaccccaaaccttgtccatcccccraagtactgagcccccaccatgcaccagcccatgccagatgctttgcacttgtgatatcacccatcccttgacaacccagcaagttctattattgttcccattttacaggcaataacataagtgctttcccagggtcccacgctggtgacagtgagggcccagggtctgagagcccagatcgcacatgtgcgggctggtggcaggggagatggcagcaaccagactcagacatttctctgcagttgtgctgtgggctcagggtggctctttaygaaggggccccttcrtggggtcatgcactcctgtgtgytttcccttgcatcatgccttgcctgtcttggcaaatatttctctggagtttacccagccagtccaaggtcacagggaagccctgtctgtgtctcacacagaaggtyaacgtccagcactgtccaaactttactcagcaaacagtcacaaagcagctcctgtgtggggggtcaggggtgggctcactgtggtctctgctgcatgtcacacattgaagcactgtgctgggrgtcatcrcaggctgtttaactcaattgtcacatgagcctgggtrcacaaaatggtagagcagctcagagagagatggacagacagcatgaacctctgaggagtcaggttttcttggatgaagggacactaagatggctttggagcgtgagaaggacytcacctagcaaatgtgggaaaggagtgagacctccaggcagagggactggctggagacgagcgtgatgtggtgagccatggagtgtatgggtccccacagaacttcagtctgggcctgcacagggcatgtggaggagacaaggaggagggaggtggccgtgccggcggttcagtgacagagatcctaaatgggaggccaatcctaaatgggatgatctctttcatccyaatttcagggtagtttggtcatccrcgccacattccaagtgtcccctgggccctttctctccctcacccycctgtctgcacatgagtagatgcctccaygcagccctcccaggacgctcacctctatccacagatgcttctccaaaacccaccaggccctcccatggaacgagctcacctacagggtaaaatcaggtcacggtcacatatagcctgactactcccctcaggaccctcattcacagccactgtattaatttgctggggctgccaaaacaaagtgtcctcatctgggaggctgcagtagatttgctgaaattgatttgctagcgttgctgaaattgattcaagcttgattctggagcttgaatcgaagatcaaggcaagtgcagggctggtttccctgaggcctctccccttggtttgcaggtggctctcctctccctatgtcttcacatggtcctcctctgcatgtgcctgagttctaacttcctctcctctcctcatctmcaccagtcttatagaattagggccccccartgacctcattctaacttaataacctctttaaagkctctatctccaaatacagtcacattttgaaatattgagggttaggacttcagtgtatgaattttgggaggaygcaactcagccaggctcactcttatcattacagctgcactagtgccatgcctggttcccagtggacaccccaggaacagccatccatccagagtgatattctgtgacatcccctacactccacagctcatcacatcacactcgtctccagtcggtctgtctgcctggaagtcccacacctgttcccacatccactgtctgggaggtccttttcatgcttcaaagccagctcagtgtcctcctttgtacaaaaaaatgtcctgacctctcagaacttcattctttctctctttctgtcratctttgtctgaactcctctatcattttgtgcacccaggaacgtgtgacaattgagttgaacaggctgcaaaaacgaaaaagaagaaagaaatgctgagttaaacaggctgcaatgacccccagcacggtgcttcaatgcatgaaacgcatcaatgacttgcagcagaggccacactcagcccccctctgccctttgagtttttgcagctcttgccaagatcattcttkttcttagaaagcccaccattattttcctytctagccatatggattctaaaagttcctcttgtgagctgtaatcagaatgcagagaagtaatacaaggttagggcccaggactcyttctcccacctctccctgcagagactcagatttttttaaaaaatgaccttggtcttcrggggaagaacttcccaccacagtgaacagccatgcccagcctacacttgactgtgcggcttacttagctcatccatccaaaggctattcctgggttgcctagtggaaatccaggcatggagctagtgcaagcacaatgataagagtgagcctggcagacactgaccccagcaataatcaggtaaacaaataaacagaactacaaactatgatgacaasaattcatccatccacagatattcactgaatggccactgtgtgcctggcactgttccaagtgctgaagaaaaatgaagaaaacaaaaatccctgcccttatagaggagacattataatgtgacaagataacataatgaaaaagaatgaagaataaaatagaaaagtaaaatggattgcatgtcacttgatgacaagtactgtggaatgaggcygtcatctaaayggagcacagaaagtggaacatggcgacatctcagccaaaagacccggcagacaccatcttggccaagggatcgaggttggcatcgccagctgtgagcagtgctgacatcttattatcttcgatatggcgtcatgagcaggctgcctcctcttggtgggatcttcccccaaacccagaacctcagtctaatcacaagaaaatgacagccaatcccaagttcagggacatttggcaaaatagcccaccactcctacttaaaagtgtcgaggtcttgaaaggcaagraaaccctgggaaatcgtctttggccrgaggaaactmagcagacatgacgactaaatgcaatgtagaatcctcggacagaaaaggacattagtrggacagctggtgaaacccaagtaagtccaggctgtaccaatgtccacttcccagttctgaggaacatgctgtggtctgtccacatttacattaggagaagcagggagagcgtatatgggacytctctgtattgtttttataacttttctgtaaatccaaaactgtcttaaaatagtttttttaaattatactttaagttmtggggtacaggtgcagaatatgcaggtttgttacataggtatacatgtaccatggtggtttgctgcaccccctttttttaagaaaatgtttcaaaaagaaaaacagccaagtaggggagggcacacgagtggggttgggaattgcaaaggcagaagcaggagaccagttaaggaagaaaacggggcactaagagagacaatcaggaggacctgctgcagccagggccctgaggggctccctgaggtggtgccattgaagcggagttctgagggacaatcaggtgtagacactgtgagtctcagaagtgggaaaaggggagtgctgtgcacaaaattgagagacggtgcctgtggcagcagctgaggagggaaagagaaggtggggtgggaggcccatcccttccttggccacaaggacactgagtagggtgctgagatgggagtaacagtaataataacaggcagcacttggaggctgcgtcccgtgtgtctggcactcgcctaagccctttgtgcacattggctgagttaatgcagaggtgaactgagaggcacctggggtaggggctgggggacaggaagcaggtgacatctccagtcctctccagcgtccttagagcaggtctacagtactgatccttctctgccacccttctccaagaccaccttggtgggagtaaggggctctaaggtgacaacacacacaggagccacagacacaagacacaagacacttttgactcccaggagaacctagtatgggcawccacacacccttcctgatggtgaytttttatgtagacatgcagagtgcagttaaccagctgttcctgcacacatctggattgctactcacacatctgtgcacacacacacacagcctcctggagcactgtggcttctgggtggctaacacagctaccacctctggttgtgctgagctgagcacccattgcctgctggggtggggagagggcaggcactttccctgcgcgaccccgtttaaccctctctgccccactgatgtggtccctgttgtccccgatgcacagaggaagaayctgtgtcaggacccccagagcggtgtctccactaagcagaagtctctgtttctctcctggcctctcccagaggggctgctctgaagcatgtggatttgatcaggataatcaaggtaaatgatccttatcttgatccatcacaaatgttaaggtacaaggctgtggagatggagagtgggtggagtctctgctgcccggtatcctaagctgggtgatcgcaagcagacacacacatgaccacctcttgggccatgcagggggaatgaatgtaatgaggccgatgttacagggttattgaaggctcaggggagaccaggccaaaaaaaaaaaaaaaaaaaaagctatgacctgagacctccctatagcagtgtttctcaaactctgattaacgttacttgaggagcttgttaaaaatacatactcctggccctgatcagataaatcagaatatttgacacagagtctttaagctccccctcgggattcaaatgcacacagatttttggtgctttgccgcctacagtacaagagagggcaggactgtcctgttcagtgcactgtgaccyggacgctcaggcccacggaactcccctactccccctgctccctgcggtgccacccacctagctttcrtgcctgagggtggtcctcagactcctcctagaacaggcccagaggctcttagctatgtaagtattcattcctccaatcactgcagagcactcaccaggtaacaagcacgcacacccaggcgagttccccatgctcgtccccacgttgatatctcagactctacaagtcttcagctgctgcctaggactctgtaagtccttgagcttgggacccctaccacacacaagcgctgggcgtgccccacaggcggggaagtgctggccatatacacccagtgaagtgggaattccagataatgagtaactttttagcaaagtacccatgccctttgaattgtgaggtgtttttgtttgctaaatctgacaattctacctgtagggaaca

SEQ ID NO: 13268 - DNA, 25871 bp, Homo sapiens
  misc_feature (1)...(25871): n = A,T,C or G, or insertion/deletion polymorphism (see Tables 1-2)
ccagcttctttacttcaacctgttttattggcaagctctttatgaccttgtgctgacctcctaactcatcctgtgacttagaatctcttaacaatctgggaatgtatcccagtaagtctcagcctcattctaaccagtccctattcaagatggagtcactcttattcaaatacctttgacattatgaagtgtcttctctatgctggtcctctctgtgtactcatttatttcatcttagcaaccaactctaagacctcggaactataaactccacttacacatatggacagtaaagccataaggagttaagtaacttgtccacagtaaactgagcctagctctaactctcccaaatctcataatcttgccatagtctacactatttcrggtggtgtcagggccatcattttttccagagcccttaaaataaggaaggagacccccaaaagtcttatgtggggatgttagtgtgtgtatgcacatgtgtgcaaactgtttgtcttcagcaccctaagtgccttgycctgccctccctggtaaacctgagggctccatcccaagagagcagggcacttctccaagtgtgtcctcagctccctgaatcccatccacacagcttccagtacctgagcctaagtcgcttcacagrgtcttccctatctgcttcccacgtagccccgctggagaacagaggtagagggaagagggcagagaagtccagaacacacacgtcctcattgtttgctaggagggctgatgttgacccagcttgtgtttgcccttcttgcccaatgctctctgagggggagagccaaacaccaggtcctgagaaccagtttaagtagaatggaaatcattgatttttcactaaattcctgaaacaacgttgttttttgttcccagtcatttcactgaattaaatttctatttgtctgccatcagaacaacaggcacacagtcccaagggtgaaagagtaaggaaatactatttattcaaccaggcactttctgtaatcctcactgcagccccaccatgtcaggactatcatctccattccacagataaargagatgaagtcgctggctctgggttcttggtggttaatggcagatctgggatttgaactatgtccaacttcttttccacttaattcctggaatccttccaagacagcaaggaaaggggaaggagggaagagaaaaaaaaagcaaggagtggagagaaaagggtttttttttaatacagtttatcatactctacaaatagccattccacccaaaagaaatgaaaatacaaagacttctacatgaatgctcttagaagcttcacccataacagaccaaagtggaagccacccagacatccgtcaataaatgggctaattgtggtccgcccacacaatgatgatggaataggactcagcaagaagcataagcgcactgctgatattggtgacaacatagatcaatctcagaaacatgatgttgaactaaagaagacagacacaaaaacatargtagtgtattatcccatttacatgctcttctagaaggggaaaaaccagtctatggagacagaagtcagaacagaagttaccttcgggaggcattgatagaaagaggactttgtggatgggagaatttgctctgtcttgctcagaatggyggttacacagatgcacacacatgtaaaaatgtatygagctgtgtatttaggagttacagttttactacatgcaaataacacgtccataaaaagtaaatcgataaagacagggaagggatggtggcacaggggagatgcggagaggctggaggattcaagagaggctttatagtgtcatcttatatattctcttcaatcctaacgtgcaaagtaggtataataaaaccttccttgcagagctgctggggaaatgaacgtttgtgagcacaaatttctgacagaggccttggcatctggtaaccaatcagcaaatgggttgctttggctgggattctgctgatgagctcaggaggggccacaaggagaatggaaagagggacggcaggggcatgatgcaacctccttcctcatcggtggatttcatcatgacagctcagtccttgctctgttgtcctcccacggactgtttcccttttctcatggggcagacagaggaggcgggtggaaaagcagcttgggtggtggtggaagcccaggcttggcactgggttctaggtcctggctgggaggctttggcagcctgctaacctctccctcctcagtgttagactccagcttgaatagtaaagcaactgggtttgttttgttttgttttacctaagaagttgcacgcctcacacaaatttttagcatatgcgaggttttcacactttcaccctggcaagacacctcagccatctgattaaagaaatgctccatttccatgacccttgattaactcagttcatgaagcaacctttgatcacctattctgtgctcagtacaaagccacagagatggaaaaaacacagtccctgccctccrgttacttgcagcctggtgatgccaccgagctttggggtcatgcgcctcacagcctggttagaatctgccctccaccacttgccagctctgtgacccagggctaggtgctcgacgtctatgaacctcagtttcctcatctgtaaaatgggatracagaaatatcgacttcataggcttgatgtgaggacgaggagttaatctgtaaccaatgcttggaatggctctggcatgagccacgtgctcactgttacctattatgctaatgttacaaagggatgtgtaggaagtgttggggaagcagcaagcagggagaaagagaggaagggagagagggaggtacctgtttcagcatcagggtaacactctgcctcagtttcctcatctgttctaaggcagtaacagtggtactcactgcacaggatagagtgaggtgatgcatgtgaagtgtttaagacagggcctggcagaggccacatgtgcaaggagtctcagccgcgattcagggggtggcacaccaccgctggagtatttggagatttatattataaaatttcggaagcaagaggcctgttaaaaccaagcaaatagaaatgctcaaaatcaacatgaaggagtcaacagggtaaatcgaacaatttgaagccaaggtcggagttgggcaaattaagagccctattgctctctgttatctaagccacccacgcagggcatgtatttctgaataataagccctcaagtcctgctgggtctcccatagtccccacgcaagggtgagtcttgcacgctcagccctgcctgtggttcccagaaggcctctgtcactgcgtgcttgctttctctcccagggaagataccccagtgccatgtcttggggcaagagaaaatgaagacagacctggaacatgaacatggtggccttgccagaaagcaagtgtgtgttgctgaaacatcagcagagattgtcaaagggataaagagataacttaaaagggttcctattgaccaaaatgcgacaagttgaccatctaaaatcaaatcataattatagttcaataggacacattgagtctcttaaaagcttccaatccgtaatgaccatcaaggcccataacctcaaaagagtaaagttaaaataaagttcagaaaaggttagctgcaataaaacatgagttttagtaattttaacaagaaggggatgaagctatagatgcatttttattccttcttttaactatgttgccccttataatgtatagctttgccttatttttctctgtctgagtaaggataaagagtaaaggccaggcacagtggctcacacctgtaattccagcactttgggaggccgaggcgggcagataacttgaggccaggagtttgagaccagcctggccaacatgstgaaaccctgtcactactaaaaatacaaaaattaactggaattggtagcacatgcctgtaatgccagctactctggaggctgaggcacgagaatcgctcgtaattccagaattcgagaggtggagtttgcagtaagccaagattgcgccactgtactccagcctgggtgactgagtgagactctgtctcaaaaaaaaaaaaaaaaagaagaagctrtgagtaggccacatagttccagaaaatgcagaaatcccccctcccctccccaacacacaggaagtggctcaggagattacacacagaaggaaagtgtgtctgctggggttttgcaagttggctaatttgaaaggtgactggaggaggtgaamaaatggtgcaaacttcattcattcattaaatgagttataagaagacagacacaagtgtccattatgctaacagagctctgtgttaaacaccccaccagcatcgcctcatctaagcctcagaagagctatgtgggaaagaaacttttatccctattttatagatgaggaaaccaaggctcagagaactgagggcctcccccggatccaagtccrcctagctgcagtcaccccacatcctctgcatgtcacaggtgctcagaaagatgctgaaggcacctggcccttcaccttcggaaagccaaaatgagcacggcccctaaagaggggattgacagcctttttctggaaaaaatggaagtttgaatctgaggaggtgtccctcaacaacaggtgctgctccccaaatctggggccaaacgcagcagttgttcccccacttagacccctgagacccatctatatggtttttcagagccaggacacatccccaaaggtcatggcctttggtggttagcattgacttggggcccatcacatgccagaggctgcccgaagtgcttaartgttattatctcattcgatcttcacagtcctgatggaagtgactcttcttagagtcttcctatctcacagatgaggaaaccgaggcacagagaggttaagtggcttgtctaagagctcacaaaaagagcgatggagctaaggcttggccccagatattagatcccgaacccacgccttaaccagtgacctgcactgactctcaaagaaggaagctggtgcctgggaaggagggtgcatagtgagggtgtgcatggggtgtgtgtgtttgtggggtggccagcactctccgggggcactttgccaatgagttcagctcccatgaagtccactgttgttctcctgaccagccactcagtcttgatttacttggcccagggccactggcacacctcacccccttacccgattycttgctgcagaccccaaatctcgactctcacatccctatccagcccataccacsaggctcccatctccaggcagggccctgtggtggggcagggcctcccccagatgccccttactcatgaccagctcacaggatcttcccatgatgcatttcctctggggggatcagcccagatgctgcaatagacaattgtggaagtaaccaggtggacaagactttccccctcatgtcctggggttcctgggggcacagtatccttgtgaatggccactgagtactcccacccctcccaccacaacccccgggattttgtcctggtgcgtttttccagattatcctagcccttcctcccaggatggatgtccagagcagggcgggggctgagcctagagccctgccaaaagagcaggaccccaaattctgagccccttacttgcctcacctgctcccacccatgctttcttcattcctcctccaaaagccccagctccccactgcaatcccttctgcacccagccaggtcctatgacacacacctccccagtgcacacagacctgcccaactgtggggctgcccrctgggcatttcataggtggctcagtcctcttccctctgcagctggccccagaaacctgccagttattggtgccaggtctgtgccaggagggcgaggcctgtcatttctagtaatcctctgggcagtgtgactgtacctcttgcggcaactcaaagggagagggtgacttgtcccgggtcacagagctgaaagggcaggtacaacaggtgacatgccgggctgtctgagtttatgagggcccagtcttgtgtctgccgggcaatgagcaaggctccttcctgtccaagctccccgcccctccccagcctactgcctccacccgaagtctacttcctgggtgggcaggaactgggcactstgcccagggcatgcactgcctccacgcagcaaccctcagagtcctgagctgaaccaagaaggaggagggggtcgggcctccgaggaaggcctagcygctgctgctgccaggaattccaggttggaggggcggcaacctcctgccagccttcaggccactctcctgtgcctgccagaagagacagagcttgaggagagcttgaggagagcaggaaaggtggracattgctgctgctgctcactcagttccacaggtgggaggracagcagggcttagagtgggggtcattgtgcagatgggaaaacaaaggcccagagaggggaagaaatgccyaggagctaccgagggcaggcgacctcaaccacagcccagygctggagctgtgagtggatgtagagcagcggaatatccattcagccagctcaggggaaggacaggggccctgaagccaggggatggagctgcagggaagggagctcagagagaaggggaggggagtctgagctcagtttcccgctgcctgaaaggagggtggtacctactcccttcacagggtaactgaatgagagactgcctggaggaaagctcttcaagtgtggcccaccccaccccagtgacaccagcccctgacacgggggagggagggcagcatcaggaggggctttctgggcacacccagtacccgtctctgagctttccttgaactgttgcattttaatcctcacagcagctcaacaaggtacatacmgtcaccatccccattttacagatagggaaattgaggctcggagcggttaaacaactcacctgaggcctcacagccagtaagtgggttccctggtctgaatgtgtgtgctggaggatcctgtgggtcactcgcctggtagagccccaaggtggaggcataaatgggactggtgaatgacagaaggggcaaaaatgcactcatccattcactctgcaagtatctacggcacgtaygccagctcccaagcaggtttgcgggttgcacagcgggcgatgcaatctgatttaggcttttaaagggattgcaatcaagtggggccccactagcctcaaccctgtacctcccctcccctccacccccagcagtctccaaaggcctccaacaaccccagagtgggggccatgtatccaaagaaactccaagctgtatayggatcacactggttttccaggagcaaaaacagaaacaggcctgaggctggtcaaaattgaacctcctcctgctctgagcagcctrgggggcagactaagcagagggctgtgcagacccacataaagagcctactgtgtgccaggcacttcacccgaggcacttcacaagcatgcttgggaatgaaacttccaactctttgggatgcaggtgaaacagttcctggttcagagaggtgaagcggcctgcctgaggcagcacagctcttctttacagatgtgcttccccacctctaccctgtctcacggccccccatgccagcctgacggttgtgtctgcctcagtcatgctccatttttccatcgggaccatcaagagggtgtttgtgtctaaggctgactgggtaactttggatgagcggtctctccgctcygagcctgtttcctcatctgtcaaaygggctctaacccactctgatctcccagggcggcagtaagtcttcagcatcaggcattttggggtgactcagtaaatggtagatcttgctaccagtggaacagccactaaggattctgcagtgagagcagagggccagctaagtggtactctcccagagactgtstgactcacgccaccccctccaccttggacacaggacgctgtggtttctgagccaggtacaatgactcctttcggtaagtgcagtggaagctgtacactgcccaggcaaagcgtccgggcagcgtaggcgggcgactcagatcccagccagtggacttagcccctgtttgctcctccgataactggggtgaccttggttaatattcaccagcagcctcccccgttgcccctctggatccactgcttaaatacggacgaggacagggccctgtctcctcagcttcaggcaccaccactgacctgggacagtgaatcgtaagtatgcctttcactgygagrggttctggagaggcttcygarctccccatggcccaggcaggcagcaggtctggggcaggaggggggttgtggagtgggtatccgcctgctgaggtgcagggcagatggagaggctgcagctgagctcctattttcataataacagcagccatgagggttgtgtcctgtttcccagtcctgcccggtcccccctcggtacctcctggtggatacactggttcctgtaagcagaagtggatgagggtgtctaggtctgyagtcctggcaccccaggatgggggacaccagccaagatacagcaacagcaacaaagcgcagccatttctytctgtttgcacagctcctctgtctgtcgggggctcctgtctgttgtctcctataagcctcaccacctctcctactgcttgggcatgcatctttctccccttctatagatgaggaggttaaggtycagagaggggtggggaggaacgccggctcacattctccatcccctccagatatgaccaggaacagacctgtgccaggcctcagccttacatcaaaatgggcctccccatgcaccgtggacctctgggccctcctgtcccagtggaggacaggaagctrtgaggggcactgtcacccagggctcaagctggcattcctgaataatcgctctgcaccaggccacggctaagctcagtgcgtgattaagcctcataaccctccaaggcagttactagtgtgattcccattttacagatgaggaagatggggacagagaggtgaataactggccccaaatcacacaccatccataattcgggctcaggcacctggctccagtccyyaaactcttgaacctggccctagtgtcactgtttctcttgggtctcaggcgctggatggggaacaggaaacctggrctgracttgaggcytctctgatgctcggtgacttcagacagttgctcaacctctctgttctcttgggcaaaacatgataacctttgacttctgtcccctcycctcaccccacccgaccttgatctctgaagtgttggaaggatttaatttttcctgcactgagttttggagacaggtcaaaaagatgaccaaggccaaggtggccagtttcctatagaacgcctctaaaagacctgcagcaatagcagcaagaactggtattctcgagaacttgctgcgcagcagkcacttcttggcattttatgtgtatttaatttcacaatagctctatgacaaagtccacctttctcatctccaggaaactgaggttcagagaggttaagtaacttgtccaaggtcacacagctaatagcaagttgacgtggagcaatctggcctcagagcctttaattttagccacagactgaygctcccctcttcatttagccaggctgcctctgaagttttctgattcaagacttctggcttcagctttgtacacagagatgattcaatgtcaggttttggagygaaatctgtttaatcccagacaaaacatttaggattacatctcagttttgtaagcaagtagctctgtgatttttagtgagttatttaatgctctttggggctcaatttttctatctataaaatagggctaataatttgcaccttatagggtaagctttgaggacagattagatgatacggtgcctgtaaaacaccaggtgttagtaagtgtggcaatgatggtgacgctgaggctgatgtttgcttagcatagggttaggcagctggcaggcagtaaacagttggataatttaatggaaaatttgccaaactcagatgctgttcactgctgagcaggagccccttcctgctgaaatggtcctggggagtgcagcaggctctccgggaagaaatctaccatctctcgggcaggagctcaacctgtgtgcaggtacagggagggcttcctcacctggtgcccactcatgcattacgtcagttattcctcatccctgtccaaaggattcttttctccattgtacagctatgaagctagtgctcaaagaagtgaagtcatttaccccaggccccctgccagtaagtgacagggcctggtcacacttgggtttatttattgcccagttcaacaggttgtttgaccataggcgagattctcttccctgcaccctgccgggttgctcttggtcccttattttatgctccyrggtagaaatggtgygagattaggcagggagtgrctcgcttccctgtccctggccccgcaaagagtgctcccacctgccccgatcccagaaatgtcaccatgaagccttcattcttttggtttaaagcttggcctcagtgtccgtacaccatggggtmcttggccagatggcgactttctcctctccagtcgccctcccaggcactagcttttaggagtgcagggtgctgcctctgatagaarggccaggagagagcaggttttggagwcctgatgttataaggaacagcttgggaggcataatgaayccaacatgatgcttgagaccaatgtcacagcccaattctgacattcatcatctgagatctgaggacacagctgtctcagttcatgatctgagtgctgggaaagccaagacttgttccagctttgtcactgacttgctgtatagcctcaacaaggccctgaccctctctgggcttcaaactcttcactgtgaaaggaggaaaccagagtaggtgatgtgacaccaggaaagatggatgggtgtgggggaatgtgctcctcccagctgtcaccccctcgccaccctccctgcaccagcctctccacctcctttgagcccagaattcccctgtctaggagggcacctgtctcrtgcctagccatgggaattctccatctgttttgctacattgaacccagatgccattctaaccaagaatcctggctgggtgcaggggctctcgcctgtaaccccagcactttgggaggccaaggcaggcggatcaagaggtcaggagttcaagacctgcctggccaacacggtgaaacctcagctctactaaaaatacaaaaattagccaggcgtggtggcacacgcctgtaatcccagctatttgggaagctgagacagaagaatttcttgaacccgggaggtggaggtttcagtgagccgagatcacgccactgcactccaccctggcrgataaagcgagactctgtctcaaaaaaaacccaaaaacctatgttagtgtacagagggccccagtgaagtcttctcccagccccactttgcacaactggggagagtgaggccccaggaccagaggattcttgctaaaggccaagtggatagtgatggccctgccagggctagaagccacaacctctggccctgaggccactcagcatatttagtgtccccaccctgcagaggcccaactccctcctgaccactgagccctgtaatgatgggggaatttccataagccatgaaggactgcacaaagttcagttgggaagtgaaagagaaattaaagggagatggaaatatacagcactaattttagcaccgtcttyagttctaacaacactagctagctgaagaaaaatacaaacatgtattatgtaatgtgtggtctgttccatttggattacttagaggcacgagggccaggagaaaggtggtggagagaaaccagctttgcacttcatttgttgctttattggaaggaaacttttaaaagtccaagggggttgaagaatctcaatatttgttatttccagctttttttctccagtttttcatttcccaaattcaaggacacctttttctttgtattttgttaagatgatggttttggttttgtgactagtagttaacaatgtggctgccgggcatattctcctcagctaggacctcagttttcccatctgtgaagacggcaggttctacctagggggctgcaggcwggtggtccgaagcctgggcatatctggagtagaaggatcactgtggggcagggcaggttctgtgttgctgtggatgacgttgactttgaccattgctcggcagagcctgctctcgctggttcagccacaggccccaccactccctattgtctcagccccgggtatgaaacatgtattcctcactggcctatcacctgaagcctttgaatttgcaacacctgccaacccctccctcaaaagagttgccctctcagatccttttgatgtaaggtttggtgttgagacttatttcactaaattctcatacataaacatcactttaygtatgaggcaaaatgaggaccagggagatgaatgacttgtcctggctcatacacctggaaagtgacagagtcagattagatccyaggtctatctgaagttaaaagaggtgtcttttcacttcccacctcctccatctactttaaagcagcacaaacccctgctttcaaggagagatgagcgtctctaaagcccctgacagcaagagcccagaactgggacaccattagtgacccagacggcaggtaagctgactgcaggagcatcagcctattcttgtgtctgggaccacagagcattgtggggacagccccgtctcttgggaaaaaaaccctaagggctgaggatccttgtgagtgttgggtgggaacagctcccaggaggtttaatcacagcccctccatgctctctagctgttgccattgtgcaagatgcatttcccttctgtgcagcagtttccctggccactaaatagtgggattagatagaagccctccaagggcttccagcttgacatgattcttgattctgatctgrcccgattcctggataatcgtgggcaggcccattcctcttcttgtgcctcattttcttcttttgtaaaacaatggctgtaccatttgcatcttagggtcattgcagatgwaagtgttgctgtccagagcctgggtgcaggacctagatgtaggattctggttctgctacttcctcagtgacattgaatagctgacctnatctctctggctttggtttcttcatctgtaaaagaaggatattagcattagcacctcacgggattgttacaagaaagcaatgaattaacacatgtgagcacggagaacagtgyttggcatatggtaagcactacgtacattttgctattcttctgattctttcagtgttactgatgtcggcaagtacttggcacaggctggtttaataatccctaggcayttycacgtggtgtcaatccctgatcactgggagtcatcatgtgccttgactcggggcctggcccccccatctctgtcttgcaggacaatgccgtcttctgtctygtggggcatcctcctgctggcaggcctgtgctgcctggtccctgtctccctggctgaggatccccagggagatgctgcccagaagacagatacatccmaccatgatcaggatcacccaaccttcaacaagatcacccccaacctggctgagttcgccttcagcctatacygccagcyggcacaccagtccaacagcaccaatatcttcttctycccagtgagcatcgctacagcctttgcaatgctctccctggrgaycaaggctgacactcacgatgaaatcctggagggcctgaatttcaacctcayggagattccggaggctcagawccatgaaggcttccaggaactcctccrtaccctcaaccagccagacagccagctccagctgaccaccrgcaatggcytgttcctcagcgagggcctgaagctagtggataagtttttggaggatgttaaaaagttgtaccactcagaagccttcactgtcaacttcrgggacaccgaagaggccaagaaacagatcaacgattasgtggagaagggtactcaagggaaaattgtggatttggtcaaggagcttgacagagacacagtttttgctctggtgaattacatcttctttaaaggtaaggttgctcaaccagcctgagctgttcccatagaaacaagcaaaaatattctcaaaccatcagttcttgaactctccttggcaatgcattatgggccatagcaatgcttttcagcgtggattcttcagttttctacacacaaacactaaaatgttttccatcattgagtaatttgaggaaataatagattaaactgtcaaaactactgacagctctgcagaacttttcagagcctttaatgtccttgtgtatactgtatatgtagaatatataatgcttagaactatagaacaaattgtaatacactgcataaagggatagtttcatggaacatactttacacgactctagtgtcccagaatcagtatcagttttgcartctgaaagacctgggttcaaatcctgcctctaacacaattagcttttgacaaaaacaatgcattctacctctttgaggtgcyaatttctcatcttagcatggacaaaataccattcttgctgtcaggtttttttaggattaaacaaatgacaaagactgtggggatggtgtgtggcatacagcaggtgatggactcttctgtatctcaggctgccttcctgcccctgaggggttaaaatgccagggtcctgggggccccagggcattctaagcyagctcccactgtcccaggaaaacagcataggggaggggaggtgggaggcaaggccaggggctgcttcctccactctgaggctcccttgctcttgaggcaaaggagggcagtggagagcagccaggctgcagtcagcacagctaaagtcctggctctgctgtggccttaskgggggcccaggtccctctccagccccagtctcctccttctgtccaatgagaaagctgggatcaggggtccctgaggcccctgtccactctgcatgcctcgatggtgaagctctgttggtatggcagaggggaggctgctcaggcatctgcatttcccctgccaatctagaggatgaggaaagctctcaggaatagtaagcagaatgtttgccctggatgaataactgagctgccaattaacaaggggcagggagccttagacagaaggtaccaaatatgcctgatgctccaacattttatttgtaatatccaagacaccctcaaataaacatrtgattccaataaaaatgcacagccacgatggcatctcttagcctgacatcgccacgatgtagaaattctgcatcttcctctagttttgaattatccccacacaatctttttcggcagcttggatggtcagtttcagcaccttttacagatgatgaagctgagcctcgagggatgtgtgtcgtcaagggggctcagggcttctcagggaggggactcatggtttctttattctgctacactcttccaaaccttcactcacccctggkgatgcccaccttcccctctctccaggcaaatgggagagaccctttgaagtcaaggacaccgaggaagaggacttccacgtggaccaggygaccaccgtgwaggtgcctatgatgaagygtttaggcatgtttaacatccagcactgkaagaarctgtccagctgggtgctgctgatgaaatacctgggcaatgccacygccatcttcttcctgcctgwygaggggaaactacagcacctggwaaatgaactcacccacgatatcatcaccaagttcctggaaaatgaagacagaaggtgattccccaacctgagggtgaccaagaagctgcccacacctcttagccatgttgggactgaggcccatcaggactggccagagggctgaggagggtgaaccccacatccctgggtcactgctactctgtataaacttggcttccagaatgaggccaccactgagttcaggcagcgccrtccatgctccatgaggagracagtacccaggggtgaggaggtaaaggtctcgtccctgggracttcccactccagtgtggacacygtcccttcccaatatccagtgcccarggcagggacagcagcaccaccacaygttctggcagaaccaaaaaggaacagatgggcttcctggcaaaggcagcagtggagtgtggagttcaagggtagaatgtccctggggggacgggggaagagcctgtgtggcaaggcccagaaaagcaaggttcggaattggaacagccaggccatgttcgcagaaggcttgcgtttctctgtcactttatcggtgctgttagattgggtgtcctgtagtaagtgatacttaaacatgagccacacattagtgtatgtgtgtgcattcgtgattatgcccatgccctgctgatctagttcgttttgtacactgtaaaaccaagatgaaaatacaaaaggtgtcgggttcataataggaatcgaggctggaatttctctgttccatgccagcacctcctgaggtctctgctccaggggttgagaaagaacaaagaggctgagagggtaacggatcagagagcccagagccaagctgcccgctcacaccagaccctgctcagggtggcattgtctccccatggaaaaccagagaggagcactcagcctggtgtggtcactcttctcttatccactaaayggttgtcactgggcactgccaccagccccgtgtttctctgggtgtagggccctggggatgttacaggctgggggccaggtgacccaacactacagggcaagatgagacaggcttccaggacacctagaatatcagaggaggtggcatttcaagcttttgtgattcattcgatgttaacattctttgactcaatgtagaagagctaaaagtagaacaaaccaaagccgagttcccatcttagtgtgggtggaggacacaggagtaagtggcagaaataatcagaaaagaaaacacttgcactgtggtgggtcccagaagaacaagaggaatgctgtgccatgccttgaatttcttttctgcacgacaggtctgccagcttacatttacccaaactgtccattactggaacctatgatctgaagwgcgtcctgggtcaactgggcatcactaaggtcttcagcaatggggctgacctctccggggtcacagaggaggcacccctgaagctctccaaggtgagatcaccctgacgaccttgttgcaccmtggtatctgtagggaagaatgtgtgggggctgcagcwctgtcctgaggctgaggaaggggccgagggaaacaaatgaagacccaggctgagctcctgaagatgcccgtgattcactgacacgggacgtggtcaaacagcaaagccaggcaggggactgctgtgcagctggcactttcggggcctcccttgaggttgtgtcactgaccctgaatttcaactttgcccaagaccttctagacattgggccttgatttatccatactgacacagaaaggtttgggctaagttgtttcaaaggaatttctgactccttcgatctgtgagatttggtgtctgaattaatgaatgatttcagctaaagatgacacttattttggaaaactaaaggcgaccaatgaacaactgcagttccatgaatggctgcattatcttggggtctgggcactgtgaaggtcactgccagggtccgtgtcctcaaggagcttcaagccgtgtactagaaaggagagagccctggaggcagacgtggagtgacgatgctcttccctgttctgagttgtgggtgcacctgagcagggggagaggcgcttgtcaggaagatggacagaggggagccagccccatcagccaaagccttgaggaggagcaaggcctatgtgacagggagggagaggatgtgcagggccagggccgtccagggggagtgagcgcttcctgggaggtgtccacgtgagccttgctcgaggcctgggatcagccttacaacgtgtctctgcttctctcccctccaggccgtscataagrctgtgctkacsatcgacgagaargggactgaagctgctkgggccatgtttttagaggccatacccakgtctatccccyccgaggtcaagttcaacaaayyctttgtcttyttaatgattgamcaaaataccaagtctcccctcttcatgggaaaagtggtgaatcmcmcccaaaaataactkcctytcgctcctcaacccctcccctccatccctggccccctccctggatgacattaaagaagggttgagctggtccytgcctgcatgtgactgtaaatccctcccatgttttctctgagtctccctttgcctgctgaggctgtatgtgggctccaggtaacagtgctgtcttcgggccccctgaactgtgttcatggagcatctggctgggtaggcacatrctgggcttgaatccaggggggactgaatcctcagcttacggacctgggcccatctgtttctggagggctccagtcttccttgtcctgtcttkgagtccccaagaaggaatcacaggggaggaaccagataccagccatgaccccaggctccaccaagcatcttcatgtccccctgctcatcccccactcccccccacccagagttgctcatcctgccagggctggctgtgcccaccccaaggctgccctcctggggrccccagaactgcctgatcgtgccgtggcccagttttgtggcatctgcagcaacacaagagagaggacaatgtcctcctcttgacccgctgtcacctaaccagactcgggccctgcacctctcaggcacttctggaaaatgactgaggcagattcttcctgaagcccattctccatggggcaacaaggacacctattctgtccttgtccttccatcgctgccccagaaagcctcacatatctccgtttagaatcaggtcccttctccccagatgaagaggagggtctctgctttgttttctctatctcctcctcagacttgaccaggcccagcaggccccagaagaccattaccctatatcccttctcctcccyagtcacatggccataggcctgctgatggctcaggaaggccattgcaaggactcctcagctatgggagaggaagcacatcacccattgacccccgcaacccctccctttcctccyctgagtcccgactggggccacatgcagcctgacttctttgtgcctgttgctgtccctgcagtcttcagagggccaccgcagctccagtgccacggcagraggctgttcctgaatagcccctgtggtaagggccaggagagtccttccatcctccaaggccctgctaaaggacacagcagccaggaagtcccctgggcccctagctgaaggacagcctgctccctccgtctctaccaggaatggccttgtcctrtggaaggcactgccccatcccaaactaatctaggaatcactgtctaaccactcactgtcatgaatrtgtacttaaaggatgaggttgagtcataccaaatagtgatttcsatagttcaaaatggtgaaattagcaattctacatgattcagtctaatcaatggataccgactgtttcccacacaagtctcctgttctcttaagcttactcactgacagcctttcactctccacaaatacattaaagatatggccatcaccaagccccctaggatgacaccagacctgagagtctgaagacctggatccaagttctgacttttccccctgacagctgtgtgaccttcgtgaagtcgccaaacctctctgagccccagtcattgctagtaagacctgcctttgagttggtatgatgttcaagttagataacaaaatgtttatacccattagaacagagaataaatagaactacatttcttgcayttatgagctttctgtgaatcagacatccctatgaagtacctcccctggctgtttctcatttactcactgtagcagcactgcgatgtgtgagtatatctgctgtgctcttaaactccaaatctgaggaaactgaggctcagagaggctactggtctcycacaatgtcacacagctcataagtggcaaagctggcttgatgggctacttgttcctctgaaccataccacctcaccacactctycccttcgagggtcacgctaaacttctgcagaggtaattcctccttaaaccagaagggttgctggtggcccacwgctcacgcctagcacacttcatgagaaaaacaccctgtgcccagtgtggagcaggcattgagctgaaggtggtgagcagaagctcatccaccagatgttgacacagcccgcagccttgggcgacccacaggactcctcttatttaactggcatttggtaggagaacaggggcagagtcaaagacaagttggctttctggagagcccagggcagggaaggaggtggcagcgctgagggcggtcaccttagacaccatcgttttactttgaagaattgtctgtcacacacgagttgacagtcaggatgggagagaccccattcaaactagcataacctcccagagggaattcctgggctcccctgggaatcaacagggatcagtcaaggatgggcagagtgtcatgacaacctcattatgaggaagacaaatatatgtcacaagtccgtgatgggacaaccataagacctcagcttcactgtatcttccagagttttaaaaaaatgtattcactgtccaacgtgatcctccagacaggttctgcaggacgcagcctaggactcattatccccaaagtacacatggggaaactcaggcccagcaggtcaaatgctctgtccagtgtrggcctggaaggcaggtcttctccactgttaggcctggctgtccccaacagcacatacttcctcagtccatatgggatcacgataaacaactccatcctccaggaccacactgcatcaacctgctgtgccctaacatcagctgaaggccaagctgcrgggcaccctgggtgttccaagtcactttccctctgcaggcaggaacctcatcctgctctgaaacagatgagagggaaacgcagaaaacagcttccagctcagccaggaaccttagagtcctgaccttttacctcgcctaggagtttgcaggggagagaacacacraatttyrgattttaagcctaaataaaggaagccttagtttgaagtgcaagctctgccggacagggggcaccctgtgagccccatttgttaagaggacaatagtcagagagcttccaggctctcacaccagaaacaggaaatacagatttcacaytgatctccttcccaggagcaacttgatcytctccataaatccgagcgggaagcatttatccaaacaacaaacaagcaaacatgagctgtgtatgggggatagagagaatgaaacccaggtccatcccggggagaatgctggtctatggcagtggggagcagtgaataaakgaggcgtacatccatggatctgggtggagagggtcagggtgtaacccaggacctttccagaggcatgagaaacagtcagcctacacccacagatgacctcaaacaccccaagtgctccttgaaaggctgaggcytttgtgttgctcttggttggattattcacaggcaatgaagtaaacaaggcacaccacaggactcagaaccagggacagcttccgcaggaacctgggtcagttctaaaaggacaaatggaatgaccctgagtagagaagtcagagaaaggcactctcactgaggcaaactccctccccagcagggacccaggcagcaactcggaaaagcaggagtgtcactattgtatcatatgggagagggcaggctgtgtgctctcagggaagttcctcaacttctctgtgccgtagtttcctcatctgcaaaatgtaaatcaaatttgaggtttcaatgcaatgacttatttctctaaagttccttgtccttgtcccatgtagcccagaaatcttcctctggcctagttgtggagcctggcctaagtcgcacattgctggagatggtgaagctgaccagcatgagaggtcagtttctagaagcccaaatcccaacaggcataagcctcaccctccaatatcagctctatcagaaacaaacaaacaaaaacatgtcttattcatttgtccttttcctcaaatgggtggcacttgggcagggcagaagggctggttatccaagcttggaagatgctgacagcagacgcttcaatggcagtaggagttttctgatcactgtcattggtatcacgcttactgttgaaatcgtgacatcaggaatgatgaaaggaactagagtcagatggtctggagcggggaagtgaggagctgaaacctccttcagtctggttgctgtgtccccagggtgggtagatcccctctgttcatcccacatgggacaagtagagcgggagaggaatcaaccctttctaaagggttgaagcattgagctgtgagcttctcggttgctgcagcacaatccttgcccatcctgactgaaacaaccagaattcatgaaatgcatcaaagaagtcttcacctactacgcaagcctggaagggtgactaagatctgaaaaacaccgggaaggctaaaggaactcccacaaggaaaccccattagaaagttctagttacaagatgctcagcacaggccatgcagaaatacgcccagatccggtggtgagcaaggaacggtaggaatgtgagcactgagtcacgcaggagagactcataggggctcaagccagcaaggggacggcctccaccccacgcactgttggccaacagcttccaggggcatttgctctcagaagtcaaagctgattttccacaattgaagtgctcactgtttgggatgatttaggaacaacaccaacaaaaaggaatgaacaatcagagctaatagaattgtgtttaaactctgctgggcttccttgacagagggcacggggagcaaacaaagtcagcagtgtgtcttaagtaaaaaactttttttccttttaattggcagttaataccctcaaaatatgttctgagattgatcaagtaagtgtctttcagcattaaaatattaggatgaaattgctaagggcttcttagcaaagtggaaagaacacaggaatcccaactccaccttctccttagcatacaatcctgagtgggctgttacagctctctgtgcctcggcgccctcacctgcaagacaggtaaaataaaactcctaggttactttcatgaataatatgcaaagcatcaccctaaaaaagtgctgctacttaawtgaccaccaaacattaatgaatactgtggattccaaaaatattagttaatgtgagtggtgtggctaccttcccccagtgccccgtgctctgtcagggaactaacagaggaataaattacagatattcacaagtttgttaccaatgaccctgagctaggaatcagcctgggatcttttcccargtctaccactaatgtgccacctaacactgcrgacatcctctcctctccctgagccccagtttcctcaccagagaatgtgagcattgaggtccctggagtcctgacattccatagagctctgagggcttcaggccggccccacgtcagtctttcacctgtgtgccctgtgcccactgctgatctggggcagaggaggcacagggaaagggcccaggctgctcttaaaaatcrcatctcacattgagaccgacgcatggagactgcggcagaagcagcagaggtgaggaccccgtgtgagtcccctgtggctgccgtagctgatttagctgattaccatgagctccgtggtttccaatagaatgcattctyttacagttctggaggccagaagtccagaacagtatcactgggacaaggtcagggtgtcaggaaagccgagtgtccttggaggctctaggggatgtgccacttcttcctcttccaatttctggtggctgcyggcattccttgacttgttgcccctccagtcacggcctctgttgtcacactgccccctctttctccatctgtgtcaggtctccctccccctccccctcaggaggatacttgcgatagcatttagggaccacctggattgtcttctcctaccaagacccttaacgacatctgcaaggacatttcttccatagttggtaacatatctctggggggcgctgttgagcctgtagaaygccctactttaccagtgaggggatgatggggctggaagagggaaggaatgaaaggagtgtgaaggaagcgccaccaaggagagctgtggaagcccaacccaaagaccgcacctgggatgtcgggaagggccaaggtacagaaggagaaggaagagggttggaggtggagggccagcagcaccaaggctcggagccagggtgaaactcccccgccaggggatggagagaaatggtggggtcgttctctcaggcagtggcacagcagagccagggccagatctggaggtggctgtgcccccctggggggtgcagactcacagcccctccaacagggagcccctccaggtgagagcgaaatggagatgagcgcaaaaccccgactatcaggcagattctgcagcaaaaatgacttcagaggtgaactgtgtgtagcctcaggaacgggatagaggtggcccttgtaaacctaccctgcaatggtgtctaggtcccatgtcccctgttccagacagaggcaggccttggcctcctgaggagggacagcaggagggcaggtccctcactgagcctggagtctctctctctgtacagcaggcaccttctcccgaccactcccaccaccaacatttcattctattccttccctcagggggcagctacaatttctctcttagcccaaggaaaggaataaaacaaactgccttatattgaagtgaacatggctgatctgggcttattgggagccctcccaaggggcggggtctagttctcattatcttctccatcaaggtggctaagaatttttgcagtttcttataactcacaaagtactgtcctagaagctatatccccatgaggggaggtagggcaggtattatcaggttcgcttacaggtggtcaacagagggtcagagaaatcagtgatttggggagctcatacagctgctagatgtagcctggcatcagtcaccgcaggagggcccaccccggcctgagtgcaggcagaacgctgtgacactgagtgacatggacaagtcaccatcctgagcctcccattctcactaacagagaatcaccaccctcggcctgaaggacaggttgtctgcaggtgactgccggggtcacggcaacagcttcccccctgccaggcctgggacccgagttgcagggagtcaggtgtatggccttttgtggtgtctgtgtggtccaggaagagaggggctgcaccgtgtgtgtgtgtgtgtgtgtgtgtgtgtgtgtgtgtgtgtgtgtgtgwktgtgtgtgtgcatctgagtatccgtgtctctgtgtgatgctatatgtcaatgtgtctttgtgtgtgtgtgtgtgtgtgtgtctctgtgtgttggcatgtaactgtaatgtctttcc

SEQ ID NO: 13269 - DNA, 63693 bp, Homo sapiens
tgtctctctgtgcaccactacagcaaatgggacctgggccacttcacttttacaattccagtttacagacctgcattgccccaaccccgttagaccaaagactccctgagggcaaagatggcctcttatttactcttgattccctagcacccagcacagcactaagcattgtacccwctgaaagaacatctgaaggatgarmgtttatagcaaaagtggtttccactgacrttcccttctctcttccccaactttggattgaggagcccaggagctggtcaggtggcaagataagatgagaacggagaagtcattacttggggcctctgttttgctggtgttttgctggtgtgtggagatggtgggtttcccttgaatacctgggaggcaggagcaggcatgaactactccagcctctgggttctggatccacatggggtgctgctgctctctggcacccatcagtccttaaccatctggtctccagccagggaaggagcgtggtggtggagaagcctctctgtcccacccactcatcccaggagctcacgagaatcagccaaagtccgagttctgcaccctgagttaggaactctataactttagactttccctgagctttgggagttctcttaactagtgtgaaagcagttacatcatcctrggtcctcctaaaatagacacatgtatccaaatataggcacatgtattgcaaacataacatgtatgtatatatgtaaatatatacatataatttttgttttgaattaagtataaacacaacaagttacaaatatagtactgagaggtccttgtatggccccgcctccctcaggcagtatcttacataactatagttcatgattacaactggaaagttgccattggcaccacatcagaaactagtctgcagaccttgctcagatttcaccaggttttttgtgcactcatttgctttcctgaaaatattttaatgtttttctacatgacttatctccccgacatactgtgagataaggtttttttttctccgaataagcttagagaacaatgaatgtgagaggtgggaaggatgatttggtgcatctctgttttatccatggtgagtctggacctcagagcagaaggaccctcgtctctcctctggggagtcctggtgccaactcagtgcaggctgctaagttatccgggtctgactgtcttcttctctgctaaaatttgtcttaagcatgtaacacagccatgcttattaatgatgaggagacagccaatgaaaattaattttttcaaagatgaatagatatctagattttttcaagcacaactcrtttaagaaaatatcacctcactgagccccawatgagttaggtctcacttagaaagtgtcccctagtgccaggtaaagtgcctcatatttgcaatcccagcacttctggagacggagataggaggatctcatgagcccaggagttcaagaccagcctgggtaacatggcaaaaccctgtctctacagaaaatacaaaaaaaaaaaaaatagctgggcgtggtggcgtgcacctgtggtcccagctactctggagtctgaggtgggagaatcgcttgaatccaggaggttaaggctacagtgagctgtgtttgcaccaccgcactccagcctgggtgacagagccagcctctgtttccaaaaaaaaaaaagaaagaaaggaaaagaaaatgcccccgagttgattacattttaaccactgtgctaacttgagagatagtctgctatctctttacaggacatgagggctgataatcacctcattgcatggtcctggggactgatgaacaaaggctaacatgtggaaaagggcaactaaagaaagaagagccacctccaggttaattagtasaagtctcctcgctggtatgccctaatacactaaaacagcagtaaaaacaatctgcacattggcatcgaaggcacagataaacttgccgaggacycttaccacggcagagggatgctttatatgagtccttagtagattaattaagttcttgctagttccatttggaaatgatgctgtcctcttggggctatgcagagaagttcatgttgatgaaatgagctgtcctagaatggcagttcccgggcagcagagcctgggctcaaggaaggttgaaagaaggggtggcgtggagctgccaggtgcaaatgtcaggccagcaatgcagtccagcttgcatggacrtgcttcgcctaggaagttgtgacttggctgcattttccacttcaggtgagatggaaggttgaactctacctcacctcctggtgaggttgaygtttcctggtgtttataactttctttgtaaatacttgaaaggaatttaccattttaatgctggaagagacgtctattccttcttaagaggacctgagtggatcttgattgcaggccttatgctgggcagagctaaggagaattcaatttgtctccaatcttatttgaatgttctttttttttttttttttttttttttttttgagacagagtcttgctctctcacccaggctggagtgcaatggcacgatctcggctcactgcaacctctgcctgctgggttcaagcaattctcccacctcagcctccccagtatctgggacgacaggagcatgccaccatgccctgctaatttttggtatttttagtagagatggggtttcaccatgctggccargctggtctcaaactcctgacctcgtgatccacctgccttggcctcccaaagtactgggattacaggcatgagccaccgcgcccrgcctatttgaacgttcctatgcctgctacaagtgcagcagcagaatctccacacatcttgmgtgcgaaagtttcctgtarttcctttagcatagaraggctggggaaggttagagactgacttgtactctttagacatatagttgatcattgaacaacacacgtctgaactgttacacacagatttttttcaataaatgtgttagaaaatgttttggagttttgcaacaatttgaaaaaactcaaagacaaaccatccagctagaaatatyaacaaaaatagaaaaagttaagtatgtcatgaatgcataaaatatatgtagatacctagtctattttattctttactrccataaaatataacaaaactattgcaaaagttaaaatttartaaarattgtgtacacactcacagatcgtatatggtrctattctcagttgagagaagtgtatacaaacatcaagatgcagtattaaattgtaactgcataaatttaaccgtagtrcataccacactatggtaataatttcatatcctcctcctgttgctgttgcaatgagcaaaggtgttgcgagtatccacttaaaacrttctgtgatactcaacattccatcatragcagttcatccccagtgaattgcgcatcmcagtaaaaagtgctctctccctgttcgcrtgtatttttcrtcctgtttcgygctgtactgtaaaccttgaataacaccatgggatccaatatgaagtggcactagtgatgctggaagtgctcccaagaagcagagaaaagtcatgacatttgacattacaagaaaaactggatttgcttgatatgtaacagagactgaggtctgtagctggggttgcttccatttcagacagatgattcatcttgtaaacaggtggtgtaaacttactgtatggaaaaatacataacagtaccacagatgtattttctccttacgaacatttccttttctctagcttactttattgtaagaatacagtatatcatacatataacatacaaaatacatgttattaactgttgctggtcaacagcaggctgttagtagttaagtttttgagagtcagagttatacctggattttctactgtgtatggtcagtgtgccaacccctgaaattgatcaagggtcaactgtaatcctaaaagaatctaatacaatattgtaaacagtaagtggtcaataaataaggaaytgaactaataagaatacataaatcycagaatatgtgcaacctgatcatagtacacagagatctctctatatatctcttttcttagttcatgctgttctttcaggtagaaagygccttattttgaattagttgtctttagagcaaaaatccctccaagagtgctgtgtggtttcctatgcacaacctggaatagtccattgcttcatgcctaccctggacatgaagggcyatgccryagcggaagtctctatgcacccacccccgtctatacctgagcaacacattcctctttgctgctctcttacaggctacagagtgcggtggcgccagcacagagctctgctcaacgtccctctgtgctttcacgatgctgatggattatgaaggtagggaagaatgtacagccaggargccattaggagggcaactaatttatraaatcacatttgtagaatttaatgcatccaacaactaccaggggaaaggtgggcaaaagctataccaacaccacccaagtcaaaaccaaaacaacaggaaaagaaaattatgtggatgtagaatttctgataacatcattcccaaggtgccttatccaagaggaactgctacaataatattttaagtggaaataaatacakgctggaagcattatatattagtagagtatttttttttcccaragtactttctcaagcacatcaacatgagccccctaagagacatttcacattaaaaataaaatgtctgcccactgctggtttctcaatytgcctccaccttctgtcccctttaatgaactgggccaygaggtgagtcagagaggataaagggagtggtaagartttgaggagagaagagagtgaggctaaaataggaaatcaggaaawgcgattcggtccccctgtccctcacrtggggccaccctcttgttgcccagygtggyttcttcttgagggttctgcatggttcctcaatcccagggaattccgcaggacattccacccaagaccattgggctcccacctctactcttttgccagttaatgaataggcaggaatttcactgcctggaaagaggaacaatgctttctggtccttatttcacatctaaaatagagaggtcaattgatttattcctaaatatctttgaacactaaaatagaagttttacagcatatatactacctggttgctctagacttaagccagggaaaagtacagattcaacatttaaaattgagatagayrctttccacttaatgctaccagtcttgctttatttcatgagaatgagaatataataatatggcatacgttcatttgggggaaagattgatgtcttataacataakttataattacagaaaacatgtgagttcactgggaataaataaattttgaagataataagatactttcacttatgtcrtaatttctatgtcatttggtgtaggatgtagagatattaacgtttacacctaactyaagtttgtcatctaagacctgaargggttttgtctatcagctgcacccctgggtagagacacaaccttggrgaaggcctcagccccatccctcrtacagcaggaatgagaacagccctgcctgttgggaagcttgasggaggctatggacgtgcagcrcttggcagarggtctcgtcatggaaggttccagcaaatgtgagatacttttatgatttcattttctccaaaaraaagggaataagagaagaggggaggaaataagactaattgcgagagataaagtacaagggtgagggaaggaataaggagacatgacggcagcgtggagcagccgaggggggagattgctttcaccacttcccagcatctattgcagattccaccctcaaacatkttgtaaggactctttattcaaggtaaygtttgaaccctgctgagccagtggcatgggtctctgagagaatcattaacttaatttgactatctggtytgtggatgcgtttactctcatgtaagtcaacaayatcctgggattgggacmcactttctgggcactgctggccagtcccaaaatggaacataaggaagtggttcttctacttcttttatttytgaaatcaggtaagacatagtttttttaaattataakaattattttttctcccacaatgtagtaaaaatacatatgccatggctttatgtgcaattcatttaatttttgattcatgaaacttccagttgaaaatcttgtataagattgaggaattcttcaagaartaagtttaagtttcctgtgaagattgtcagggtgctggaatgaatrggcagagaaaataatgggtgatttttcaaatctaaatgagtgcacccacataatggccagtctaattgaaaaagagccaatgtagctaattatgcaaaggacggctaagctctttgcctggttctcagtttgactaatttatatcatctctgttacggtgtcatgctcccctcacttgcaagtyaaaacagtgaaatatctctttgaatatattccgttctctcaccagttcatggtggcggcagggtcggggactcagcatttctccctttgttatggcctgaggaaggctttccatcagtatacgtttgcctcttatccccggaaaaatcacacgcatccatttgccagatgctgtgtgcagatagtgatcaacaaatactcagttgcttgggttaggtccctacatttttacacatacatacatacctgtgtgtgaatgtgagtgtgagtgtgtatcctttacaaatactagcttatttagctcgtggtataggtagggtagcatattcatcctcattttataaacaaagaaatcagacttaggaatatcatgttatttgctcagtgaccaaattctcagatctgggaaataaagaaaactggatttaagccaggtttcccagaaggaatctagggctcttctcacttttcagctttgtttaagcctttgaaagaatattctaaacatgtcctagtacttctttttctttaaaaaaaaaaaagctttattgagatataattaacatatagaattcacccatttaggcatacaatccaatggatttcaagatattgagagttgtgcagccaccatcagaataaattttaaaactattcatacccccmaaaacgcactccactctccttagctgttacccccaatctgcagcttctggcaaccactaatctactttctgtatttatatctttgycattttgaacatttcatacaaacggaatcatacgatttgctagtagttcttcatgtaaataatgtacgcttgaaattcaatctataaattaccagataaaattttacaagttgcactttagagtcaaatacatttgaatttagtggaagccattcaaggagctatcaaagaaaatacagagcaggagaaaattaaagaaatttttgtaagaaattggtgtatgttggggggtatgaatattatatttcaatgcatggaaactaggacatagatcactatgaacttattcagtgggctacacccaaaggctagatcaaacttctctgccacaggattaacatatgttttaacccacctggtgggcacattctctcataagctctttyggaaagccaggttttctgtggatgtatcatctttccagtgtgctgcaatgcccggggagagggaaaagtttcttttacagccatgcttagtgggaagtggagaaacatcttccatttcacaaattaagtcttttacacatgcaaatatgcatacacattcacacaccacagtgaggaagaaattctcacaccattartaaaatacatttgcatcagtagcaatatacatctgcattttgcctataatataaatgtatttttccactaaaagatttgtttgatgtttccttgccagcaaataagccctatcaaatcctattgccatatgagtcctagaggtgaataagagaagaaaaaatgggggaaaattatttcaaactgaaaagagaamagtttgattctgttttgggatatttcctagggacatgagctggggaggggatctcagcagcgatgygctatgaagcatagtaacataacacagagaacttaattgaagggggaaataaayggaagttttctttttttgaatatcwgttgtagccygctctgctatacttcaaaaaaactcttcagaaagtttaactgaactcactgtaggacacactttgtggatttattgtgtgttttgaagtcacactgtgagctatatagaattaaccaaaacacaactcttcttgaaaatgagagttcaagttggcagaaagtgcggggtaaagacayggatatgggcctaaagcatctatttctttgtgatcttttgatatatctctcaagtgctttttagtggattagctttagaatgcatcagccaactcctgctcaataatccatttttccagcccrgaatgtcttaaattgaggaaggacraagtccmagaggtggggarcagggggactttggccgaggactttgcatgaatcgatgagcatgcatccacctccctgtcctgccccttgtgctctgtgtaccctcaggaggtcaggacaggcctttctgagaatgaraatctgttcatttgctttcctactggatayttgtcatcagcatacaaaccaatgygctctgcagtgtgtcrtctttcagaacctcccctgacckcatgttccctggagggctcgctgtcttcagagccaggcttgtctccygctgcmgcctccactgytctcctagtcactctgtaacccacyccctctgcctgcggcccccaccacgcccctcaaagtggtcaaggttgtcctgttgtctaattccatggagcttgcctgtcttcattttattagcctcttttggcctctyacccttgtgmaaatcactagcattctgtgcraaggacggmgctggcatctccaggcttggaatagagctaccaaagctcagccagatgtctggaagagcctcaggacaagggrayaccctgtagccttgtggtgggagcacagctgaggcccccttggccaccctctgccacgaccaggcagaaagcagctttcggacagattcgttgtctcagatttgatctcaaagaaaaaccaaraccagtatttgtcccaggtyctgcttttttacaatttcctcyraaatccagatacctrtcaacaccttggaaaaactgayttctccccarttagtagkgttgtgtgactktcatmagcccagtacaaaaatggccttctttgttggggagcttcttaccctccagtgttttgcccaatttttgtccaagktggcarcataatttagttcagttcttgtttatttccaccatcatctatgcaccaaaatttatgtkyctcaaggagggaccattcagaggatgcttcccaccrgttcaagtgacagtgycagaaccaaagcgcatattgtaggaaatcaaacaatggcctccaagttccatttctacccagggatgaacaaatcaacatcaatcttggtaacacaactgccactgatggtgccttactcttctctcatgacatggmacaatyratagcaaacataaaatttgttcttgtttaaggatttatatccactaatatggtaacatagtagtggttccatagttctaacctgtttrtcaatccagttaatcttttactatcttgcaatctgytaatgaaactgtttttctttgttttataatttcaacttttagagtcaggggtacatgtgcaggtktgttacatmactaaattgcgtgacactgagctttgggrtacaaatgatcccatcacccaggtagtgagctaaatacctactaaataggtagtttttcagcccttgcctygctccctctctcccttctctggtagtccccagtgtcttyagttgccatctttatttatgtccamatgccyractgtgtgttcttaactaaacattttgattcatagctacccattctacttccagtaaacagmaagttttatttggttaatgswaaccaaatagattaaaaggaagtcatgacaattagacatygrcattgatttactgaccatttattccacttggatctcccacctctaggtcaaggagagcctctggatgactatgtraatrcccaggggscttcactgttcagtgtcactaagaagcagctgggagcaggaagyakagaagaatgtgcagcaaaatgtgaggaggacgaagaattcacctgcaggtatttccattgtygttgcacctacgcaggaatctgtaattcagatggcaagtaatttactcacaaatttattaatgatttaagaggaaagagaaatttatggagccagagtttggaactatatttgctcacagtatgtgaagccatactaacagcttcttgttaaggtttattggagtctttgttagaaaaataccctcaaaggaagttatttgtttttacaccggacacaaacattagcagttattgttctgagctccagttttcaacatcatcatcagtaaatgtttgttgaggatcaggtgaatgaaagtgtcctagatagatctgagcaatgacttatagctacaagatccagtgcctgccctttagtatttaaggtgtagtcaaagaaactggatataatgttaaaaaaaaaaaaaagacagcccaagtgaggtacaggcataatcaatgcatgctctacccagatccagaagaaagaacagtgcctaaggttgaggcagctagagaaggctcagggaggaggtgggaactgagctgggtttggagttgagagagctcttgacaagcaccaggaaggcaggggaagatgyggccctgcacyttctgagggggaccattaagagatgaagttgactaaagcagagactttgtgtaggtgacrggcytgggaaggtagctatggawkccagactgagcacccatagcaggaccacgggatggagatgggaggggtcaggggccagggyrgggtggaatgtggrrcagaggttcaggggaactgatcagagttgggaggtcatggagayggactatcttggygaatgggttcaaagcaaccagagttgcttctttcyaacccaaaaacaaaaattaagaagatgagtgaagaagaagtaaagcagttgaaacaggaagaaagggaaaattatgagggagggaaggtaagggcarataagatttgctgccacgttggtgtattttgttcagtacttcatcgatgccatgcccaaataactgaaagaggcagcaattctgarctctctggtccctcaagatattcaatgatctttagcatgtctcacttattaataaacatttgttttctttaaataaagaaaaatacttattggatttcctgcttcgttctgcagggcattccaatatcacagtaaagagcaacartgtgtgataatggctgaaaacargaagtcctccataatcattaggatgagagatgyagttttatttgaaaagaaaggtgagtacattttcttcctcctcctcctactgtcctccccatcctcccrctcttcctctttctctattctatctttaatttatragaccagaggaggaaggyactaycrtgttataaaactgaattctgagttaggacaggatttgattactaactaaccatgtcagcttgagtgtattacttcacctcttagatttaattttttttgttcaaaagatgaaaggattagatttacaaaatcacttctacctctatgaccctgaaaataagatttwtaaaatattattttatatttaacaaggagatgggaagtctaagcattccttttggtcttggcttcttattctgcagggtgaccatggtccttgggccctaacrtctggaygaagccttgtaaaacagaaatactgaggtgttttaatcctcagaaacatttagattgggacacaaatcttatttttactcttaaatttttcacattttgggggacatggtctatatttttctcagatttctgawatgttgtcttttaaaaatgtgtaaaagttacagttccttttctatagtttattttaaaatgtgggtcaatagtcccactgcttagaataagaggcagacaggatttcaatagaaattgcatgcctttttagatgtgcaaatgtttcattaagcatttcccatcaagtatatcccatcaagtatgctcccattaagcatatcccatcaagtataaatatttgaagggatgcatgacactttaaaaactgtttcctctactgtgttggtagccaggtattaagactgttaatagtaacaatttasctctccaaacattctgcatcccaggtgttaaagaggactggaaacaccttagttcttgtattcttgaggatgatttgccatattgtgtctagtattacggcaaaactctaagtagcattttaaatagtatttatttgggttggaattatttctatgcattgactcwtcttcctgggtttcattagctgtaygcattgtacttccttccttaccactatttatctcgaattcttgagattaaagtgcagattaaatctaaactttatctggtraagttattagttcttacaagtagcaagcaaacggtaaactaaataggatcacctaattgtaccagatttwaaaaaaaaaaaaccctgattctcctgattctctctacaaaatgctaacatttaaatatgtcatttgtaaattgttaaccagaaggaacatgggaatgactgtaggttgagtttgaagtctgaagtttgaaggcttagtttgcttgttttcaaagtgacagaagggagcaaaaggttatataaactctgatgggtacatacaaaaaaaaaagaagtgaaaagtcaaaagtcagtcattttttggtccttgtttctttgctgtgggatattgacctgctactaacttacctgccagggttttgccaggaacagtcagtgttagatcacatttacttctgccacttgccaccagccacactgscttcaccaagtccaagaccctatcaccactggttggggctacttgtagctgtacacatgatctctaagaaatgtaacttccctgtttaaagcccttcctagtgcccttaaaataagacccaaagacttcccaaatgtgctagggcccagcattatttaagtaacccccagctgctgtttgcttggcttgctaaacttttctacactggccttacttctgttccttcaccaccccaagcacacaccctcctgcctgggaccctcttcacctttgtcctgctgtgccagctccttcttatctcctaggtgtcagctcaatcatcatgtcctttgcaaatcttccttgacccctagacctccctttcacaaagtaccttgagtttacacttttgatgagtgtcttatgtctactgtaatactatgtcccaatgaagatgtacttgcaatcataatasgcagtattgggttaaaagcattagtttgctgyaggtaygttaggagcactttccccatgtgattgatcaattaattaaaaaatggctaaagtgggtaaccttaaatgatggtgyaaatataccttaaacdttttatattttcattgaaaacacaagtgtacttgacaccttttgacgtagagcagaggcttttcttcttcgaatatggggtcaccagtagaaggtctctggtgtatttcctgcataaactatgctccagtgcaacatctacaataattactttccttatttttgaagtggaccatatctcgacatttattaatcaatctgmatgtgtaaaacctttagatttttatgaattcctcctcaagytttatagtcaactatatgagtggattgccctctgtggatytgatagcaattttttaaatgattcaygtttcaacttgttaaaaacatttaatttagttaaaaaccaaacaaaaaagagctttgttycttttcacattcatttctcagtttagatcatctttaattaaatataaatgtaagaaagttggaaaatgcaaagaaaygactcgttgtaagcacataactcacgtggggggaacagacatgggtgggcacactagcaaacacctgccagctgcatgtggacccaggtgggcacsrgactgttttaaacacaggagagggcccrttgtctaactggtgagttggttgagtggaagctggttgagaacttttactgcaaaccatttacagtagaccacaattttatagccctgtttggcactttttcatatcactgggagcctgaagaaatagaagtgggttggatctctttcagcctcdgaaaagcctgccattcccccatctaaaaagccctttccccattctctcactctgtctcatcatgtatgtaatatgtatcatcattaagtgatctcattttataytgtttccttgaatatttcctgtamcccccctgcctgattccaytagaatgtaagctccatgacggccaagcctctggctgcactgtgccccrtgtgtccccagcatcctggtggggctcgatacacagagagctcataagtagcatttgaatacatgaatcaaagaatggytcagtttactgcagcctttttgcagatgcaaaagatgatcttttagaaagcagaaacagggggtctggtgcatgagatctttttctcaacrtgactatgctgtgcagaccttcatgtggtgtcttgtgaaagactttgaccactgtgtggacttcccttcagtgtatctytcagagtgcaagactgggaatggaaagaaytacagagggacgatgtccaaaacaaaaaatggcatcacctgtcaaaaatggagttccacttctccccrmaracctaggtaagacattycctttcatctttgtgttcatctactgtaaagttgtccctctgtgtctgtgagggattggttccaggacccctgtggctaccaaaatccatgcttctcaagtcccttatataaaatggtgcagtatttgcatataacctacataccttctcttgtataatccctaatataatgtaaatgctatktaatcrttgttatactgtattgtttttatttgtattatgttttattgtcatattgttattttctgtcmtctttttcaagtcttttccatccacagttggttgaatttgtkgatctggaacccatggatacagagggccaactgtatttaggataatttcawcacttttaattcaaaccacaatatgtraataagcagatagaaagaatctttttgatgtcgatgttcaactatttttgkcaccatagtagaacatggttgctttctattttttcttggatatggaggtttcttgaagacytagaacayagaagaatgcctagtttaaaaaaaatcaatgaaactatgagttttaggccaaatctgagaaaagatcaaagatgactaygtttgggactgaagtaagcatatcargttagaactctcatcacatgttcgactcaaattgtggagcaaaagagtaaataagatataaaaatgamaatgaagatacgtgaaattcaaatgttrcaacttgcctattatttattttagtgcatttttttgtacttttcccagtttggtgttaggtggcmttaagttctcagtaatgacrcttatcaaataggaacttagtgcttgttactcacytttatccattcccccaacactcaacaaattgcctttgctatatccctatgagatgagcagatcaaatattccccgtgasttaatgaaaactgattcaaccaaatggcaaagtcagagactatcgggggccatggagacactctgggccatttttatgaggtagtctaggctcatctttatgagggaactgaggtctcrgggggtgggggttatcccaaataggttcacagaagaaccagaaataaaacctgcctttctmgactgtaagtcttgtgattttcatctaaayggttgtcwctatacagcaactcatctctagaactgaaaataagyttaaatccctcctccatccccaataattcaagctgcatttcagagaaaaccaggactttggaatcagacagatcaactttgaattcttgatctgcttcttcatagctatttacacttaggcaagttttgttttgttttgttttacgttgccactcagttttctcwtctgtaaaatagggrtaataacaccttcctcaaatggttttattaggactaaaagagagaatgtgtggaaagatgttagtggaattcctggcagatagttcacatgracaaaatggtattaactacaaaaatttttacagrgaaaacggtaactgacaaaagcasgtgtttggaatgaattaagaccatggcagccttttgaggcctttatatttctcctgactgtgcaataaaaatattttggctctctaagacttggctgtcacagtagcaatggtaatattagctactgtgccagaagcagcctatcaatagagaaattgaaaatctgaccacacaaatgctgcagcacccagctgaaatgcatttggatgacaatctcagatgggaatcragagcatctccttctgccttgctaatagcaagctgatttttagaatatagtctaagtgcttcttttccatcctcyccagattctcacctgctacacacccctcagagggactggaggagaactactgmaggaatccagacaacgatccgcaggggccctggtgctatactactgatccagaasagagatatgactactgcgacattcttgagtgtgaaggtcaggagtggttctagaaaatgttttcatttctgcycttcacctgtaaaataatttgttgtaaagccccttcccacagggatgttattaataattgagtaacgtattcacctctsggaaagaagcaaaaccccagaattaacctgawttttttttttttctgagacagagttttgctctcgttgcccaggctagagtgcaaccgtgcaatctcggctcaccacaacctccgcctcygggttcaagagattctgctacctcagcctcccaagtagctgggattacaggcatgtgccaccatgcctggctaattttatatttttagtagagacagggtttctccacgtaggtcaggctggtcttgaactctcgacctcaggtgatccgcctgcctcagcctctcaaagtgctgggattacaggcatgagccaccatgcccagcagacctgaattatttttattaaaatgttacatcaacatgtacaaatataaaactacatctaaactctaagtacaaacttcttatgcttacaactcttacacagtgttaaccccaagacaggtttgcaattaaatagttaaaataaaacaacaaaatcaataaaaatcaaataaacaatatatatttaatgtggtagactttgctgttttgctgaagctaagcaaggaaccagtttttaaatcagcaatccattatttgaatggactgagcaatttaatagtgcacctcaaaggtcaatgctaaaaaattttaaaaaaatcctactgaaaaaactgtcatcgtttcacatttctggctacattagtgcaaaagggaataaataaaggtgagatttgtgtgacagtgtggatatggtactgtgtgacaactcagttctcccatcacttccacctgttcgaatcacggggatcctttatttgtacaccatgttataggtatttgcccttaagcaycaccaatgcatcactgttatattaagtctgcccgttttccttagtactccataaaatttaagtcacatattactctgcctcaccatgttayttcaataattctgaatcaaagtttaagtttgtgaataattttgcaaaaaagagccaatcatgcttctcaacaacataaaaagagaagcrctrtcacttcaggtgaatattrttctccctgaggccatgagcataaacaaaaactccagactaaaaccctgagacggtgccaggtcattcagcagtcagcggaatgatcagaataatttcatacaaagttttaaagatcattattgaaatgaagatgccaaatattgaaaactcctaatggagaaygtagactcctgggaatatatgcacccttggctccccactggcctgtgcatcccggtctaaggacatggcatcatggaaattctgaacttggtcatgactacaatagttgagggagtattgactaaaatatgtgaatgttacggtttaaaaggaaaatgacatttggattatgctagaaaatcctgagtccttattgccaattttattgccaagwrcctgttgtgaattacrtcggaatgagaggcaagtcgcacttaagtgagtaggattctggttyttactctctattttgcttcatccatttcagttttcttcttcctctctgtccttccttcccactctgtccagaggaatgtatgcattgcagtggagaaaactatgacggcaaaatttccaagaccatgtctggactggaatgccaggcctgggactctcagagcccacacgctcatggatacattccttccaagtaagtctcactgggaaaaacattccatgtttaattaaggctctgcagctctatcagacatttgctgtcatttagatattttagcattcctcaagaagtgaacgcctgatgwttttaatttcaaagctaacctcctcccacaatattgcaagtgaaatacgcattcttgctgctcaaaatatggtccacgggtcagcagcagggatgttttctgagagtttgttagaaatccagaatgtcacaccctctgaatctgatttgaataataaccagatcctcagctgatgtgcacacacattcaaacactaatgtcagtaatgaatacattaacatctgtcttcagaaatrcacacacacatgttgctggtgtattttccaaatattttccttttctctttactccttgtctttcttttccctttgtaccaatgarattcaagtctcctaacctttgacctatgagcagacgtcatggatttttgaatccctgatgttttatgtatatttacatcaatgtgtttttctggaatgaggattcrtaacttccatcagattctctaaggggaccacgaatttaaaataagaataagcttcttgctctagaaagtcatgatggttcctaraataaggtttcgtgagtattctatttcacattaattgtgctggaaaacacctcccattccacagtcgcttctggtcttcctcttcattctatgatgactacagggccataccagggctttcaagaatgcagaagtgaggctgagccacagattccacggtggaaagcagctctattgaatttgtacacctcccattccaaatagctagcttaaaacacagcagctgccattttccttcaaaggagaaatacaggaaagacctaagggtccaaaactgggtaaaggcacttccaggaaaccagaaggagaagaggattgcttaagccgctgctggctcctctttccatcctggtaagcatttacaatcagagagggaatgaataaacgcagagggccaccaggcatggagtgcatccaacagccctggccactgggccccactgaggaaggatccagccccatactgcatggtgagacccttgcaagagcacagcttctcctcttggtttttctaagcttcaaggctggtgggagcagagcctggtagaccagaaggaccattcctttaagctatgaagatgcacatttcttggctctgttaggtactagatgagtatctttaggcagggagcactttacattttaaagactgctatcatttgtggttgaataactggaatttgcttacrtcaattttccagatggccaaaatgataaggtcactgattctgttgagtgatttttacacatgtaaactgttagaaaaacagtgcttggcagccgggcatggtggcacatgcctgtagtcctagttacctaaagggctgaagcgggaggattgcttgagtgagttcaaggagttcaaggcaagcctgggcaataagtgggaccctgtctctaaaaacaaacaaaaaaaagaaagtccttggaatacagggccaaccttgtytcctwgttgccatctctgaacacagccttcatctgattacctcctccatgcccgactgtgcctagcacacagcaggtgctcaatgtttgctcttgaaaaagagtcttatccatgaatgtaaatgttcagtgctactaaaatcttkcttgtccattcagatttccaaacaagaacctgaagaagaattactgtcgtaaccccgatagggagctgcggccttggtgtttcaccaccgaccccaacaagcgctgggaactttgygacatcccccrctgcagtgagtatgatgcacacccagattccaggatttggacctgccctgttcttgaaatcaaaagaaaacatgtgtcagtgcctgagtgcagcctctgaaaagtgacctacaagtcctatgggatgttattggtctttattttattgctggtttaaaacagttatggttattggttactgtgggtgattgatcagagcrtccatttatcatgtttttctttctttgcaactgaaacttctgcctcaggagttcactgaaatgtaggctttaggtgttgttcatcctattctctctgtgctaaagggaaatcagacccatgctctctgacacatggatttcattttcaaccagagttctaatagttgttttgtaaacaaagagtgtctttstttacaatgttcaggtctgtgggtgtccagtttttccaccttggggagcagagggtgagtggtgggggtggggaagagttcaagaggagaagatgaaatggcagacctagtagaaatgatgtggagtaaacaattttatcatattttcctctctgagaatttgaagcaaaggattacacactaagagaaatacaggcatgaaaggttaaaaaggattcagtgagggttggcctcccctcctttcctctgacatgtgtcctttgaaagcggaagttcctcaggcattctccctttttatgaatattaatttctctttttttttcagtttctctttttgtcatcttttttcctcaagaatatcttgatttctggatgcacacacttttccttggaggtgttttttgccttctttccatggactctttccctgttgtttggcttttatggcatgttgggtgccattcagtcatgtctactcagtgaataatttattcttcaggaaagagagtggacctttggtgtatgtgagaattcggggtgtgaggtgacacgtgttgatacttaccaggtaggargaactgagcaaagagaacatagaaagaagcacctacccaagggtctttctctgaaggagttccttgtgaaagggtctcacaggcatagatgstactaaattgatttcatctgaaaacatgaaacaattctcaagtgccaaattccaagagaggctgagcaraagccaagacaggccagaacaccctgcagccatcctccttaacatccatctgtgcattctctattttaaaattattcattgtagggctgggcacggtggctcacgcctgtaatcccagcacttccggaggccgaggtgggyggatcacgaggtcaggagttcaagaccarcctggccaatatgatgaaaccccacctctactaaaaatacaaaaaaattagccagttgtggtracacgcacctgtagtctgagctactcgggaggctgaggcaggagaatgacttgaacccaggaggcagaggttgcagtgagctgagatcgtgccactgactccagcctgggcgacagagcgagactccrtctcaaaaaatatatatattcattgtaacttattttgcccattcaagcaacacctccaccatcttctggtcccacctaccagtgtctgaagggaacaggtgaaaactatcgcgggaatgtggctgttaccgtgtccgggcacacctgtcagcactggagtgcacagacccctcacacacataacaggacaccagaaaacttyccctgcaagtaagtcccctccrgtctcattctgctgctatggaatgtgaaatcccattgactttgccttagttttagttactgtaggaacgcaggataaagtattctggaagaaaaactgatctagtcataagtaaaggaaatgaactttagcacgttttttcccgtaacggttgttctcaaagcgtggttccctagacttttttctttttggaaagctaaactcacaatcacttctttttcagaaatttggatgaaaactactgccgcaatcctgacggaaaaagggccccatggtgccatacaaccaacagccaagtgcggtgggagtactgtaagataccgtcctgtgactcctccccagtatccacggaacarttggctcccacaggtaagcaagggtatgggagcttactgagggcccaagttttctccttatttttgtataccagtggcatcatcacaatatacagtagctttgtaagtttaatgctattgtggtcagaaagcctgcccttatgatttcagtttttttagatttgttgaggtttgttttatggttcagaatatagccatcttggtgaatgtttcatgtgctcttgaaaagaatgtgtcttctgcggttgttgggtggggtgttccctcaaggtcatttaggtgaagttggttgctggtgttcttctgtatcsttactgattgtctgtctcctccttcattgactactgtggatgaatggtgatgtgtccaactttaactgtaaattagtctatttctcttttagatcgtaactcttttgtatattttgaagctcttttgttaggcacatatgtatttaggatggttatgtcttctagatgaaaggacccctttatctttatgtaatgtttcttcttatctctgggaatatttcttcttctgaagttctgaactctctttatggtgatataaatacagtctcacagctctattttcactagtatttgtgtgatatatcttttaaatttgtatgatatatcttttaaatttatctgagcttttaaattgagatgttcaaaccatttgcattcatgcaattgttaatagagttgaatttacatctaccatcaagttagttatttctctttgtcccatttaaactttgttccttttttcatctttttctgccttcatttagattgagtttatctccactactcacttagtaaattaatttttaatggttttagtattttccacaatgtttataatatacatttttgacttttcacattccaccttcaaatgatatcattctacttgacatatgaatccttacatcattgcagttctacttcctccctcccaaaatgctatactattactctttgtaatagaagcttacttctactatgtcacagatctcacaatacattgacactatttttgccctaatagttgtgttttaaagtgatcaagaataaaactattttaaatattttctttatttatttattttaccatttctggtgcttctcatctactggggtagatctcaatttccatctggtrtcagtttctttctgtgaaaaacaacttttagcattttttgtagcacaggtctgctactgctgaagtctttcagattttgagtgtctgaaaaagtattttgccttcagtttttaaaagtaattttgctgaaygtagatactgggttgagagtttcatyacttgcaacactttaatgatgatgttccattatcttctgttttaaatagtttgactagtaatctgatctttgttcctatgttttcaataggtcatttttctctgactacctttaagattttctcatctttgtttttcaacagttcgactatgatgtgtttattattaatttctttgtgtttaatctgcttgaggtattctgagttcctagatttgtagattgttgatttttttcttttctcttttttcttttcttttctttttttttttttttttttttgagatggagcctcactctgtcacccaggctggagtgcagtggcgcaatctcggctcactgcaaactccacctcccaggttcaagtgattctcctgcttcagcctcctgaggagctgggactacaagcatgtgccaccaggcccagctaatttttgtatttttggtagagacagagtttcgccatgttggccagactggtctcaaacttctgacctcagacggtccatcaccttggccttccaaagtgctgacagtacaggtgtgagcaaccgtgcccagcctarattgttgattttcattgtccttgtaaaattcatagccattatctgttcaaacgtttctttttgcacttttctctctctgtattttccttttgggactctaagtaccacgtgtttgggattctaagtacccacaacattcatgttgtttcataaatcttgtaagcttgttctctttttttttcagtaactctttttcattctttgtgttggtttggataagttctggtaacctatttccaagtttatggattattttttcagttgtttctagtcatctcctcagcccattgagagaattcttcatctctgatattatgactttttttctagcattttcatgttactcttttctatagtttccatctttgctgaaattctctacctatctatgcatactgtccaccgttacaacaagatcctttaacatactaatgtaggtatcacacaatcccaatctgatagtttccagatggcgtcttctctaagtctggctctctggattgctttattattcaacagtggctttttgttcccccttgggttttttggtgtgtcttataattctttaatcaaacactagacattataaatagaagaacagtagaggttacagtaaatattatttatactttgaaatggacacccttgtcttgcaaatatatatcgtggataattgagtcaatgtagtcactagtttaactgaattgggatttgtgattgctagttttaccttaagtgcaccacagatataaattcctccagtgatgtgctgctgctatcttttacttagagtggggcctggggtgctaaagagttttctccgtgttcctatccattcccagatttcagcagtcactgcatgcctgcactacagaggagatatcttcatacacataatctaaccccattgacactcggctgtttcttgttactgaatgctcactttttggtggacgtaggagaatacttatctccctggtctacctccctcttaggccagttgagcacagctcggctttgaaagtagtgatttttcagtgttcttgtgcctccttctgatggaacttgtacctgtggtgggtttggaaagaaagagtagtaggcttctgcttcattgcaatgcaggatgttgggcacaagaggattccctgtaacttctccaagggaataagatttttgcctccaccactctctgagaagctgtggatctttgcctgcagtcctagatgcaggaccatctcctgccctatcacccagaagctttggtctttggctttgtttgaggaaggagctagagaaatgtgcaaagctttcatgtctgccccccactgacagccactcaccacccacagcctgcactgccgaatgcatcctcctctcatctgccctcgtgttctcatgaacactcagtagggacccataaaaaagagcttgcaygtaagtgcratttccaattataagtactctatctgttctttcmcacccaggttttaaatgaaatattactaggaacttattaatgttctaaaatgctataaatctatttttatgttaatctgtctgctaatacagaaaagagaacagtcataattctcagaggctaccgtactgtttttgtcatarattgcttcatgcttcttttttttcagtaattgttaagcttgatttcttttattttaatttcagcaccacctgagctaacccctgtggtccaggactgctaccatggtgatggacagagctaccgaggcacatcctccaccaccaccacaggaaagaagtgtcagtcttggtcatctatgacaccacacyggcaccagaagaccccagaaaactacccaaatgcgtatgtctytgatttttactgtaagaggggcatcrgccaactgaaatttctgttaaaagagccatgcttcatgcttcaagccaacttcctaggaccaaatttctcttagacccagaatgtgtagaaaaatgtctcaagaatcttgcttttgaagaaagggcctgcgagaagagaaattttaggctggctatttttcctgagtagttttatggatgcaggaggacatctggaggtgatgaggtcacattaattgaaagctcaggagtacatatgagcaaatgcttagaaacagtaccattccacaatgcccactaaatatcagtgcaatatttctaccatagaaatctatcattttaacctccaacccctgaaatgaaggttgaatttgctatttttgtcttgggtcacaagtaaatatactttatatatataagtatgaatatatatacacacatatatatgtatacatatgtgtgcatatataaatacacacatatatgagatatacaagtatacatatatagtgtgtatatatatgtacacatatatgtgtgtatatatatgtacacatatatgtgtgtatattagaatatatataacataaatatgtatatatatatwttctgacctgtataaacacagtggatcctgagcaccagtggcctgaaaggatatgggttgctgggacatgaagaacaaaagcaggatacgcagatgctgaacagcgaaagaggccrttagatgaacagaaaaccaggtctaacaaggacagcttttcttccataaatgagtacacaatatatggaaaaaactatttttacatattggagaacagataaactgagataatttakaaagggaatcaaatgagatcaacccaataactaccttggctttgttcctggagacttcctgggctgaagaacaaggagatggagcccaagccgaccacagcagtcttgctgaactgaggaaggagactggagttgggattactaaaacagctgagattttctaggctaggtaataacatgaaaggaaacattgtggaggaaagcagctccaggaatgtccatagaaaagtcctcaagtctttggctaaatagaaagctgcatatgcacagggagargttccagagagaaaataggataaagaacagctactggggaaagaaaaacygcaggggaacagtgagctcartggagatgccagagctcacatagcactgggggatatttgagttctgaccagcctgaggagagacctcgctgaacatcttgggcattcagtagtcaccacataaagccaaactttgggagtaggattagtgtattcctataataaaggycactccagaaacagcatagtaaagctgaaaagcaagtctaaaaaaatcaacacgatctccaagtaaattaactgattgccagaagaaaattcaaccctttagaggcaaacaacaaaatcaagttgctcagttatgtggcatccacaatgtgtgacctaaatttataactttaccagacatacaaaaagcatttactgtgatccataaccaggagaaaaagcactcaawacaaataaaccccaaaatgaagaaattggcaagaagatttgaaatatatatatatcayaattgtgttcamggatttaaataaaacatgaacatggaagaaacaaatggataatatcaaaaaagaaaaattataaaataaccaaatagaaattaaataactaaaaaagtgcatgtttaatgaaaaatgtactggctacccttaccatcaggttagacattacagaagaaaaagttaactagaaaataattcaatagaagtgatacaaactgcagcacacacatacaaagactgaaaagataaagaaacagagcctcaagaatatctatgaaaatatcaaaagatttcatatatgtgtaaagcaagtcacaagagaggaaagagatattgggacagaaaaaaatacttgaagcaacaagaaaaatcttattagaagccagaagaagaaaatatatgtttacacagaagaatagtggtaaaaatgactgatgccttctcgtcagaaactatgctggtcagaaacaatgaaataacacctttaaagtgatagaaaaaaataaaaaagattaacatagaatgttatatccagcaaaaatatcccttgaaagtgaatgttatataaatacatattctgcctcccccaaaataaataaaacactaagagaatatttcattactaggcttatataataaaagatgttctagaaatctattttggtagaagaaaaatagtgccagatgggaactttatactaagtaatgaagaaccctggaaatggcaaatgtaaaagattcatatttaatgccttaatttctttaaaagataattgatgggaggctgagtcgggcagatcatggggtcaggagtttgagaccagcctgaccaacatggtgaaaccccatctctactaaaaatacaaaaattagctgggcatggtggcacgtgcctgtaatcccagcaactcaggaggctgaggcaggagaatcacttgaacccaggaggtggaggttgcagtgagctgagatcgtgccattacggtccarcctgggtgacagagcgagactcaaaacaaacaaacaaacaaacaaacaaaaagataataatttactacttgaagcaaaatgatagcaatgtattgctactttaacatatgtaaaagtaaaaatttctaaataataataatcacataaataatgtaggaaataaatggtagtatactgttctaagtttcttgcattatccatgaagttatataatacacatggttgaaggtggtaagttaaagagggttattgcaaatcctagaacaactgaaaaaatttaaacttagaggaatagataataataagaatgttccatttatccaaaagaaggaaagaaaggaagaaaaaagaatgaagaagatatggcaaagagagaaaatacacagcattatggtacacttaaactgaactgaaartatatttaatatactcctaagcatattaaatataaagggattaaacattgcacagaaaaggcagagattrttaagctgaataaaaatcaaagcccaattatgttctttttactatacatgctctttaattgtaaagagctagtccaaaaaccaagtgtggaaaatgacrtatcatgaaaataagaatcagaagaaagctggagtggtaatgttaatcccaaagtaatctacaagaaataataccacgatgaaaaagttatttcttaagtaaaaaaagtttattcatcaagacttaacaatgctaaatgggttgcaccctcataagagcccttctgatatatgaagcaaacactgacagaactgaagagacaaacagataagcccacaattagagtgggagatatcctaatgtctctctccgtatggwtatacatcttcccaaacaaaatataatagaaaaaatacacaaaaaaatcagaaagaatatatatgttttaaaggaaattgtcaacctatttaacactatgccaaactgcagaatacacattcaagtatgcatggagcattccccaacatataccatatgtgtgggcctacagcaagtcttaatagattgaaaagaattaaaatgatacagagtctgtttttgagcaaaacagaattaaatgagatataaataacaaaaaaattgggaaattatcaaatatctgaaaatgaaacaacacatttccaawtacttcataagtcaaagaaggaatttagaaaagttttgaactgaataatagtaaaaatacaacatatcaaagttcgtatgatgcagcgaatgtttttagggttttataactttaaatgctttcagtagaaaatagaaacatgtaaaaatcaatgacttaagatggcatttctcaaagtatgctctggagaaacctgaagtctcttgagatcccttcagagacagtctatgaggttaaaacacctttaaatttaaaaaaaaaagattttatttgctatttcacttttatttcctgataagtgtacagtggagttttccagaggctacataatgtttgatcacattatctctctgatggctaataaaatgtgtgattgtctattatgtttaaaaacattctcagttttggatgcaataaatattcatagtatatattacaaaatgaaagctctttagggtccccaatactttttaagagttaaaggggtcttaagaccaaaaactttgagaactgttgatttaagataacttaaacatctagaaaaggagaagcaaataagatccaaggtaagtggaaggaaggaaagaatgaaaatctgtgaaatccagtgtataagaatatagacaaacaattgagtaaatctgtgaaacagaaagttggttcttttgaaagattcatgtaattgataaacctctgcctaaactgacgacaaaggagggagcaccaccgtcaacatcaggagtaaaaaaagggaagagtcattgctataggatctttttgatattaaagctaataaacaaatattgagagcaactttacgttaacaaattcaataacctagataatatggactaattccttagaaaaaaacaaataagcaaattggacactgaataaactgaatttctaaccaatctgatatctattaaagacaacatgtgtatataatctttaatatgttaatatatattaataaatcaataaacttcccacagagaacactctaagttcagatggcatcattagaaatkttattatttaaaaaaaatccaattcttcacgatctgttacagaaaatagaggagaagggaaatatttcttgactcaatttgtgagaaaaaaaaaaaaccctagttgtaaaaaagtagacwaggatattgtgagaaactatagcacattatgtattgtgaacataaatataaaaagatgtaacaaaattttaatcattaacatgatgaatatcccaaacaagtgaagcttctcttcaagaatgcaaggctggcttaacatttacaaaacaatccatgtaatccaacatgttaacagaataaaagtgataaatcatatgattatgtcaatagatgcagaagaaaatgtgacaaaatttaacacttatccatgataaaatgtcttagcaaactatgaatagactggaacttctttaacttgatcaaaggcatctacaaaagacctccagataacatcaacttaatggtgaaagattaatgttttctctctaagattgggaataagaaaaatatgtttgctctcagtacttctaatcagcaktttactacattggtcacaaccattgccataagacctgaaaacaaaacaaaaagagaggaaaaaaaggaaggaaagaaagaaagggcctaaagtttggagaggaagaattaaaactgcctgtattcacagaaagcttaattaacggatgcagaaagtcctaaagattaataattaaattttgcaagattggagaacacataagtatatacatgatcaatataataaaagtagttgtatttttatacactgccaatgatcaactggaaaataaaaatgtcagagcaataccactgacaatagtatcaaaaccacaagatatttagtgatacatttaacacaatatgcacaagaattatgtactgcatactaaaaaacattgttaaggaagraatcamaagatctaaataaagatatatcaygyttatatattaagagtcaatatcacttctcaccaaattgatctttggattcagcccatacccaattgttaaggaagaaattacaagatctaaataaagatatatcatgyttatatattaaaagagtcaatatcacttctcaccaaattgatctttggattcagcccatacccaaccagaatctcagcagtcgttttttttaaaaaatgtgaaaaaatgtatatgctagaatcacaaggacaatatttaaagagaagaaaaaagttggaggacttacttacccaaaggtaaagacctataaaggtacagtaaacaagatatgtggtattgggaaaaaaaagtatacagatatagaaatggatggtccagaaacagatccacatatacatgatcaatttagtttctaggtaggtgacaaggaaattcaacagggaaaaacatcttttccaaaatcattgtgaaacaatcggatatccatctagaaaacaaaaataaaaacaaattttgacttctactttccatcccaaattaatgtgcaaaagctcctagatctaaatgtaagagctaaaacttaagctgaaataaaacaattccaggaaaatatataatattttcacaaacttgaggaaggcaaaatttttttcaggcaggacccagaaaacactagctttraaagaaaataaattataatttgggctttcataaaatgaaaattatgttcatcaaaagtcattgttaagaaatcagtaggtaagtaacagactggaataaaaattctctccatccatatatctgacaaatggtttgtatctagagtataaacgtttctcccactcactaatcagaggacaaacaacctaattaaaatgggcaacagaattgaataggaaatttctcagggaacgatggacagatggacaataagcacctgaaaaaatgctcaacattttagccatcaaagatataagaattataaccatcacaagatgtcaccaacacttaatkggcatgggtatcattaagaagacacaacaataagtgctgtcactgatgtggagcgaggatgtgcagctctcgcatacgctggttaaagtacagtatgctggttttccataaagttaaataactatgagtctaccccaaaaaactgcaattctattcctgaatatttaccccatggaaatgaaaacagaagtccacaaagagatctacaagaatattcacagcagctctagttattataaccccaaactgtaaacaactacaaggtcaatcaatgagaaaatgaatcgataatttgtgatctattcatataatggaatattattaagcaattaaaatgaagaagtgactgatcctctcaaataggatggatggaactcaaaaatatattaaggaaaggaggcagatacataagtgtacattctgtatgagcccatttatatcaggtttgaggagaggtaaaactaatctttagtgaaggaaaccaatagtatttccctctggcagtgggaagagggtagcaggaattgaatgagcagtgacacagggtgtttctagagtaatggaagtgttctgtatcatatgggagtgtggtttacacaagtataggtgatcatcaaaactcaccaaacaacatttaagatctgtgcatttcacactatgtaaaagtatacctcaactgaagagagtggaaatctgtttcaaatgctcagccttttaacacatccagttgcttagactatgaacttcctcaaatggggtgtctgggcttgagattagatcacatgtgtagagtcgctagagagacaatgttgcattcccatggtacataatacatttcccgttttctcagacagccacaggtcatgaatgtgaggattctgagaggttggagcaacattcttgggaggcatgagggggagcacattctccaagatcccccccagcccgrggtcctcgcctgctttgactattactccgttgttttcggactcctccgtagctgcccgacctcttcagatcccatagtctccctttatatcttgagtcccactgttcttccaactcatcccccattccctcagacctggagtggcagtggccagcagaggatggattgagagcaggagaggatgtcctgcccaggaacccatcctagagaaatggcatcctgcctgggagctagtttcccagggtggctttgataygtcttgcagaaacaaacccacttgacacacctgatacggtattgacagtaacactatttttcgtggttgtttttcatagtaaaagtagatccctttagttacactgtgagtacttagagtaaggtgactggcctgggaatgataccatcttggatgtcattttmtccttggagaaatgtattttagttccaatgcacatttcacaatacagtcctatagagagaaatacagagagctagacagttagagatatacttttatgtgcataaaaatataaaatatgcactttaaaatctgtacctgttattcctgagaaatgtatttggcagaaggtgggagggggatattctgatccttttatttacatgtttatgtatgatctgagtttttatatggagcatatactacttttgattttttaaagaaaaattaaaatctgtctttgaaatgtacacagttgtttagaagttgaggaccatttttgtttgttacaacattattgtacctataatgggaatatttcaaagccacttgttaacactttgttagaacaaaatgtagagggtgctgggtgcccctgaatattctcccacctcttgtgacctgtattgttttggaatttccagtggcctgacaatgaactactgcaggaatccagatgccgataaaggcccctggtgttttaccacagaccccagcgtcaggtgggagtactgcaacctgaaaawatgctcaggaacagaagcgagtgttgtagcacctccgcctgttgtcctgcttccaratgtagagactccttcygaagaaggtaagaaatctgtggctggacatctacacrcttggacgctgggatgaaaagccatggaaaatctcactgatgcagaaaccttccatgctacacgagaaatcaagtgtttttagagggtctgccatgtrgaaggaagcctcagtgcactctctcaaggaggcagaggtgtgacttttggcacaacrtgagtgggctgtgcctttaggacaggtgcaaaccctccaaggtgctcaacttaaccactcaccttgttctaaaatgggttatctcagtatcccagtccaaattcgtattctrtcatgctgccatatgtgtgattctttccaagccagtaagcatctccagtaatttcttaaggtaggcagcgttcattgcagtcttcagcattgcagtttctgaggaatgtggcccctgattctgtcatcctagagaaacctgacatgactgtattgattccatatcatcctgggtctctgtggctcttcataatcatccattttttccctgtacagactgtatgtttgggaatgggaaaggataccgaggcaagagggygaccactgttactgggacgccatgccaggactgggctgcccaggagccccatagacacagcattttcactccagagacaaatccaygggcgggtctggaaaaaaatgtaagccactttgatttggactctttggccttttgctcaccaatctttgcaaacagaattggttctgtgttacagaaaatctgacctggactgctcttttttgtaatgggggagaggggacagaagaaaatattggaaaggcatcagggggctamgctagaatataattggccttagtatggaaagtacaagcagcacaggccaggaaacctccacacatgtgagggttctcaggcctcttccctttagtgacatttmtttaaagtttccattattggggactgtctctagtttctagtgtttgtatgctaggttccagtaatcaaagatgccctttatgaaatttaagtcagatttttcgagaaaaaatttggatgggccatcaggtcaccatgggacttcccttagcctcatgcattctctgckatggtttactttggggcctatgaatagggaagactgagatataggaaaaaccaaagtgtctgtgttcccccactctcacacccatgcagcataacacttctcacaccagatgtggggggatttctcctcacaccccaagcgagtctccagcagataccagctgggtgtcctacaaygtaactcagtgctgacactctatctggagacagygtcagatcccataagttaaggctcagtcccacaagaccgccccactgcagatgccaatcccaagttccaggcggtgacctgtacttctgcccaactggacaaaaatctgtttttctacttgattactttgctagagtggctcacagaactcaggggaacacgttacttttatttacccatttgttataaaagatattacaaaggatcctggtgaacagccagacagaagagatgcacggggcaaggcatgtgagaaggggctcagagtttccatgccctctccagtgcaccagcccccggtaccccaagtgttcagcaacccagaagctctccaagtgcagtcttgctgggtttttatggaggcttcattacagaggcacagttgaatacatcgttggccattggagaccagctcaccttcagctcctrttccctccctggaagttggacgtggggggctgaacagttccaaccctgcaatcacatggttggttcctttggcaaccagccccatcctgagactatccaagaacccaccaagagttgcttcattcaaacaaaagatgctcccttcactcaggaacccccaagggatttaggagctccgtgtcaggaactggggggcagagaccaaatatacgtttcttattctaccacagtgtcatatgaakgggargacaacactgcctttctgtgtcttgccccatagagggcgcacaatgcatggaaataaatgtttctgaatcaacagcaaacaggcttcatcgggtaggagagcgctgagccctccagggacaatgcacatcaatgatgtcccactgtcctttggtgctggggctctaaggcctccactgggtcaggctcctgaagggagacccattctccaaaracccccgagggtcaccactccctgtccaggggtgtggcctcatagctccttttgaacaggggcacaggaaggayggctttagagcattcaaaaaataactttgccaaaataataataataataatagaarggaagaagaggctgagcatggtggctcacacctgtaatccctacactttgggaggctgagacaagcagatcacctgaggtcaggagttcgagactagcctggccaaaatggygaaacctcatctctactgaaaatasaaaaaaaaattagccaggtgtggtggcrtgcacctgcagttgcagctactcaggaggctgaagcaggakaatcgcttgaacccaggagatggaggttgcagtgagctgagatcatgccactgcactccagcctgggcgacaagagcaaaactccacctcagaaaaaaaaaaaaaaaaaaaraaggaaggaaaaagaaacactcctttatgtcttctaaggatagacatgaaatgygtgagccttggaacaccttctccctctcctgccccacgtgagctggagcttacatgccttcttgttttcagtactgccrtaaccctgatggtgatgtaggtggtccctggtgctacacgacaaatccaagaaaactttacgactactgtgatgtccctcagtgtggtaggttgccttctttttggtaaggaaactgcttacttaatatggatttgcaacmaaaaaggaaaagggcttctgagcagactgcttctggggaggagatagctgccctctccatcagaccccactcttcatcatgggcatcttgaatctgccctactattggccacatttgttagaggaacacctgcccatcgccccaggcacacataaataaaataaatgtaaaattcccaaagagcaagcttagaggtaatctagtcagccccaggatggtcccactgaatgctgccatgtctagcgtgggatgcatgaaaaatttagagtcattcggatgaaaaactttccctttccacagctgagaagtaagaaagaaaatacaaacagcaggaaacaggtaagcatgtaacgcacattgtaaacctcagatggccatcctaggaattcaatgaaargtagtgcagctctttagccccagatggcctttcttataagtttactactcacaagtcacattagtgacatagcttagagactgcttgttgggttccatcctcattgctctgagactcttgttgggagtatgaggcttggatcaggggaaggggagttgacattagttcttaaagaattggaataacaaatccatgggtatttctgaaaaaaaaaaaaaraaaaagaaaggaagctacttggaattgtcccatatttaacattctgctgaccaatcaatttgtcctagttacagaaaaccaccctggacttctcctatgcataatttggttgcttgtggttgggtctgccatgtggagggaccttgagctgggggaaggagcttggcctccaagtccactgaagaccagcatcctgagattgcctgggaaggtggtacagggcagtgatgaagatcatgggagccacactgsccagcttcgcatttgggcttctcctagggacaccaagagggaggaaggaggggttaggatggtatgaaagattctacttggccaatattattgtaatgcggcattgtgatctctggatttagcatgagttgatagctgactttttctgcagaagcatcttggtggcacctctaactcaaagtccctcratggagtcagttccagttctccacttctggccccatctggtacacaccactgcctctcactgccygggctctctatccttgacaggctgccttgaagttgagcccagactgattttcttgcctcagaccccactaccgtgcctgggactcatgcacctttgactcccatggaagggaagtgcagtagtttcccaggtgcaattctggtgtcctcacccacattgaggatgtacaasaatcaggttcttagagattggagaaagaaggaagaatgggaacaagatttttcccaaaggactgtgaggtcccccacctaaccttgatgtgagacaagtgaggttaaccccaagcctggtgagaagcgttcccatcagacacttggaaatcctgaggactgtttcatgcagaaggatatggtttattcaggtttgactcgtgcttgagaaagctagagcctctggtggtgaatgattttaataactatttcctttccaccaacatatacagtacaaataataataagcaaaaataaatagaaacattcagttttgttttgaatagtaggagcagggtaccatcatttctgtagttactcttttagtacaacgatgcatgtctactgtatgtaaggcatactagcagaaattgagctcagcactagagaagatgattgcattctatgccttgcttcttttttwaaaaaaaggcttccatagatagattctcagaacagcccatggcaaatgtaaagttatttggaaaacccaggttccagattcactagagcatagaatctctggttggttgggaaggaatttcctcttacagttgttactaataaytgtatgaacaattatttaaaatattaacatttacatttgtgaagaccttgaagggctggagacaacagagaagcatttttgaataccctctgcagcycctgcactgttgtaggcattggtggatggtaccaaagatgggacactgtccctacctccagagaccctgtgggctggctacagagagaaggcagggaggaggaaaagaagaataaagtcatatgtttaagtcacccccayggccgttggttagtcatgggaggctccccagaggagctgtcctgaagctggctgacagaaggcaacatttcaacttaggacagtaatccttgctacatacaatcacatacacacacacacacacgtgcacacacagagactcacatggaaaaataaacctttgtgcctttcagcagtgatgacaattatggttttcagtaaactttacatggtttagatggtgatggtgatgatgatgattatgggaaggatggcatcatgttctaaacatactgcatggagtcagaataacaatgacaaataaccatttgtcccaatcaaggttttctcagaaaatatctcattctgatgctaaactataccagtctgtttgatcacttctccaacaaaataattacaaagtgcttatattttcttgaaaagagagggtcctgtgttgtctactaccacttttgaaacttagagaaaatgttccaaaagatgatgattttactatttagttcggcctttaagatgtcaaaaactcagtgcttggaatttgtctcgaattacaccacaaaattgctaccttgtctcaaatgggatttctttcccaccttgtgccacagcggccccttcatttgattgtgggaagcctcaagtggagccgaagaaatgtcctggaagggttgtaggggggtgtgtggcccacccacattcctggccctggcaagtcagtcttagaacaaggtaagaacaggcccagaaacgatttatactgtccctccacgtaagccctgcaaaacccttctacatttacataaaatccacacagctgaggcatcagyacctgcctctaagttttctgaaggaggaaaaaagctacaaaaattaatatatgtatatatacayatatatttttataggttctctactgtgaaaatgacaaaaattgctgtctttttcttgatctgggcagytccatcaaaatctgtaggcacagtgatttgcaccaagttccaatattgctggaaaatactgaagatgctctgaggatttctatggatatccattgtctcattgtcagatgaaaagagggggaagtttttagaaatgtgacactttctgggttgggagagcaaggacaaaattatctccagtctatcacaggcacagattctttttctttggacactttcgtgaatcaytgaattcaatgcagaggctactcatccattcgcaaacaaaaaaattctaggtcatgatccccataaatgaagagtgatcagtccaatcccagggaacctggacattttgggtattgtttcagtggaacatgcctttcataagttccattttcttgggtatctcttaggaagcaagcataggaaacaggcccatccgtctgcctgttttgcttcctcatctcacttctacacragggygcctgtgctcaattgctgttttcccctaaagagactcttttccataagtttgtgaaatgccatcgacaaacctgatcgcattgcatttcactctgctgttgagtcgatttttctttattttatcatttagtaactccttgctctacagagctttcaccttccacatatttcagattcattctttcctaaactatgtggtggtctacgtcctcactgacttatcaacatgctaccatcatgcacttcctatctctattcctcttcwttaaatttggttccaartggctcacaccattattctgagctattacctgcctacgcagtcctagaaagtaagtgattcaggaaacattccccaaaagtaaagtttctcaggtaagatcagaagactcccatgagtcactgctgctcaggatcacatctggctccttgaagagtgattcatcagaccttacatagatcttgtcataaaaatgaaagaggcctcgggggaaggtcttgggctggtggcttctgttggagtcctgggctgtggggtgaaagccgtggctgtagagcttcatgcggagttacttagctttgctctcctgtggacaggccatgcctgtgcctcccccaagcatcggaaaaaktggcatagatgggcccttctcaaaaatcccactcctggagcactggccaaaattacyaccatcctgatgctgggcttgcagtcctttcctttgggaatatgaacatggtcaaaattaagtgaacgtgtctttctggctttctgtacaatggagcagaacaaagtatcaatttaactaaaatttgaactaaatcctctttccaggtttggaatgcacttctgtggaggcaccttgatatccccagagtgggtgytgactrctgcccactgcttggagaagtatgtttaggggamaattgacatgaagtcttgtcttaaatactttttctgtccttcttttcctcctttcctcctttcctttctcactcttcctcccttccttctctggctgtgacactagggaccaggccagggcaattggataagagagaagggaagggtttctagaaagaaactgcagaggaaagacacagtacagatgattttgtgggcctgaataaactgcagaacagagctgttcactaccataggctgtatcagtctctgcccaaacagcccaagaacattccttaactgcctgtttcaagcaaatcatgaattttgcttcttgccactcagaagtcactaattctgagtggccaagggtgtcagggagacagcaccaatttcatggcacagaggttacctgaaggggctggaccatattttcctcttgacrtcctcatcttttctaggtccccaaggccttcatcctacaaggtcatcctgggtgcacaccaagaagtgaatctcgaaccrcatgttcaggaaatagaagtgtctaggctgttcttggagcccacacgaaaagatattgccttgctaaagctaagcaggtactcgttcacctgtggtcttcaccccacgctggtgaagatatttgctttatgtctgggttttatgggccatggccactgcatggcagtggggaggaactgtctatcacatgaaaggctcaagggctttggggacagcatcaatcttcaaccctagccctgccacatgctagctgtgctcttgagaaaggcagcaggactccgttttctcatgtggaaaaagagttgaaatgaggtactctgttactcctagaactcacttaaygttcaccagttcatacacattcatgatcagagaayrattcagttattccaggctgacaattcccccttcatcataatatgtttaagagaatcatataagactatatttgtttcaaagcactttaaaaaccacaasatcragttgggtgtctggtgtgggtgcctgtaatcccagctacttgggaggctgaggcaggagggtcacttgagtcccggagtttgaggctgcagtgagttatgatcgtgtcactgcaycagcctgggcgacagagtaagacactgtaccaaaaaaaaaaacaccaaaaaaacaaaaaacaaacaaaaaaaaaacaacttcacaatgtcaaaaaaatcacaaatacagtttataaatgtaaattatattattattattgtcttctttgatttgattttctctttcctgttgaaatgttgtttcactaagcctgacaaagtgaaacatttgcttatgtcactcatttagtgctgtttggagccagatactagttgagtcagctaagaaacagctatttgtaggagaagcaggtttgggacaggtgacaaggcacgcagggcrctcgctgtgctggtggttctggaagacagggtgtcagtgtggacagggatgagcatggcctggatgagaaggcacggggcaggagcctgagctgctctcctgggcctggccacaagcccagggcagcttctctgrgtctgtgaactgaggggtgatgtcctgggatgctctgacactctagaaggagagaagagcctttccagctcagcctttataaacagtagctgatctccctcctgctccccagtgtcctccccgccatcccagcaaaygtgcaaatagaaggtccccgttcctcatgatcctcagagagctggggtgttctgatggcttgaacaagtaatttggaaattttgggttttggaggagttctctgataggctgatacatttcgagtttagagttcccaccycacatccccacaccccgagtctagggcatttagtgctccaccagggaacctgtagagtgaggamgtctgcatgacaggctgggccttytgatgatgctcagaagcagaaagtgtgcctgcttcaaagttggtgacgatgatgtttyttgatcagaatagggcatttyttatttccaatcctttatcctcttgaacttactaaagtagaatcaggtctaaaaaccggagttctaatgtttgagagtccctgggactctaaagtatatgaatgttctttgaaaacaaataccattttgttcaagcaaaaggcttatttccaatcctctttcatttggtatcaagtattttactggattcttacaactatggcgtagtaacattcactgaggaggaaatggaggatccaagsatggagcaagttgctctgggcacacaacacatttgcaattttacagcctcttggtggcatctcagtcagacattccatgcactgatcaatgccctattcgattaatgtaaaaggacacactcagcatgagattccagttgtgcacagaatatacatgagaagtgcgcctttgtcatccctactttcaaaggtgaaggccaccagcagtatcttgcatgcaactgatgcctttcaaatgaaaccttacatctgcatagtccatagacaaccacaggcaaatgtgagggtgaaactctgtgttctacgytgctctgtgtcagtgaagcaaggcagtgccagttcagagggctctggggcctcaagacagggatgactggttgtgggtrctgcagctgcgagcagagcagtcaaacataactgctgatgcttttctttcagtcctgccgtcatcactgacaaagtaatcccagcttgtctgccatccccaaattatgtggtcrcygaccggaccgaatgtttcatcactggctggggagaaacccaaggtgagataaattccattgcccacataacraattggttttgacctacagtccatgtgacaaaatgatcattttggagaaagctgtgcaaattcctatccatgaawrtggtccaccccactcctgattttgcctgggcacctgtctatgtcttaatcagtcttcaaggcacatgatcaaagggaggaaaactgtgtctttgagtctctctctctctctctgttttcagaacatttttatttcaattaattaatttttaacttttattttaggttcaggggtacatgtgcaagtttcttgtatatgtaaacagtggtttgtcatrcagattattttgtcacctaggtactaaccctagtacccaattcttagtatttcctgctcctctccctcctcccactcttctccctcaagtaggccccagtgtctgttgctctcttctttgtgtccatgagttctcatcacttagctcccacttataactgtgaacatgtggtatttggttttctgttcctgtgttagttttctaagaataacggcctccagctccattcatgttcctgtaaaagatattacctcattctttcttatggctaaacagtattccatggtgtatatgtaccacatwttcttcatccaatgtgtcattgatggtcatataggtgattccatgtctttgctactgtgaatagtgctgcaatgaacattcatgtgcatgtgtctttagggtagaatgatttatattcctctaggtatatcgccagtagtaggattgctgggttgaaagttagttctgcttttakctctttgagaatcaccatactgctttctacagtggatgaactaatttacagtcccaccagctgttagtgttctcttttctctgcaaccttgccagcatctgttattttttgactttttaggaagccattctggctggtgtgagatgatttttcattgtggttttgatttgcatttctctaacgatcagtgatattgagctttttttcatatgtttgttggccacaggcatgtcttctttagaaaagtgtgttagtgtcccctgtccattttttaatggggttttttttttcttgtaaatttgtttaagttcctcatagatgctggatattagacctttttcaggtgcatagtttgcaaatattttctcctgttctctaggttttccctttactcccttgagagtttctttttctgtccagaagctcttaagtttaattagatcccatttgtcaatttttgcctttgttgagattgcttttggcatcttcatgaaatttttgcccgttcctatgtccaggatggtrttrcctaggttgtcttccaggatttttgtacttttggattttacatttaagtctttaatccatcttgagttgatttctgtatatggtgtaaggaaaggggtccagtttccatcttctacatatggctagccagttaccccagcaccatttattgaatagggagttattttcccattgcttgtttttgtcagctttgttaaaaatcaratgtctgtaggtgtgtggccttatttctgggctctctattctgttccactggtctacgtgtcttttttttttttttttaccagtaccatgctgtttttgttactgtagccctgaagtatagtttgaagccaggtaatgtgatgtctccagctttgttctttttgtttaggattgccttggctattctggctcctttttggttmtatataaatttttgaagtagttttttaatagtgctgtgaagaatatcattggcagtttgataggaatagcaatgaatctgtaaattactttgggcagtatggccattttaatgatattgattcttccaatccatgagcatgggatgtttttccattcatttgtgtcatctctgatttctttgagcagtgttttgtaattcttattgtagagatctttacctctctggttagctgtattcttacatattttattctttttgtggcatttgtgaatgggactgtgttcctgatttgcctctgggcttggctgttgttggtgtaaagggatgctagtgatttttgtacattgattttatatcctgaaactttgctggagttgattatcagctgaaggagcttttgggctgagactatggggttttctagacatagagtcatgtcatctgccaacagggatcgtttgatttcctctcttcctatctggatgccctttatttctttctcttgcctgattgctctgaccagggcttccaatactatgttgaataggagtggtgaaagagggcatccttatcttgtgccagttttcaaggggaatgcttccagcttttgcccatttagtatgatgttggctgtggacttgtcatagctgtctcttattattttgagatatattccttcagtacctagtttattgagagttttcaatataaaggatggtaaattttatcaaaatccttttctgcatctattgagataatcatgtgggttttctctttagttatatttatgtgatgaatcacatttattgatttatgtatgttgaaccaagcttacattctggggataaagcctacttgatcacgatggattggcttttttatgtgctgctggatttggtttgcaagtattttgtaaaggatttttgcatcagtgttcatcaaggatattggcctgaagttttttgttgtttttgtgtctctgccaggttttggtatcaggatgatgctgacctcatagaatgaattggagaggagaccctcctcctcagtttttttgaacggtttcagtaggaatggtcatagctcttctttgtacatctggtggaattcagctgtgaatctatctggtcctgggcttttgttggttagtaggctatttattactgattcaattttggagctcattattgttctgttcagggaatcaatttcttcctggttcagtcttgggagggtgtatgtgtccaggaatttatccatctcttttaggttttctagtttgtgtgcatggagctgtttgtagtagtttctgatggttatttttatttttgtggcatcagtgctaacatcccctttgtcatttctaattgtgtttattttggtcttatcttccttttcttcattagcctagctagcagcctacctatcttattactgttttcaaaaaaccaactactggacttgttgatcttttgaatgaattttcatgtcttgactttcttcagttcagctctgattttggttatttcttgccatctgctagctttggggttgatttgctcttgtttctctaattttttccattgtgatgttaggttcttaatttgagatctttcttcttgatgctagcatttggtgctatgaatttctctcttaacactaccttagctctgtccaagagattctggtatgttgtatctttattctcattagttcaaagaacttcctgatttctgccataatttcattattcacccaaaagtcattcaggagcatgttgtttgatttccatgtaattgtacggttttgagttattttcttagtcttgactggtatttcattgtgctgtggtctgagagtgtgtttggtatgattttggttctttggcacttgctgaagattgttttatgtccaattatgtggttgatttttagagtatgtgccacatggtgatgaaaatgtacattcagttgttttgggaaagagagttgtgtagaggtctatcagatccatttggtccaatgctgagttcaggtcctgaatatctttgttaattttgtgcctcgatgatctgtctaatactgtcagtggagtactgaagtctcccactattattttgtgggcgtctaagtctctttgtaggtctctaagaactttatgaagctgggtgctcttgtgttgggttcacatgtatttaggatagtagatcttctttttgaattgaaccctttaccattatgtaatgcccttctttgtcttttttggtctttgttggtttaaagtctgttttgtctgaaattaggatggcaaccyttgcttttttgtctgatttccatttgcttggtaggttctcctccatccctttattctgagcctatgggtgtcattacatgtgagatgggtctcttgaaggtagcataccagtgggtcttgctttttatccagcttgccactctgtgcctcttaagttggrcatttagcccatttacattcaaggttagtattgctatgtgtgaatttgatgccctcattgtgttgttatgctggcttgtttgtgtgatggttttatagtgtcattggtctgcgtatttaagtatatttttgtattggctggtagccatcttgctatagttagtgcttctttcaagatctcttgtaaggcagttctggtggtaaccaactccctcaacatttgcttagctgaaaatgatcttatttctctgttgcttaggaagcttagtttggctggatatgaaattcttgggtggatattttttaagaatattgaatataggccccaatatcttctagcttgtacgggttcagttgagaggtatgctgttagattgatggggttccctttgtagacgacctgtcctttctctctagctgcctttaacattctgtctttcattttgaccttggaaaatctgatgattatgtgtcttgaggatgatcttcttgtatagaatctcacaggggttctctgtattttctaaatttgactattggcctctctagcaaggttgaagaagttttcatggacaatatcctgaaatgttttctaaattgtttactttctccccatccctttcagaaatgccagtgatttgtagatttggcctttttacataatcccatgtttcttggaggctttgttcattccttttcattcttttttcttaatttttgtcaactgtcttatttcagaaagccagtcttccatttctgagattctttcctcagcttggtttattttgctrttaatacttggattgctttgtgaaattcttacagtttgtttctcagctctcagctctgtcagatccattaggttcttttttaaaccagtgattttgtctttcagcttctatatcattttattgtgatcctcaatttccttggattggattttgccatcctcctggatcttgatgatcttcattcctatccatagtctgaattccagttctatcatttcagccagctcagccttgttaagaacccttgttagagaactagtgtggttgtttggaggacatatggcactccggcctttatgttcctttaactgcagtgtaggttgaatacagccaatagacttgttctttggatgtttttacagggccaaagccttgtgcagggtctttatttgtagttgatttcttgtctttggtttcatagtgtggtatgttagcaaggtatttttggtgttgaagctttggggtgtgatccattttttatttgtatatttccctacacctaaaacaagcaaaaaaacagtaaaggtctttgagtctcttaatccataatttcagcattcctragtatgcttccctgggtaagtggggttttcacccagccctcaagttaagagtgttagattatttttcatgtgaaattagccagactggctttcttaacacaatgtaaaacaataacaacaaaagttataattagactagtcttcttcccaaatacccacatgtctaatgtaagtgggatggtgttaaacaggggacctacaactgggggagaggcggacaggtcccatggccccaggtctaggatggcatttggtattggttgatgggtgtggatgagaacaagagagggaacayttgtgcaggatatggtatcagcacctgtaatacattttagggattctttcttctctttgcagtatgccctgacaataattatatccatcagcctagtccccttggccattgaaacactaagactgtcttaggatccctgctscagtttctcagaggtgctaggagggcattaggagtctgaagccctggaagtgtgttctgactttgccactagctagatagacctggactaggcacrttacctctttgtaccactcagctctaacccctcattcaaaaacccagcattttcaagtggtgtttttcacatcagcctttgcataagttttcatttgaagaaaggtttttttgtttttgttttcttggtttaatcaaacatttaaaaacgaatggtctagatgatttcaaagtggctttccttttcctgtgcttttcctactatttaaaaacttyacctccttgatttcttgatctccctttctgcactgctgggtctgggagcattgaggccaagtaaaaggaaccttggcaaaggaggaacacctatgggtgtgccaggctgctcccagtgttttgcatttttaaaaatttaaatgctgcaaacctctatgaattacatattattgttcctagtttacaaatgaggagcctgagkctcagagaatgtgtgggatggtacagactaacctgaattagaaccctggctcccatttactggctgtcaggacttagaaaagtcataaactctctggctgggtgcagtggctcacgcctgtaatcccagcactttgggaggccgaggcaggcagaccacgaggtcaggagcttgagacgagcctgaccaacacggtgaaaccccgtctctactaaaaatacaaaaattagccgggtgtggtagcacacccctgtaatcccagctactcaggaggctgaggcaggagaatcgcttcaacctgggaggtggaggttgcagtgagccaagattgtgccactgcactccagcctgggtgacagagtgagactctatgtgagaaagaaagaaagaargaaagaargaaagaaggaagaaaagaragagaaagaaagaaagaaagaaagaaagagrgagagagagagaragaaagaaagraagaaagaaagaaagaaagaaagaamgaaagaaagaaagaaagaagggaaagaaagaaagagaacgaaagaaagaagggagggagggagggagggagggaggaagggtgggtgggttgtgaactcttgttgattgtttcctcagctgaaatgtgggctgcagggctattgggggagaaacaataagaaagtgcaccaagcaccaagcacatgctaagaagtccatcatggcagctcctgataataatatggaatagagttgtatctaacatgactctttcttgcaagtgacagaaaatgcaacttaagttggattaagcaaaaaagagaaatyattagtgaactgaaaattctgcaggctcacatcatggccccagaccctgtccattattcttgggcacaaatgtgayattctcgtggcygcagatgctgtggtggctctggctctgccaggaaaagaaataaggaaggccactctccccattacacaaacaatagtcttccagctctgagaggtcgaacttgtgtcaccagcctgcccctaaacccgtcactgattaactccaacctgcatcagctgttccatgmtggaggtggacgcaggaccacactcataccaagatgggggcaaagtgtagttccctcaacaggattataggatatagtgtgataggctgctgggcagccaaaaagcaaacagatcctctacaattcctcaactgatgaaagcacgaagctaaaatcataaagatctgtgtgtgagttctggctctcccatcttccttgtgagattgagcagttagttaatctcttttagcctcagctttctcacctgtaccaacatataaggtcattgtgaggattaagattatgcctcatgatcatcattatcatcatcaccatccacattgcaaccacaactaccatcatcatccccaccaacatcatcaccaccaccaccatcacaattatcattaccaccaccaccattgtcaccctcaacatcaccatcatcactatcaccaccaccatcatcatcactaccactaccaacaccatcactctcatcattccaccaccatcaccattaacattaccatcactatcatcaccaccaccaccaccacccccatcattactgccatcaacatcaccatcaccatcatcaccaccatcaccatcattatcaaccatcatcaccaccattccaccaccatcaccattatcatcactaccattatcaccaccaccatcatcaccaccaccactaccaccaccatcaccaccatcatcaccataaccatcatcaccactatcaacatgatagtaattatgattaccaccaccattagcattatcattaccaccaccagtaccatcaccatcaccaccgccaccacctccatgatcattactacccaccaccrtcaccgtcaccatcatttcactaccagcacaattatcattaccaccaccatcactaccacccttatcacaaccctcatcatcaccaccattccaccactgccaccaccaccaccaccatcactatcattaacaatagacatcacataaccagtttgtagctggaccttgagcccagagcccactcactgtttcttcagtcccaccgccaaccaccaggatgagtcacaaaacataactcaggcctgctcctcaattttctacatgtcaataatgacattgaagcaatgggtgttctctgcttctcagagggaagttgaaattctcctgctcttcccttcatgtttccagatgttccctgacttggatattccaaacgcagagtttggaggtgttgaggccaaggggtttttccaggtcagccatcatctgcaatcactgagctgatcctgctgctggactttccctgttgccctctccccaacgccccatcggggagggcttcaatcctcaggtcacctgtggcctttctgccctcagaggtgccatctctacatctaccactggaaggcagcacctactcacagattgcatcaatttcccagcaactcatggtgggttttcccccttatcagcgtgtttgccttgctcagagagcagatcccagagcagtgacacctaacttaattttcagcaaaacattttgagaagggtgctccctcacacaactacacagtccaggtgatgcacccactgcccaatgcttggtagtcaagaggagcttcctccctgcagctctgcccagatagggctgagctgggctctggagcsaggcgctgggatgagccwcttccatgctgctcatgtaaactccagattcagtgtcggttttctgaacccgagacaatgatctaaatgcagtcgaaggctttggggaaagagagagtgcctcggttcttacctgtgtcatgctcgcaaagcaaagagttttgcaaaattttaatgaaacctgggcttgcaaaattggaaaactagattatttgtgacgacactgagacatccctgggcatgtctatctggaaaaayggcattttctctggcaattttgcagacattctatttcaatttggcaaagaaaataaagcagtttttcacaaaggcagaaatacaactagaatgttcactctccctaattgtcaaagaagtgtaaattagaaaatgaatcaggacaatttcaacctattagattagctaatattttaaaaattgaagactcatacaagtgaggtgaagtgattgttttctagtggcacggtacactgtcacacccttttagaaaataatttggcaacgttattgggagacagaaatatgtctatgtaatttatgggaacttagactcagaaaatgttaaggaataagaatgaactttatgaacaaagatgtggaaagctggaagcaagagtggggccaacacgcatggggaggaagcatttgggcagtgactccacagacccaggctcaggctgaactacacaacctccttacgcctcagtttccttaacagtagaacagaaatgataaaagtgcctgtttcacaggactattgcgaggattaagtgagatacatcgcattataagcttgtgtctggaaaggttaattcttggtaaatgatgactattcttttttattgcaataaaatatacaaaacataaggtttactattttaaccattttggaaggtaccactgagtggcatttagtacattcacaatcatgtgcaaccatcatcatatttccagaacattttcctcattcccaaaggaaacctcatgttcattaagcagtagctccccttaacatattagttatgaagatcatagcattatacaaaactcmtgacacaatgatgagtgaaaaaatcaagatgtgaaattttgtgttatgatgtaattagtaaaagaagcatattaaaacatctgaaaaaagagtatataaaaatagcaattgcatttttcagactctacattttaaacattattctttatagttttaaaagcaaaaagtaaagaaacaacaaccaaccccaaaccaacacgacaaagccsagattgttaattccagggctcaggaacacagaatcatatatgatgtttacactctgcagggtcagagactccagcggcattgggagctgcctcgtgttctgcagcctcacagacaggaggtccagtgccgctgctctgttctggaatatsctcctgaatgtgttttgggtgcagttgccatttctttcatctttttaaacacaggtacttttggagctggccttctcaaggaagcccagctccctgtgattgagaataaagtgtgcaatcgctatgagtttctgaatggaagagtccaatccaccgaactctgtgctgggcatttggccggaggcacygacagttgccaggtaagcaaagatcaagagaccaaagttagtcttgtgctctcttgtctcagtctcagyccctcagacttcattccccaggtggcaaattcaaggattttcaaccgaagaccccagtctaagtgttgtttagaaacttcctagatctgtccctgaatgcgtattcagatcatctaaggggatgtcttggggcttgagttccaaatcagtagcaagcgagttttaagtgccataactacctcaggccactcaccctcctggggtgtgctggtggccagggactaaagtggtgacttttccggtagggaaggaggtagaggrtacaggacagagaccaactgcacacactttacactgatgcccaggctagcccagtctaaaggaaacaccaacataggaagggatgtgtgcaggattcacaaaagatcttttctacccsccggaaaaactaagtggtgtggtttcgctaaacagattttgctaagtacttaagcactgcagatgcttgagtaatatgctcataagttcctttctgatttsaattactgggaaaatgtayatatggatagtagaaggatggcatcccataataaaaggcaggcagcctaaccctcacatgcatttttctctccctctgtatagggtgacagtggaggkcctctggtttgcttcgagaaggacaaatacattttacaaggagtcacttcttggggtcttggctgtgcacgccccaataagccyggtgtctatgttcgtgtttcaaggtttgttacttggattgagggagtgatgagaaataattaattggacgggagacagagtgacgcactgactcacctagaggctggracgtgggtagggatttagcatgctggaaataactggcagtaatcaaacgaagacactgtccccagctaccagctacgccaaacctcggcattttttgtgttattttctgactgctggattctgtagtaaggtgacatagctatgacatttgttaaaaataaactctgtacttaactttgatttgagtaaattttggttttggtcttcaacattttcatgctctttgttcaccccaccaattttaaatgggcagatggggggatttagctgcttttgataaggaacagctgcacaaaggactgagcaggctgcaaggtcacagaggggagagccaagaagttgtccacgcatttacctcatcagctaacgagggcttgacatgcatttttactgtctttattcctgacactgagatgaatgttttcaaagctgcaacatgyatggggagtcatgcraaccgattctgttattgggaatgaaatctgtcaccgactgcttgacttgagcccaggggacacrgagcagagagctgtatatgatggagtgaacckgtccatggatgtgtaacacaagaccaactgagagtctgaatgttattctggggcacacgtgagtctaggattggtgccaagagcatgtaaatgaacaacaagcaaatattgaaggtggaccacttatttcccattgctaattgcctgcccggttttgaaacagtctgcagtacacacrgtsacrggagaatgacctgtgggagagatacatgtttagaaggaagagaaaggacaaaggcacaygttttaccatttaaaatattgttaccaaacaaaaatatccattcaaaatacaatttaacaatgcaacagtyatcttacagcagagaaatgcagagaaaagcaaaactgcaagtgactgtgaataaagggtgaatgtagtctcaaatcctcaaagagctgtgtttatttcattgacaaatagattatttgtattcaattctgatgtgctttaaggatgaagtttctcattttacaattagcacacacttcgtatatgttgtcacctgttctccttacacaaatgttgttccccattttgaaggattccctttggtaccagttttgcctgtccacataaagtatttcatttaaaaagctcagcataaaatatagactgcatctgaaaagatattgaatataatatacatagcagaacacacacgttccacatttcaaaagcctcgataacaaaaaagaaagatcaaagcccttattagtcgctgtaaagccatttataaagctcctgctgatcctgttaagcatggatataattgacctttcttttaaattaaaatgtaagcttttccccaagacaactcaaagtgccaagactgaatgggaactgtccatgtttctaactcttggccacgggcaccatcagaactgaacttaacaaatatatgaaaaatatctcttcatttttaaaatcctaagacccagaaatcataatccatgggatttgtttagtaaagaagaaaatctgtggctctaggtgtccactaaaggagagccaaaaatgtcccgaatartctcaggaccacagcatcattttatgaataacagaaccaagacctcakattgtacaacagattggttcttattgctggaatggggcataaaccatgcctggaaccccagatgctacagagaaggtagatgggagagacttctgacctgttcatgttgcaaaggcgtgcggagaccaaggtgagcagaggacacgaatgctcacattctgtggcccaggaacctgtgattcaatctcctcattaacaggattcccaaattttcatcctccctgcaatttttcaaatgctcggttatgggcttagtcccttgactgatcagatttgatgaacatttctgcacaaatttcccaaatccttggttttcaaatcctgcattcttgatggagctgttatgagaatcgggtggggggcttctctcgtctctctttagcctaatgaatcagagaccaggaagagccatgcacctgagaggctcttttttaagccagctacatattatgtgttcccagaaacttcaacagcactacaaataatmctaactcatccaacattatataaaaatactctggatagattgaggtctttatacagtattacaacagtgtggcataatgtagctgaaatgcacacgtgcatctctgcaaggacagctttgcaaggaggatcagctcctggatagctccttccttccctctgtcaggggcctcaaaggtgagagctggaaactggagtttttttattcctgccacacttataggaatgtggactgaaaaaacaaaggagaaaggagaaagtcttcgtgaaagattatgcaactagttagaggaaggtcttctgttattatttaatagcatagctggttttgatcaaatacacatacctaacttctgatgaaaacccaactcaaaggtaacaaaaatcacttcaggctaattttttgacttgctttcagaccctagacagaggttagttagcattacagtatttaagctctttatgaatttctgctgaattaacatatgtttggaaatcagctgctgatgtgaacccagcagaaatgatagaataatccagtgcagttttagaagggaatatactaacaggtttcagtaatttagcacgaactagtttttttagagtaaataaccatggatcacaatcaatgtgcttaatttgtagtacagtaaaccatacttctagattttttcaagtgtggggactaggtataattaatctatccaacttttcattatgaaaatttataaacagaaaaaaattagaatttgtgtaacttaaatttttgttggtagaattcctcatgtttatatattagttggatattgattttccttgctccccattgggacaatcctgcaccaccccaccacccttcaccagccaaaaacaatctctcccagttgtttaattttaatgcagctgatgtggtagaagagtcctggtctcaaaggactccctcttcctccatttcttcctgatgagtttgcaaatctgactrattctgattgaatcaagaatgaatgcatcactctcagtgtgtaaacaggcagcagtcaatggagtagaatcaaagggaagaaagattttcctcaggatttttgaaatattaaaaaacattagagttccatatccttaatttccagttcattatcaagattgctttttattttttaagttagcagttaaatcatttttaaagattacgcaaaaaaacaagactatgtgttctatttaaaaaaaaaaaatcaaacagtacagaagtctctgacaggaaagtgatggccctcccttcgctacccatctccccagcccatttgtgtccccagatattgttttacatcttttactgtaattctcatattcatatctctgtcttttttagtgaaaaatgtcaaacagaaacttataaagatttcagtaatgttaatttttgttgatataactcttcatgttcatatattggctggatattagctttccttgtacactatttgcctccaaaactcaatctctctttcttttctctgtctacttacctctattacctatctatcatctattatctatttatccattcatcaatccttctacccattatctatcmtctgtgtctatctatctatctatctatctatctatctatctatctatcatctatcatccatctacctattatctgcctatctaccatttgtgtgtcatctgtcttcctatccagctacagagagggactgcctttggttttagttttttataaatactctaacacattgttgagtgatgtttcactttgtaatcagtcttgaaaacctgcctatgccattccatctagacagacctgacgtcagcctcctcactctgtagagtaagccacactgttaatcccctgctgctgcacgtcccagcgatttccactttcccacgtcagcagttcctgcctttagatcacttctgagtcttagcaccttacatggaaatgcttctctcttcacaatcatgtttaaaaaataatgaatattcttatctagctttggtgggattttttacattaatattttatgtttactttgaattttttgcttacgatgtaagatgaggatttattgttattttttccccatgcatgttcaattttctcaacatcttcctttctccagtggtttgaaatgctgcttttatttagggtgcattgaattttggacaatgcctgccaagtttttctacatcatccactgtttctggcaaggcaatacccgtgatttcaggcaaaagcatcacgaggccaccacagatggatgccagggtacctacggaataggggagaggtgttactgcccccaggaacacacagctgggccttcccccacaggcctcctcactgtgaagccaccgtgttactcactggagtggctctcaaccacagcaacctctacaccccagatcactgccttggctctccttcaccatgatttcaaatgttctctcccttcctcaaaccctgagctatggcccctgtacacctggcagccatgggttctctcacacatctcacagtgattgactgagtgccttctcggggtccaacacccaaggcctcccctcctgcatcacagggaaacagaagtgctggaggggagtcccctctgcacctgctcactgacactctcacttacctgctcctctccctcccattccacctgtcaccttacactggaagaattgtcttggtgtctaccccagggccagtgctcacctaggcttgtctttttgggtgcctcactatggtgattaaccctttctccagtatctttaacctattgggagaagctttcaaacacattaagatctttcttgtttgaccagccttctctcattctcacctcatccttccattaccatcctttcttttactgttctttagagccaaagttcttgaaaagccaccctctcctattttctccacttatttgtatccaagtggtgtgctagtaaatgcctaacaactggctttggacaatcaagccctgattggcagcatctgccaatgtgcacggtgtaaatgctcccactgtgggcccttcagtctactgacacaacatccctgcctgtgccactaggaagagatgcaggagccccatcaatgtggcttccaccataaagacgcagcagacacaatctcaggaacacaggtaatactgaagatgtagtagatgaactagaaactgatgaatgttgagastaaaatcagttcctactttaaatgcatagacattaatgtaacacaacaagaaacatgaaaaaacaaggaggtaaaataaaacaccatcaaaggacacaataatttcccagtagctggtcccatagaaataaagatatattaacaacctgacaaagatttcaaaataattatttgaagaaagcttggtaaacttcaagaaaatacagagaattcaataaaatcagaaaaacaataaaagaccaaaatgagaaatgtaatggagagattaaaactgtttaaaaagtcaaacagaatttctgaaactggaaaaataattaagtgaaaaatgcaatagacagcatcaaaagcagaattcatcatgtagaataaataatctgtgaacttgaagacaggttatttgtgaatatagaatcgaagaagaaaaaatagtaaaaaaataaagtttacaggacttatgaggcagcatgaaaagtgcaaatattttagttataagagttcacaaaggagaaaaaaaggggtagaaagcttattttaaaaataacagaaaactttctaaatctagggaaagatatcaacatccaggtccaagatggtcaaaagtctctaactaaattcagttcaaacataactacatcaaggcaaagtcagactgtcaaaaataaagacaaagagaaaatcgtaaaagcagaaagagaaaagaagcaaatcacatataacagagttccagtaaggctagcagcaaagttctcaacaggttccatacaggccaggaaagagcaggttaatatattcaaaatgctgaagaaaaaaactacaaaataaggatactgcattcaccaaagctgtgcctcagaaatggagatatcaagtttttaccaaataaacaaaagctgaggaagttcattaaccccagacctgtcttacaagaaatgctaaagggagtctgcaagatgaaaaaagatgctaattagtaacaaaaaagaaaacataaaactcactrgttaaagtaagtacayagtcaaattcataatattcaaatacgttaatggtggccacatatatctgtaatatgaaagaatgaatctcttatatctttagcatgaaggttaaaagacaaaactattgaaaataatagctacaataattttttaagggatatatgctataaaaagatatacattgtgacataaaaaaattttaaatgcagggagatgtggagtaaaggcacagagtttttatgcaatcaaaattaagttgttatcagcataaaatagcccgatataattatgagactttttgtaagcatcatggtaaccacaaagcaaaagcataaggtaga

SEQ ID NO: 13270 - DNA, 33175 bp, Homo sapiens
gggaaaagcaagagatcagattgttactgtctgtgtagaaagaagtagacataggagactccattttgttctgtactaagaaaaattcttctgccttgagattctgttaatctatgaccttacccccaaccccctgctctctgaaayacgtgctgtgtcaaactcagggttaaatggattaagggttgtgcaagatgtgctttgttaaacagatgcttgaaggcagcatgctcgttaagagtcatcaccactccctaatctcaagtacccagggacacaaacactgcggaaggccgcagggacctctgcctaggaaagccaggtattgtccaaggtttctccccatgtgatagactgaaatatggcctcgtgggaagggaaagacctgaccgtcccccagcctgacacccgtaaagggtctgtgctgaggaggattagtataagaggaaggcatgcctcttgcacttgagacaagaggaaagcatctgtctcctgcctgtccctgggcaatgcactgtctcggtataaaacccgattgtacrttccatctactgagttagggaaaaaccgccttagggctggaggtgggacatgcgggcagcaatactgctttgtaaagcattgagatgtttatgtgtatgcatatctaaaagcacagcacttgattctttactttgtctatgatgcaaagacctttgttcacatgtttgtctgctaatcctctccccactattgtcttgtgaccctgacacatccccctctcagagaaacacccacgaatgatcaataaatactaagggaactcagaggctggcgggatcctccatatgctgaacgctggttccctgggtccccttatttctttctctatactttgtgtctttttcttttccaagtctctcgttccacctaacragaaacacccacaggtgaggaggggcaacccaccccttcataacttaataggcaaagcattatccraacagactgttcacagaaaagaaaaatattaatgactcaaattcacaaaaatatgctcaatctcactaacaaaatgcatggacaagacaattcgatgcaacactgtaatcataaaagataatcaccctctaggagcgagttaagtaaaatccatgcaatagtattccatacagttactgaaatgaatgaaataatgctttataatgatgaagataatagttaacatttactgagcacttagtatatgccaggcctgtcttaacggtttatagataaagcttrtgtctcaattctattattttttctatatttttttttagctgcagaaactaacacagaaasgttaagtaacttgaaaaagattaaaactagtaagtaatggagccatggtttaagtcccagtgtctggctccagagtcaatgctcttaactaccatgaagaatctccaagatgtatttttaagtgcgtgcttggggtggttgagggtggtggtgaagaaagatgcggaagtgtttatcgtatgctaagatttattgtttttaacagtttttgcttatatgcatagacaatctttagaaggacacacaagaaactgtactccctttggattttataacatacgtatatgttaccctttaaaaagtcaagtttaagttaaagaaaacacacccaaatcattagattctcactaggattctcaatgtgaaatagaagaggcattagatttggaaatatggagtctactcctggttttcctggtggctctagtaaaaaatcacaatctctttttttttttttgagacggagtctcastctgttgcccaggctggagtgcagtggcgcgatctcggctcactgcaagctccgcctcccaggttcacgccactctcctgtctcagcctccctagtagctgggactacaggygcctgccaccacgcctggctaatttttttgtgtatttttagtagagacggggtttcaccgtgttagccaggatggtcttgatctcctgacctcgtgatccgcccgcctcgacctcccaaagtgctgggattacaaacgtgagccaccgcgcccggccaaaaatcacaatctgttaaaccaggagtcaacaatctttttccacaaagtgccagatagtaaatattttaggctttctaggtccaatagcttctgttgaaactgttcgactcagccattgtagtgctagaacagccaggtgatgcgtaaacaaatgagagtaggtacagctakgttctaagaacctgggcaacgaaatttgattttcatttaattttcccaagccacaaaatattcttttgattttttttttaacttaaaaaaagtaaaaacaagtttttagctcacaatctacctttggcccacgggccgtagtttgstgacacttgaaccatttgttcaatgaagggcccgattcattatgtcaaaggtcatttcctactataatattctgaaattctctacttttaatattgcgagtaaggcagacagagaaaaaatgaggaaatacatctttagttatttttaatgatccaaatattaaatcaaagtaatgcgttggggccgagtgcagtggcycacgyctgtaatcccagcaccttgggaggctgaatcaggcagatctctygagctcaagagctcgagaccagcctgggcagcagcaaaaccccatctctacaaaaaataccagaaaaaaaaaaaaagaaaaagaaaaaaattagccggccatggtagtgtgwgcctgcagtcccagatgctcaggaagctgagatgggagaatcgtttgagcctgggaggcagaggttgcagccagctgatactgtaccactgcactccagcytgggtgayagagccagagcttgtctcaaacaaaacaaaacaaattagctgggagtaatggcatgcgcctctagtcccagccactcaggaggctgaggtgggaagattgctggagcccagggaagtcaaggatgcagtaagcagatatcataccactgcattctagcctgggcaacagacccagaccctgtctcaaaaacaaagaaaaaagaaagtaataggttgggtgtttcaaaagatttttagccttaagatccagattatttaaaaagtgaactgcctactccctttcttggactccctcctctatgagtaaaaatgtattacagcaactgtaacacatcattatccccattccactttccactatgaaacttaagacttttgatgacagggataacatctactttatctttgtaactcctgcctctaacgcaatgcctakcaagtgatacaggtatgatgcttgttcaataaataaataatacatcacacagtaatgatttccaatttactcttacaactttacatagtacttaagaagtccttaagaaattctaaaaaatcctcaccaagcagataagcagcagataaacctgataaacacttacatgctgtagtatagtggtaataacctagygtcctggctctgaggtcagttaaaacatatgtaaatcttagctctggcacttactaatcatgtctccctaaacctcaatttctttgatcctgtaaaatgggggaaattataactgcttcatgatgtaattttaaggattaaatgagaaaaaacatataaagcaagtagcataattcctggcaaatrtaagtgttcattaaacaaccacctttataacaaagtatctcaagtcatactagactcctaactggtctttcttcaagtcctgctccctcaaaaatttaatcttccaaaaagcagctaaaatgatttttttttttttgagacagaattttgctctgtcgcccaggcgctcagctcactgcaacctccgcctcctgggttcaagtgattctcrtgcctcagccactggagtagctgggattacaggcgtgcaccaccacgcccctctaatttttatatttttagtagagacggggtttcaccatgttggccaggttggtctcaaactcctgacctcagatgatccgscttcttcggctggctccctaaagtgctgggattacaggcatgagacaatgcgcccagccagaatgatcttgaaaaaccaattcgggctcaagctttaaatcctctcgtagtttcccactataatgaaaagaaagtctaaagtgctcatcttgacttacaaagctaatcatctgtcgcctccttacccctccatgttcatcttgggccattcatcctctgcccattgagcttcagatccacaagcccttcagttcctcaccccagcagtttcctttgctaggactgctctttctggcagatgactaggcttcttcctctttcagatctcaccttcttaaatgtcacctcagacaggcaggtatcctgtccgctactgtaacatcctctttaaatagcccccatcacacctatttgttgtttgttccagcccctccgcgaaccytgcctctacccgccgcatggcagctacctgggagagtgcctggagttgaatgaatgaaaatagtctgtagggtgcactgcccttgtcaatcacaagcagatttaattacctgtgccagaactcacgggagggaaacaccgtccgccagccccgctctttcctggctacagataaaagctccaggttccgggggttccggttggtgaattctggggcgacagcttcattttccacagggtccacttcaggtttcgctgccggctcggagctggttgacagggctgcgaacctgcaccctgggcaacgggaaaaaccgcacagggcttaaaaatgacggatatggacagcgcacgaacccgctctaacgtctatccgcttttacacccccaatctttaggcccgaggggacgaaaaatacgtatgcccacagggtggagtcagcactgaccccgtccttaacttcctactgtggtcttcgcagtgccgcgagctctatttcgatccggcacgtcgaatacaaaatagaacccgcacgttccmatgtactgtgcaagcccaggcgagtgasctrggagaaggggggcaagactaattaccagggttcctgcaaaccgagaacccccaaaacygcgaccgaagcgccatcgctgagacgatctcggaaaagcctcgcctctttttyctcacggacgactcagtcgctcgccaggmgcagccatataaagtcagggacaagcctttggctgctgtagatccccaaactctccacgccagacgccrccgacccggaagtagcaagtcccctgccactgagtggccragaaggcgatctgttatcctkcaycgccaatcatcgctcacgtcgaggggcacgcaggccctggagcccaccaaccacctcgtagctacgcccaagaccacgcttkttgcttaagtccggggtcaaaggcacacaccccacaaaaccatgtttgggttttctactcggagagcttgggcggtcatygactggtccacacacaccccacctgggcaccgcgtaggaataasgcagggcaagatgcagttttctccttaaaaagggtggttgtcttcctcgaaccaaaaattttcccgtatggcccgctggaaaaactgccccgtcccacccaggttcgcgcccttaaacttacactcctgaggcctggagcaaagccggccgatctgcctcacgctccccgagcagrgacaaggaaaagacactaaacctaaaacgcacgactcgctcagaaccccaactctaacttggagaagggcccgcccctccagttacaccccagctccaagctccacccttcttacaaccttttctagaaggcactagaatggccsactgcgtctgcgcaacatcgtttgaggcgaaggttcaacctcttcccagcggtccaacatccgacttccgttctccgctttcgcgcccttcccaycggctatctaattggacaaaaatgccgaccccgccccttccccggagcctcacttccgtcacagtcctgtttctctccctgttgtccctgcctctttttccttcccgccgtgccccgcggccgggccggggcagccgggaagcgggtggggtggtgtgttacccagtakctcctgggacatcgctcgggtacgctccacrycgtcgcagccactgctgtggtcgccggtcgsccgaggggccgcgatactggttgcccgcggtgtaagcagaattcgacgtgtatcgctgccgtcaagatggaggggcctttgtccgtgttcggtgaccgcagcactggggaaacgatccgctcccaaaacggtaagggcgggccgggcctgggtcgggtttgcggccggggagggccgagtcccaccgcgaccggaccccggctgccctcgtttctctcctttacctccgcagaaagggcctcggggccccgcagccggacccagcccacccgccgttctctggggcagggcgctgtggccccacttttcccacagcgaggaggagccccgccgcgcgcggcagggttttgagaccggcaacgcgtggatgtggtgtccggkgcggcgttggaaacgcgccctccgcgggaaagcgggcctcccgggctcgcacgtgcgggccacgcctcgcacccccttttgtttcagggcgaccccctgagtgtccatgttaaacgccaggtttyattttaggaccatttaccagaaaaagagtaggtccatccgcgcgccctcggatgagcccggtgccctgtccgcccgcagctgcagtcgaggtcgggcgtccggcgtccagccgtatccgggttgacagcttcttacagtagagttagcccaggaaacgccactcgagtgcattgaccccaggagacggcagcgctaacttagcagagcgtttgctgtcaggcctttggatacctacagagcttactgtttcttgatagaytcctaatttttttcgtaaacaaatctgaaagtcaccaccttccccgttgactaccgatttctctcctcacagataaagagagttttaatgagcaaaaaacttgcagaatctgaaggaaaaggctggtatagctgtacgaagtggcagagcrtgaaattggtggttattactttttttttttttccccgccatcagattccaccccgcatcaaagctgtgccaaataggctcgctttgtttagggacagggtcccacctgtcgcccagacgagagtgccatcatagctcactgcattctccaagcacaggtccgcgccgccgcatccggctttgtttttattttttgtagaaatgggtttcgctatgttgcccaaaggggtctcaaactcctggcatcaagcgatcctcctgcctcggcctcgcagtgttgggattacacctgtgagccacagtgtctggccccatttacactcttagtaggtggtttttaaataattaacacagatttgtagatttgggaaatacgggggctgttggatgtcatttacctttaggctgaaattactgtctttcagagttgtggcttatcctcatttcttttttatttttaattgattgtctacagttatggctgcagcttcgattgccaatattgtaaaaagttctcttggtccagttggcttggataaaatgttggtggatgatattggtgtaagtacacataactgttgtgttagtttccttaaagtaaaactatcttcagtgttttgctatgttctttctttgactttatcagaatccacgtactggaaggtgatattaaaggtgaacgtgtattataatggggctgtgttgatttctataagtggttcatattttttcctgcgaatttcttaggatgtaaccattactaacgatggtgcaaccatcctgaagttactggaggtagaacatcctgcagctaaagttctttgtgagctggctgatctgcaagacaaagaagttggagatggaactacttcagtggtaggtagactggctaaagaatgatcatttttctaaaaaygaccgactttcagaaagttgaagccataagtgggtcatttgtgctgtgtcagaaataagttacatattctgaatgcccagaagattgagcaagaagaaaaaacaaaagaagttacacatttaagaggggaaataagcttcttaggtacagattcagaaacaaaatttgtaagttgatagttacagctagtttgtacagtttaagtaggaaagaatttgagttcatttgacatagccccattgttttaaatgttggtattcacaagttttgagggcttatttttccttttatggcagtattcagacatcacacagatttttttatggtctctcaaaagtcttgtttcctcccccatcaccccttgagacttggaaagctctcaacttttctgattatttggaggataaaatgttaccaatctgggggagaaacaatgtttttatattattatttttaagagaccatctgtagcacagtctgaagtgctgcagtgctgtcatatctcactgcagcctggaactcctgggttcaagcartcctcctgccttagcctcccagagtgcttgggattgcaggcatgtgccaccacaagcaactaattaaaaacctcttttttttttytttaagagacagggtctcgctatgttgcccaggctggtcttgaactcctggcctcaagtgatcctcccttctcggcctctgtagtgctgggattacacgcatgagctgcactcagcctgttctattttttaaatcctgacaggtaatctcaggaattcaaaatgggagtgtgagaaattaataaatacatcatgatatgacagtgtgatcttaccgagtcagtaaatgtgatacacagtataaactcttcatagatcatccagcatgcyggtatagtagaaacactattgtttggtgagaaagatgttaattctggagaaactagatagtttgtggggaaaatgtatttctagattaaactttagccatgaaagaatggaatctactcctaaaatatgaatatgatctttgtctaacttacgataatgtgatttaacaaatgtagttttccttccataagaagctgacagtctttttgctttaaaaatatttcttagtgttttatcaacttgaagaactatcttttttaaataaaataatagcytaatataggtcatatgaatagtcacactcggtttagcttctgttgagcattttttctaaaggtaatagatgtgttgtcttttacggttgtattgatgaactagtttcttattgctgaactagtttcttagaacatttttctggctcctacccagttttggccatttgcatttataatacaataagacctcactgaacatccacagtggcttcatggaaactgactttaagaggaaagatgatgtataaaaaaacaagttttcctccccccatcagcgttacaataaacaactgtatttgagaaattgctgtccattgttttgcttaaagtggcagtttccaagaatttatgagtaacgtggaggacttggagtgttttgtagcgttcttctcccttcacgcccaggtttctaataaccagttaattcatttcatcactaccattttggttaataatatatggccattttagtgtcattccatatgtattgcacatgttgaatatccggcacactcagaccrgtgaatgttttctcaacaggttattattgcagcagaactcctaaaaaatgcagatgaattagtcaaacagaaaattcatcccacatcagttattagtggctatcgacttgcttgcaagtaagattgtttgcattcagagaaattttttttgatgtaatagttgtaaactgtgttgtcttaacgttttgattaataactaaattttaatttgaaaaccttcaatttaaatgttttagcatttaagtagtaatatttgaagttaaaaacttggaccagtatcttttttctcatttgactaccacattttctcctaataatagattttagtggctrtgcttatgggatagattaaacttgccatgatctgaagagggagggttttttcatgtcctcctcctatatgaaatggctgaacggrtattattacttacgacattttggctctgtgttaagcatgatgaatgcaaagagtttgagtagtgactttataagcgtttttctcccccacacttttaaacagggaagcagtgcgttatatcaatgaaaacctaattgttaacacagatgaactgggaagagattgcctgattaatgctgctaagacatccatgtcttccaaaatcattggaatgtatccttgtggttgtcagataaaatttagactttttaaagcataagactttgagatgggcatggtggtatgtgcctgtagtcccagctactaaggaggctgaggtaggagtattaattgaacccaggagtgcyagtccaatgtgggcaacatagcaagaccctgtctcgggagtgggtgcgtgtgtgcgcatgtgttgcgcgcacgcgtgcgtagtagcagcagtatcaattttgtgcaataaaattttgaataaccaattttatgcaaattgatatcaatagrgaggagtaatgctgtatkgaaattacytgttgccttccctgcttttttagggtgaaaaggtaataaaaagcatgtctaaaagtgatatgaattgcagatagtgataatgttgtaacattttggtgacaagtaatgcttgctkctttaatagattagattactaaaaggaagtcccttgaaattacccttgatttttcacgtgtgtaccctttgtccattccaaacctgttactgtccttaacttttggcgtagaaatggtgatttctttgctaacatggtagtagatgctgtacttgctattaaatacacagacataagaggccagccacgctatccagtcaactctgttaatattttgaaagcccatgggagaagtcaaatggagagtatgctcatcagtggctatgcactcaactgtgtggtgggatcccagggtaaggtttgggatttggtttatagaatgagattgctacagattaaaactagcttttcttttggctgggcgcggtggctcatgcctgtaatcccagcactttgggaggctgagtcaggtggatcacgagggcaggagtttgagagcagcctgtccaatatggtgaaacctcatctctactaaaaaatacaaaaattagctgggcatggtggcacctgcctgtagtcccagctacttgggaggctgaggaaggagaatcactggaacctgggaggcggagattgcagtgagccaagatcacaccactgcactccagcctgggctacagagtgagactccgtctcaaaaaaaaaaaaaaataaaaaatgtttttttgtggattatgtgcagtacatctttttgtaatttaaagcacatacaacatggtagaaggaatgtgaattaaaagaaattacrtgcatttaatgccataaaatttttctaagataaaatgcaatgaattagtctaaatttgtgtgtttacatacaatcgattataggtactctttattatgcttttaaggatagacgtattaacttaatcttatgttcaattgtaggcatgcccaagagaatcgtaaatgcaaaaattgcttgccttgacttcagcctgcaaaaaacaaaaatgaagcttggtgtacaggtggtcattacagaccctgaaaaactggaccaaattagacagaggtatgttgagagattatttttggccttttaagtgtgagtgtcttggaggactttaacatttttagccaagtcaaactattttacttccagaaaaattagcctggtggtgtttttagagggatttggggttatacaacctatatgaaaatcggcctttttgtggaattttgattgtatgagtctattaatattaaagatgtaaaagacaggaatctaatttcctcaaagcagtacagaactcagcagtatagtattgactgtaacctactgtttgctagatactggaggtgcaggtgatattagtggttggcatgccagaagagctaatggtggaggtagtgtgaccattgctatagatttgactgcctgacagtcacttaaaacaataaattgtttaggctgggcacagtggctcatgcctgtaatcgcaacactttgagaggctgaggtggcaagaatctgaagcccaggaggttgaggctgcagtgagctgtgattgtaccactgcactccaacctgggtgacagcgagaccctgtctcaaaaaaaaaaaaaaaaaaaaaatagtttaaacagtagttaaaccagacctacaagaaagctttgccaagagtaagaaatgtgytgtcatcttttaaatcagtctgcacgggtrttcttttttccttccttcctcatacaacaaagtgtcctttcttccatcaaagccagtccctctacagtaagtgttctagagtctgtttccttctgctctagagccttttctttgattcttgtttcatacttgcatcttcaactaattatgctctttcctggattcttcctgtggctcttttgtccttcaagcttcttcrtacatccttgtgctataggtactccctatcgtacatctttacaggcagatgtcatgagtggtttactacacaaaacttctctggtgcttttcttctcatcccttttcagccctgttctccatttgagggactgcatgttaaggtctctagcgtgaaattcggaagacattttcagccttcctcttacttgacctttagcaaccctttgattatgtccttcttgaaatgctttcggggatggaaggctttgtgatgctgctttgtctggaccatgtcataatactctccaggatagccyctttgttcccatgacttcatgtattatctctctatgccagagactctttcagctgtttctctaagctccaaacacacatacctctatctagtagaatgcttttcaagcatctcaaagtgaacatgtctaaaactgaacttgtgataataccgcaaatctgcttttgaccattttagtgatggggagtccttcacacaggcagaaaactaggaaatgtccttaactcctcctttttaccaacactttttctcctaatctgtcaccaagaccgcttgatttctacctccaaattaaatttacctacttttcattttcttgcctagactgttgtagaaacacacccaagctagtctcttagagaagcttttctttcttcttcaatctaaattatattctgttgtaacttcctgtattttttcttcctggggcttattacagtttttaccatgagtttatataacagtgtgtagcacacagtacttgtttagtagacaagctgcttttgaggttgatctgtaattcattttactttaaaaattcttcgaatgatctattcacatggcttcactcatattgactcttcaaatctggatctcccatagtttatggtttccatgatgtaagtgactgcctcctgggagcttcacctgagtaacagcagagacttcaaacttaatcttgtcctcaactaaactctcatttcccatcctgcccccaaaactcttgttatttattttactccaggagtcacccaagccataaaatttgacttttctgtttaggttgtctttcagcttatatctcatgttattatcttcttgtcttcagccattcagtgcagtttccacattgataatcagggaatccttttgaaaacacagatgatatactagtcttgcttagagatattaagcttagtatctagattgtttggtgtaacctgcaaggtttttcacttttctggttctrccttcttttgtgctttcaactctggactcctgtttttgtttgtttgtttgtttttgagacggagttttgctcttgttgcccaggctggagtgcagtggcacggtctcggctcactgcgacctccgccttccgggtttaagtgatactcctgcctcagtctcctgagtatctgggattacaggcgcccaccaccaggcccarctaattttttstatttttagtagaggcggtttcaccgtgttggccaggttggtctcgaactcctgacctcaggtgatctgcccgcctcagcctcccaaagtgctgggattacaggcgtgagccactgcacttggcctggactcatcttcattgtccacctcctaggctaaatttatgtcttttatgtgcttgtaatctctgcataccactttartgacacttgccctggagtgtgattggtaatccctctccccactagatccttgaaggcaggacctgtgttccctgtttaaccatagttctcaattagtaattcaaatttgggttggggagagctaagtggtaatttttaattccttcaaattttccatgaattsgactaatttaaattctggtcagagataacaaaggataatacaatttgatctrtgattatcttgtgataaatacttaatggaagttaaattatttttaaaaatcacagaaggtaaytcaggttacaaaaatactttgcagagaatcagatatcaccaaggagagaattcagaagatcctggcaactggtgccaatgttattctaaccactggtggaattgatgatatgtgtctgaagtattttgtggaggctggtgctatggcagttagaagagttttaaaaagggaccttaaacgcattgccaaagcttctggaggtatgtcttgtgctggctgtcacataaaatacttttattatccctgatcctatcaaaggtctttttacattrgaatattgacagaaaacagctcaaaaacatttatattctcttaatgctttgtgctaccaacacatttatagagccatttttcatgtaactggagaaattttgttggaaatttgtgaactgaatttgttcatttctaaaatgacagttccatcttaggataaaaggagttaccgtgtgctgcctaactaaattctaaacttgtaatatagcacttttaycacaaatgctactgagtccaaggatattaaaatcatgaaagagcaatattcacagatcctttgtaactctcttattagcaactattctgtcaaccctggccaatttggaaggtgaagaaacttttgaagctgcaatgttgggacaggcagaagaagtggtacaggagagaatttgtgatgatgagctgatcttaatcaaaaagtaagagccactttctaaaattgtaaagttataccgattttgttaagtaaaagtaggttttcttcccatttatttgctgcttgtagtctcacagtgatacgagcagttatasgcatgggataaaataacattgggccactgtaaattgagatgaagtaaccattttcatctcttctgcakggactagacattgtttctgtatagtatatctaaatatcctgtgtaggcaggacttaagggaactttatgtagacttattttattaaaatgccattttttttgagaaattgatggtcttggcaaaaaaaaatttttaaaaatgctattacaagaattgtacttttgttttgaacagtactaaggctcgtacgtctgcatcgattatcttacgtggggcaaatgatttcatgtgtgatgagatggagcgctctttacatgatgcactttgtgtagtgaagagagttttggagtcaaaatctgtggttcccggtgggggtgctgtagaagcagccctttccatataccttgaaaactatgcaaccagcatggtaagaacagtcatttcttgtcttagaggcctgagagcagtagctgtggacttcaattttttttttcccttttgtgaagtcacctaattttcttcttttcctaggggtctcgggaacagcttgcgattgcagagtttgcaagatcacttcttgttattcccaatacactagcagttaatgctgcccaggactccacagatctggttgcaaaattaagagcttttcataatgaggcccaggttaacccagaacgtaaaaatctaaaatggtaagcatggtttcccgctctttgttaacctctgcagaacaggttgcattaaaaaggatagtagtcaattacatgtcagcaaacataagtaacagacttgtcaaatacttaacatgaaaaacttcacagcaagcatttgttgttcagtcactgtaattcaagggataatgactaattattagcactggtgtgtcttcgttaactgtgattgctaatctctccctgcttcttttggtagaaagactacctacaagatctctagtctgatttaaaaatcaaccttaatacttgaatgaaatgctggagttaataggccacctaatgaaattgtaagcggccgttaaataattctttcttaattgcaggattggtcttgatttgagcaatggtaaacctcgagacaacaaacaagcaggggtgtttgaaccaaccatagttaaagttaagagtttgaaatttgcaacagaagctgcaatcmccattcttcgaattgatgatcttattaaattacatccagaaagtaaagatgataaacatggaagttatgaagatgctgttcactctggagcccttwwtgattgatctgatgttccttttatttataacaatgttaratgcaattgtcttgtaccktgagttgagtattacacattaaagtaaagtacaagctgtaaacttgggtttttgtgatgtaggaaatggtttccatctgtactttggtcctctgatttcacatattgcaacctagtactttattagtttaaaaagaaattgaggttgttcaaagtttaagcaattcattctctctgaacacacattgctattcccatcccacccccaatgcacagggctgcaacaccacgayttctgcccattctctccagtgtgtgtaacagggtcacaagaattcgacagccagatgctccaagagggtggcccaaggctatagcccctccttcaatattgacctarcgggggagaaaagatttagattgtttattcttctgtggacacagtttaaaatcttaaacttgtctttttcctcttaatgtatcagcatgctaccctttcaaactcaaattttcattttaactgcttaggaataaatttacacctttgtgaaaattcatccctgcctatcttacctcgttccttttatgccaagtaagccaatgtctttttttttttttttttttttttaccttgggaagtaatgaactcagtcctagtaactagtatttctttaactattacccacatggccaacacctagaagatactatcttaaaattggattgtgaaattcactggtaagctctcagggttacttgtgcatctttaccttctctgggtttaatccaagttctttaactattgcagcararacagctgcaaaggcttcattgatttcaaatatgtcaacatcttccagtgaccaacctgcttttgtaacctagaggaaagattcatagaaaagaggtctaaacttgggtggaaaggctaaagttaaaccattctttgtcaacataaatatatgctgcatgatactggtaactgctastttggtttgttcttaggttaatacagtgacattctcacacatttttgccttagtgacatccattccatccaaaaggttaagggtgtgatctaaaagatcccttagaaattctaaattgtcttaaaattttgaaccagtagcatctsttaygtgtacctaaggctaatgtaacagaatcagttcccctagaaagcatgtgatccaaatgctctcagtggctgggggtagtggctcacacctgaaatctcaacacttggggagcctaaggcaagaggatcaattgaactcaggagttcaaaaccagcctgggcgacatagaccttgtctctacgaaatgaagaaggcktggtgcacctgtagttcgaggtaatgggaggctaaggcaggaggaatatttgagcctaggagttttgaggctgcagtgagctatgatggtgccactgcactccagcctggacaacagagcaagaccttatctcaaaaatagaaataaatgctcttggttactcttctggtagggaaagactagagctaactacatgaataagctcacttaaggctaacaggaagacaaatttcataaaagggaatarggttatactcacagcttgctttatggctggaattggtcctattcccataatggaaggctccacacccacttgggaccaggaaactatccgtgctaaaggtgtaagyccacgtttatcagcttctgacttcttcataagaacracagctgcagcaccatcatttattcctgtaaaatatgagtgacttaatttctaccatgcttattaacctcagttacatatctgtggcttctttaccacctgaagacatgagttaaatgattttacctgttggctaaggcatttactataattcaacagactttacatagaaattatgtttggcaatatattgaccacaaaactttccaactagagaaagtggtaggattacagtagtcggggctgggcgtggtggctcacgcctgtaatcccagcactttgggaggtggaggagggtgaatcacctgaggtcaggagtttgagaccagcctgaccaatagggtgaaagccatctctacttaaaatagaaaaatcagccggtgtggtggtgtgcgcctgtagtcccagccactcaggaggctgagacaggagaattgcttgaacctgggaggcggagattgcagtgagccaagatygcaccactgcactccagcctgggcgacagagtgaggctccgtctcaaaaagraaaaaaaaggattacagcagttggggaggrgagatctctgacaggaaatggaagaataagcctgggcttcacaaggaggtattgggagtttctggtactggaaaaatacaaaggtagataaactgaagttccctaatttacttcttcatttgtatgtctagttgggatgtcaagaaaccaaattaattctttcagtataggttaagtcaatgatcaaatacagagaaatgacatgtttccttmaactgttttaagrataattttgtacataaatattgagttgggtgtggtggctcatgcctgtagtcccccagctacttgggaggttaaggcagggggctcacttgagcccaggagtttgaggctgcaagtgagcaatgatcatattgctgcacacgaacctggctggcagagtgagtccctgtcccaaaaaatagtacttttgtatataaataaagagaaaaatattcactcggtagacattatagaacatagtattcccccagatgtccttcagaaaatctaacctgaagcattggctggggtgactgttcccgttccatcagtaagaaagtaaggctttagcttggacatggcttctatgttgctcccatggcgaggaaactcatctgttttaacttcaataagacctaagcaaaggaaaaccaattactcaagattagtccagagacagaagtaagtgtgctgggaatggtgggttctctgccattaaacatgaggattcatatttagcagaaaagttttaatatgtgaccactttgatgacaacaggaggaaagtacacacaagaattattgtacatgaaaacaatttatgagtatgtccttatgagacacctgtgttttccaaatccataggccttcctgaggaaagtagctaccagggacctgtttgtgccaaattctgctatagtttgggtcatagtacttggctggttacgagtgagtggatcaggcagtctcaragccaatcgtgcactgctggcakgacataagagatatcagttatcaataagggagcttgacgggagcattctgtattagaaaatagcgagtgaccccaaaagatccaccctttagaaatgtgaaatggagatcacacagaaacagcgagaagtaatgggtgtccacttctgaggaggttgagcctatacaggaaacaggtcagctggtgcctcctaacaaccatgagccagtgctccagcttctcatgaaacctgctgtgtgtgcacagtggtcatggacgctctggaaccaagagtgcttgagtgctgacataggtcccatgttaccgtgtccygtaaacccagcataccccctccccacattcatgtatccaggacatatayttgcaacctgaaaaacataactaagatataatttctaaagattcctatgtattactcttttagatgttactcttacctataaataggttgatgtttaaaccactatgatatactcacctyttctagttgacaccaaaactggtacaatctctttgtcaaaatggccagctttctgtgcattctctgtcctgttctgggacagaactgcaaccttgtcctgatcttctctactcacttgccattttttggctacattttcagctgggaaaggagaaaaacagcaaaaaactaacattttcatgaactggcatttgatagctcaagtcgtccacatttgaccaagcactgactgaccacatatgctagcaggctcatggtggcctgtgcaatgctctgtgtggggtggccctgcctgccactggcagttggtttggaaatgttgcagtgactctcaggagtcatacttctctccttccctttctatataattgtaaacttacagaaatttccttcacccagagtcaccatttatattttccctccatttgctttaatattttctttctgaaccatctgagagaaagttggagatacaatgccttcttactcttaaattttaatttcagtgtatacttccccaaaacaaggccactttcttacataagcacagttataaaactcaagaaattgggccaagtgtggcggctcacacctgtaatcccagcattttgggaggccgaggtgggaggatcacttgagcccaggagtttgagaccagcctgggcacagcgagaccctgtctccattaaaaataaatttagccgggcatggtgtgtgtgccatgtagctagtagtcctagctgcttgggaggctgaggcagaaggatcacttgagcctargagttcaaggctgcagtgagccatgattgtgcctctgcactccagcctgggtgaccctgtctcacaaaacaaaacaaaaatcaggaaatttaacatgaatcaaacactattatctaatccttggtccacattcaaayttcacctatatttcagtaatgtccttctagctcctttatttgagccaataaagaagcatgcattgtacaactatcaatctctctagtttgcttttgtctgtaacagttcttcagactatgcttcttaagcttgatatttttgaagaacatgggcgagttcttttgttaagggtcatcaattttgatttgtctgatgtttcctcagaattagattaagattstgccaaaaggcaggtataccactgaatgatagtatgatttttctcagtgagtcttattaggacacaaatgacaatcagtttatcccaggtgatgttatctttgatcacttggttaaaatggtttggtattcaccaggtttctagcttttaaaggtaccattttttcatttataagtaatcaataatttatcagaggttctttttggattatccaaatatcttcttccccatcatattttcacccactagttttagcattcattcatgactttctaactccaacattccttctattggtaagatattaattggcattttaccayaaagaaaaccttttccttttctcccatttattcagttatttatatcaggatggactcatacattttcattttattgaataagttataactcattactytcattacttactttgatgctgaaatttttcaatacttgggcagttataacccattactatcattacttatttgcacgctgaaattgttcaaaatttaggcagttacaacccattactatcataacttatttgcacgctgaaattgttcaaaatttgggcagttacaacccattactatcattactgactctgatgctcaaattgttcaaaattccactacaggaaagtggaagccccgtaggctgcctcctgtgtgctttcaacatgtccctgagcatgtccttaattttttagcattttttccctagccttggaaagggccatttctccaaacaaccttagttccttttagtggataaatgtatttagaagatctgggtgtcaggactgcttgttgttactggtttgtcattgtttctaggtctgttcagtagaaacttccatatgtattatttataattttacatatacacacacactcatggtaacaccttgagttcatactgcattttgagttctccaaaatgcaacctaacaccacaagctacattcttctccctttccgtatttgtaactctcttctacaaatgtgagaattggccaggtttggtgggtcacacctgtaatcccagcactttgggaggctgaggtgggaggatcccttgagctcaggagtttgaggccagcctgggcaacatggtgaaaccccatttctacaaaaaatacaaaaaattagccaggcatggtggtgagtacctgtggtcccagctactcaggaggctgaggtgggggttgcagtgagccaagattgagccactgcactccaatctgggtgccagagtgagacccgtctccacacacacacamaaaaaagttattgctttgctttctatgtcttgtctttacttatcaagctgtttttctttctttytttttttttttgttggatgatgtctcactatgttgaccaggctggagtgcagcagmtactaacaggcaaaatcaaccatagtatactatacaacctcaaactgctggcctcaagtgatcctcccaccacagcctccctrgtagctgggactataggcacctgccactgcaccctgtaaaagctattctcttatatatacttctagaagctttacattttttgcttttatttttaaatccaygatttatctcaaattagcttttatatagggtgtgaggtagggatctaggttcatctttcccatgtgagtaatctgttattccagcaccatttgttgaaaagactttaatttctccatttcattccattgatgcctttgttgaaaacragcataagtctgggtctatttctgaactctgttctctttctctgtccttatgccaaaaccacattgtcttgtttacaacagctttawaggtaatgttaaaatcagagcatgtaagtgctattttctgacttcaaaattgttttggctattctgagtgctttgcattttatacagtatttatttacactatttatttatttatttagagatggagtttcattcttkttgcccaggctggagtgcaatggtgcaatatctcagcttactgcaacctccgcctcttaggttcaagcaagtctcctcccttggcctccagagtagctgggactacaggcrcctgctgcaacacctggctaattttttgtagttttagtagagatggggtttcaccgtgttagccaggatggtctcaatckcctgacctcatgatccgcccgcctcggcctcccaaagtgctaggattacaggcgtgagccaccgcgcccggctggaagctattcttttgttgttgttgttgttgttgtgtcactatgttamccagactggaatgcagtagatactcacaggtgcaatcatagtagactatgatagcattgcccaggctagactcaaactcttggactcaagcaatctcttgcctcagctcttgagtaggtgggactacaggcacataccaccatgcctggctcctttagtatttcttgtagtgtaggtgtgcaggcaattcattttccttcatctaaaaatggctcttcactttcactcttgttttttttttttttgagacagagtctcactctgttgcccagactggagtgcagtggcatgatctttttttaactttttgctacaatttgctaaggtgtaatttttcccttgtctatcttggtctttgaacttcttttcacaccaaatgtggaaattttcttcagtttttttctgccccattctctctcttccttatgtatgagattcctattccatgcatgctagtcctatttattttgtcctgcagaccaccaaggctctgttcatttatattttatttttttgagacggagtttcattcttgttgctcaggctggagtgcaatggcgtgatctcagctcaacgcaacctccgcctcccaggttcaagcgattctcctgcctcagcctcccgagtagctgggattacaggcatgygccaccagcctggctaattttgtatttttagtagagatggagtttctccatgttggtcatgtgggtctcaaactcccgacctcaggtgatctgcctgcrttgacctcccaaagtgctgggattacaggcatgagccaccacacctggcctattttttaatttaatttaatttaatttaattttttgagacagagttttgtttgttacccaggctggagcgcaatggtgtgatctcagcttgctgcaacctccacctcctgggttcaagctattcttctgcctcagcctcccaagtagttgggattacaggcatgggccaccacatccagctcatttttgtatttttagtagagacagggtttccccatgttggccaggctggtcttgaactcctgacctcagatgatctacccggcttggcctcccaaagtgctgggattacaagcgtgagctaccgtgcctggcctgttcatttattcttcattatttttctctgtgttcttcaggtcgtgtatatgatctatcttcaaacttcctgaccctttttcttctgtctccaagatgctgttaaggccattcagaatttttttttctttttttttagagatgaggtctaactatgttgctcagcctagtctcaaacccccagcctcaagtgatcctcccacctcagcctcccaaggtgctgggattacaggtgcgagccaccatgcccggccccatcccagtgaattcttaatttcagattgtgtactttgcaagttctagaatttctatttggttcttgtttatattttttccttttactcctgagatgtccacatctattcctctatgaagattatattttcctttgtatctttaaacatatgtaaaatagagcctttaagatcctcatctgataattctagtattgcagggtctgttgactgttgtggtttttttccaccctggttgtaagctatattttcctaattctttgtgtatctagaaagttctcattgcatgctgaacattatagttgctacataactggacatagagattttattatctttagagaatatattgagttttgtttccacaagcagtcaaaatactggcaaatcaccttgatccttttgaggcttgtttttaagcttattagtttgggtctagagtagcttttactctatggctttggccctacccctaaactgtggtctttctgagatgtcaatggagtgtccaaggagttcagtaaggtttccactcgcttgtccagaacttttatctcctagtaatctataaaatctccagttcacctctcctttgcagctcttttctactaggccttgtaagctgttatctacaagcttagtatttgatcaaagacttaaggggaaccttttgcagatttctggagctctttttttcttctcccccttattctgccccacaaactccagccatctcagaagccccaaattctctgcttcttcagatcactgagaccactgtttccagcttaggctctgcctctccataacacagtttgggaagtgccctgggtagagacagtgacagtggggttttcccttctctcaaggatctcagtcttacatgagtattagtcaaaacctgacatacataaaacagtggctttatatattttcacaagttwtatgcttgtttatagtaggaaatctaatctttgtcaattactccatcatgacctgagccttttttcttttctttttttctaaagaagagcaatttattttcttacagttctggaggctggaagagtaccattcaatccacagtacaccttggaaagggctcgggatctgaatttttaatgaccacctctagttatggttgaggcagttggtcacacagtgtcttccattgtctgcctgtgtttttatagccttctctgttgtggctgtaagtcgagaagtggtcaagatgccttgagcttctcattgcttcccatatccctaagcccttccttccttcctagcattcatgcacacagttccctcttggaatcttgtacttttccccattacctttttcacatatttatgtgttacataaaaccagagccattgctgcatgcatttgagcaaggtgcttaacttctcagggtttgattctttaactctaaaatgtctattctgtttcttaagttttacatgtatactaaagacaagagtgcttttgatttcccagttgctttgccattaaacttagaccacaggacccttcagcatgaatgaccaataacccaattgtgtagtacaaaaagtacagctaggtaccaaaaaaacaactggtttatctctgtcactacctctgccacagaagcactatttgtgggccctgtttcttcatttggtaaaatgaggggttgatccagaagaactctgaggtacttcccacttctaacattctctgataatcaagagttcacaaagaagagaatacttacttcacttcagttaatcaaagaagagatataaaaatccttaagacagtctctggccatamggacgaaagcacctaagaagcagattagtatatkgtctttttaacctttttaaagctaatacagtttcagccatgtctgccttacctgtaatacccatatgacagttgtgaaatgcatctgtaagaccatcacagagtatactgtcagtcagtggcatctcacctatctttactcctgttctcaagtaagccaagtgaggagcctagaagtcagaaataaaaatggatttaggcttagttgcaattagtcttctccccagaatacaactcaaaactatctagtatttcctaagtcttcatctaggcccctttgcagcccttctccccagttctaggtcctcagccaggccaaggtctaaagacccctggaattagcagacttcatctttcctattgttgggaacgattactctcctacctacccattttcaattctccctcaaacctacccattctgtgtcctgtttccttaagaattccatttattctttccatcgaggcaattaattatctgttaaatgaagaaatcctctaagggcttaagtaaagctaacaatgtgttacctatttcaatggatgacataatgtctacagtgagaataatcaggctaactaaatgatggggagggatttctgagtagcggccagtcttaactctcaccaactcaacagcaggtatattagaatggaaagagtcattgattggacttagagtcggaagagttgtatttgaatgctggctctggtcctcagtttccttacctgtaaactgggaatggtatcatctaccctatatggggctgttgtgaacacatgtacaaaagcacctggtaaagtactacacagatgtcagtrtcatcccatcaaaatcactccgattatttttgttacctttagcctgcctcctcctgaacctcagcaatggctgggctgaatcagcttctatctagggaatctgcacctcagcccctgagctgcatcagtaggaagcagggggtatagtttttctttcaaccactatgccagtttgaggtatggaacttggtgaaacaaatcatgcctggcaaacctactggagaagggcaccacttggtggtcctcttttacatgttctataccctgaaaaggtcaaaaagtctggtccccaggatctccttgtcatgtgcaggaaggtaagtggcaacatctgttttttgccttttactcacaatgggaaagaaatttaaaaccaaggacatcaagcaactaatatgaatttaattcagaaaatattacatgcttcattaatagtttagaaaaagtatattcggttccaatcacactggttgataaacttcttatcaacccggatttcccacccaaactgaagaatacttcacattcaagtagggatcaaggttgtcatttctgtttatttgttcactgtttggttccagctctgctatgcatctgtttactctgttctggcatagacatgagtttctcagtgtgaggtcagtgaaagccacctcatcagagaggccttaccttgctcatattttccatgcctcctgcaaccacaatgctggagtctcctatccctattgactggactgcaaggcacacagcttttaggcctgacccacagatcatctggcagctccatgctggaacagagtagggaattcctgcacccacactggcttgtctaacaggattctgcccacagcctagaaagaggaacacagaggactcttagcaatcaaggagaaagacaaaatgtcacagtgaaagtgtgtggaaaattgccagttgggttacctgccacttctgaaagcctacaggtcaagtaagtgcccactggaggcaaaaaggcctgtatacactctccacctgtcacagtctagcccttgaatatatactgccttgtgctgctctgtaggtatttcatagatataagctttctcctccataaataagtcattaatacattaagaaagaagtgtcatcctcatcttttgatatggcttaaatagttgggcgcggtggctcatgcctgtaatcccagcactttgggaggccaaggagggcagatcacctgaggtcgggagtttgagaccagcctgaccaacatggagaaactctgtctgtactaaaaatacaaaattagctaggcgtggtggcgcatgagtgtaatcctagttactagggaggctgaggcaggagaattgcttgaacctgggaagcggaggttgcggtgagctgagatcacaccattacactccagcctgggcaacaagggcgaaactccgtctcaaaaaaaaaaaagtgcgggggggtgcttaaataagcattatcaaacctatgtctaataaacacaggatataacctaggcattatcagtgtttctaactagggccatttgctcccaagatcatggcttaagacacttgagaagaaaaagggttacttaaaaaggaaaacctttgataataagcagttctgttcttgcttagtattcattacactatgcttaaatggttatataacaaaatatatacaaactcagaattcacaaatacctttttttctcattctgagtactgaaacacaaatatcttttcataattcaactatgggacttcctttagttgggaagaaatacataatttacttaaagtagcacagaagagaatggagttaaaagtttcaaatattctcaatcgccattgtctgttatcagagtcaatggtaaatgtttataaagtggttactctattcccagtttcagatatactcaaacctaccacccttccttggagagtttgtggggaagaactagcaaakaagtcgctgataaaaacttagagattatattcatcacaatgttatcartctgggattaggctggaaactaaaaacgggtaaggttacttgagactgaaaasatatgcaggatcatatacatattaaaaagacaggcccagtgcggtgcctcaggctgtgagcagtggctcacacctgtaatcccagcactttgggaggccgggggggggggcgcattacttgaggtcaggagtttgagaccagcctggacaatatggtgaaacccccyctctstactaaaaatacaaaaattagctgggcatggtggtgcacgcctgtaatcccagctactcaggaggttgaggcaggagaattgcttgaacctgagacagaggttgcagtgagccgagattgtacggctgcactccaccagcctgggcgacagagtgagactccatctcaaaaaaaagaaaaagaagaaatgaggtacagggctgggcatggtggctcatgcctgtaatcccagcactttgggaggccgaggcgggtggataacttgaggtcagaagttcgagaccagcctggccaacatgttgaaaccccatctctactaaaaatacaaaaattagctgggcacagtggcaggcacctgtaatcccagtcacttgggaggctgaggcagaagaatcactggaacccgggaggcagaggttgcagtgagccaagattgcgtcactgcactccagcctgggcaacagagtgggactccatctcaaaaaaagaaaaagaaagaaatgaggtgctaacacaattaataatgctagcatttagcatactacgagcttcatgagaatgagaatttctatctgatatgaacattgcttatctccagctgctaaaatagtgcctggcacaaagtaggtgctcaataaacatttgttacatgattgtagaaggtatctggctcaaggaataggacagatctaagttcaagtgctagctccacttcaaactgtgaccctggtaagtcatttaacctcttaaactctcatttattcatttgtaaaatgaagataataggatataacagacttgtgaggaagattaaatgaggtaatgaaaggaaagcatttagcacagtgctttaaaagccttaaacttagtagacatgcaccggtagtcccagctagctcagaagttcaagggcatggtgcaccatgattgtgcctgtgaacagccattgcactcacgcccaggcaacagacagactccacttctacaaaaaaatttaaaaaattagccaggtgtggtggcctgctcctgtaatcccagctactccagaggctgaggtgggaggataccgtggagcccaggagtttgaggttatagtgggctacgattgattacaccactgcattccagcctggacaacagagtgagaccctgtctctttaaataataataataataattaattaattaattacgagtgttcaaacccaaagaatcagaagatgggggcactctcaggactcagctatattcctctggggagtgatatgycccatttgcaaggggcatgatgtggcacctattttccaagctcagaactgagccctaagagggcagggaacttacctgtattgttggaaccatactcccagcactaagcacagtatggggcacataggaggaactgaatacatttttgttgaatgagtgacactttgaggtagtaaggaggagcaggcatactttcctatgcgtcaggctggccctgctgctgctkcttcttcttctttttaaaaggagtctcactctgttgcccaggctgaatggagtgcagtggcacaatctcagctcactgcaagctccgcctcccgggttcacgccattctcctgtctcagcctcccaagtagctgggaatacaggcgcccgccaccacacccggctaattttttgtatttttagtagaaacggggtttcaccgtgtcagccaggatggtcttgatctcctgacctcatgatccgcccacctcggcctcccaragtgctgggattacaggcgtgagccaccgggcccggccggccctgcttcgtaagaatgaaaaggcagtgggccgcctgtagtcccagctactcgggaggctgaggcaggagaatggcgtgaaaccgggagacggagcttgcagtgagccgagatcacgccactgcacyccagcctgggccacagagagagactccgtctcaaaaaaaaaaaaaaaaaaaaaaaaaaaaggaaaagaaaaggcagtgtaggtggtgtaggtcagtggtctaagttcattcacaaaaagcatattaatgaagctaagtctttttgtttgtttagagaaggggtctcactctgtcacccatgacggagtgcagtgacacaatcactgcagtctcaaactcctgggctcaagtgatcctcccacctcagcctctccagtagctgggaggcacaggccatcatacctggctattttattttttgtagagacggggtcttgctttgttgcccaggctagtctcaaacttctggactcaagtgatccttcctcctccgcctcccaaagtgctgggattacaggcgggagccaccctgcctggccaagaagctgagtctcaagctggatagaagctactgacagggctggaagaagggggccaacaggaggaatcataacagagggaactctgagcaaaagcaaggaggcaagaacttgagtgagtgagagagtgtgtgagtgtgtgagagwgtgtgtgtgtgtgtgtgtttatgggctgtttctaataagcctgacttctcctggaatcactgagacttacctgctgccaagacatgtccaaagatgacctcagacacatcttccggagccacagtggccctcttcaagacttctttgatgacagtggagcccaggtcctggacaggaacagcagctaaggcaccattgaaggaacctacaatagaaaggcggagagcgtggacatcacaagcctgcgggtaatacgggaaccacctacgagcaggggagcctcatgaccctgtttggcaaggccacgcgaggaggcagtgccctctcctcccacacgttcctacacctgctggtctgagcaaaggtcaaggtgggtgccacaactcgcagcagccgagggctggacaggcgacctccagaacggcctagggacgccgctgtagcccttctatttccccaaatccgaaggactggatgcgaccccatgcttcccaaacaaaaggaaccggcgggtcaagggcgttgaaaaccatgcggcacgaaggagacgaagtcacgacttctagccattgtgtgacagcccgaccccagcccaaagccgggctcag

SEQ ID NO: 13271 - DNA, 12648 bp, Homo sapiens
tggatgacataatgtctacagtgagaataatcaggctaactaaatgatggggagggatttctgagtagcggccagtcttaactctcaccaactcaacagcaggtatattagaatggaaagagtcattgattggacttagagtcggaagagttgtatttgaatgctggctctggtcctcagtttccttacctgtaaactgggaatggtatcatctaccctatatggggctgttgtgaacacatgtacaaaagcacctggtaaagtactacacagatgtcagtrtcatcccatcaaaatcactccgattatttttgttacctttagcctgcctcctcctgaacctcagcaatggctgggctgaatcagcttctatctagggaatctgcacctcagcccctgagctgcatcagtaggaagcagggggtatagtttttctttcaaccactatgccagtttgaggtatggaacttggtgaaacaaatcatgcctggcaaacctactggagaagggcaccacttggtggtcctcttttacatgttctataccctgaaaaggtcaaaaagtctggtccccaggatctccttgtcatgtgcaggaaggtaagtggcaacatctgttttttgccttttactcacaatgggaaagaaatttaaaaccaaggacatcaagcaactaatatgaatttaattcagaaaatattacatgcttcattaatagtttagaaaaagtatattcggttccaatcacactggttgataaacttcttatcaacccggatttcccacccaaactgaagaatacttcacattcaagtagggatcaaggttgtcatttctgtttatttgttcactgtttggttccagctctgctatgcatctgtttactctgttctggcatagacatgagtttctcagtgtgaggtcagtgaaagccacctcatcagagaggccttaccttgctcatattttccatgcctcctgcaaccacaatgctggagtctcctatccctattgactggactgcaaggcacacagcttttaggcctgacccacagatcatctggcagctccatgctggaacagagtagggaattcctgcacccacactggcttgtctaacaggattctgcccacagcctagaaagaggaacacagaggactcttagcaatcaaggagaaagacaaaatgtcacagtgaaagtgtgtggaaaattgccagttgggttacctgccacttctgaaagcctacaggtcaagtaagtgcccactggaggcaaaaaggcctgtatacactctccacctgtcacagtctagcccttgaatatatactgccttgtgctgctctgtaggtatttcatagatataagctttctcctccataaataagtcattaatacattaagaaagaagtgtcatcctcatcttttgatatggcttaaatagttgggcgcggtggctcatgcctgtaatcccagcactttgggaggccaaggagggcagatcacctgaggtcgggagtttgagaccagcctgaccaacatggagaaactctgtctgtactaaaaatacaaaattagctaggcgtggtggcgcatgagtgtaatcctagttactagggaggctgaggcaggagaattgcttgaacctgggaagcggaggttgcggtgagctgagatcacaccattacactccagcctgggcaacaagggcgaaactccgtctcaaaaaaaaaaaagtgcgggggggtgcttaaataagcattatcaaacctatgtctaataaacacaggatataacctaggcattatcagtgtttctaactagggccatttgctcccaagatcatggcttaagacacttgagaagaaaaagggttacttaaaaaggaaaacctttgataataagcagttctgttcttgcttagtattcattacactatgcttaaatggttatataacaaaatatatacaaactcagaattcacaaatacctttttttctcattctgagtactgaaacacaaatatcttttcataattcaactatgggacttcctttagttgggaagaaatacataatttacttaaagtagcacagaagagaatggagttaaaagtttcaaatattctcaatcgccattgtctgttatcagagtcaatggtaaatgtttataaagtggttactctattcccagtttcagatatactcaaacctaccacccttccttggagagtttgtggggaagaactagcaaakaagtcgctgataaaaacttagagattatattcatcacaatgttatcartctgggattaggctggaaactaaaaacgggtaaggttacttgagactgaaaasatatgcaggatcatatacatattaaaaagacaggcccagtgcggtgcctcaggctgtgagcagtggctcacacctgtaatcccagcactttgggaggccgggggggggggcgcattacttgaggtcaggagtttgagaccagcctggacaatatggtgaaacccccyctctstactaaaaatacaaaaattagctgggcatggtggtgcacgcctgtaatcccagctactcaggaggttgaggcaggagaattgcttgaacctgagacagaggttgcagtgagccgagattgtacggctgcactccaccagcctgggcgacagagtgagactccatctcaaaaaaaagaaaaagaagaaatgaggtacagggctgggcatggtggctcatgcctgtaatcccagcactttgggaggccgaggcgggtggataacttgaggtcagaagttcgagaccagcctggccaacatgttgaaaccccatctctactaaaaatacaaaaattagctgggcacagtggcaggcacctgtaatcccagtcacttgggaggctgaggcagaagaatcactggaacccgggaggcagaggttgcagtgagccaagattgcgtcactgcactccagcctgggcaacagagtgggactccatctcaaaaaaagaaaaagaaagaaatgaggtgctaacacaattaataatgctagcatttagcatactacgagcttcatgagaatgagaatttctatctgatatgaacattgcttatctccagctgctaaaatagtgcctggcacaaagtaggtgctcaataaacatttgttacatgattgtagaaggtatctggctcaaggaataggacagatctaagttcaagtgctagctccacttcaaactgtgaccctggtaagtcatttaacctcttaaactctcatttattcatttgtaaaatgaagataataggatataacagacttgtgaggaagattaaatgaggtaatgaaaggaaagcatttagcacagtgctttaaaagccttaaacttagtagacatgcaccggtagtcccagctagctcagaagttcaagggcatggtgcaccatgattgtgcctgtgaacagccattgcactcacgcccaggcaacagacagactccacttctacaaaaaaatttaaaaaattagccaggtgtggtggcctgctcctgtaatcccagctactccagaggctgaggtgggaggataccgtggagcccaggagtttgaggttatagtgggctacgattgattacaccactgcattccagcctggacaacagagtgagaccctgtctctttaaataataataataataattaattaattaattacgagtgttcaaacccaaagaatcagaagatgggggcactctcaggactcagctatattcctctggggagtgatatgycccatttgcaaggggcatgatgtggcacctattttccaagctcagaactgagccctaagagggcagggaacttacctgtattgttggaaccatactcccagcactaagcacagtatggggcacataggaggaactgaatacatttttgttgaatgagtgacactttgaggtagtaaggaggagcaggcatactttcctatgcgtcaggctggccctgctgctgctkcttcttcttctttttaaaaggagtctcactctgttgcccaggctgaatggagtgcagtggcacaatctcagctcactgcaagctccgcctcccgggttcacgccattctcctgtctcagcctcccaagtagctgggaatacaggcgcccgccaccacacccggctaattttttgtatttttagtagaaacggggtttcaccgtgtcagccaggatggtcttgatctcctgacctcatgatccgcccacctcggcctcccaragtgctgggattacaggcgtgagccaccgggcccggccggccctgcttcgtaagaatgaaaaggcagtgggccgcctgtagtcccagctactcgggaggctgaggcaggagaatggcgtgaaaccgggagacggagcttgcagtgagccgagatcacgccactgcacyccagcctgggccacagagagagactccgtctcaaaaaaaaaaaaaaaaaaaaaaaaaaaaggaaaagaaaaggcagtgtaggtggtgtaggtcagtggtctaagttcattcacaaaaagcatattaatgaagctaagtctttttgtttgtttagagaaggggtctcactctgtcacccatgacggagtgcagtgacacaatcactgcagtctcaaactcctgggctcaagtgatcctcccacctcagcctctccagtagctgggaggcacaggccatcatacctggctattttattttttgtagagacggggtcttgctttgttgcccaggctagtctcaaacttctggactcaagtgatccttcctcctccgcctcccaaagtgctgggattacaggcgggagccaccctgcctggccaagaagctgagtctcaagctggatagaagctactgacagggctggaagaagggggccaacaggaggaatcataacagagggaactctgagcaaaagcaaggaggcaagaacttgagtgagtgagagagtgtgtgagtgtgtgagagwgtgtgtgtgtgtgtgtgtttatgggctgtttctaataagcctgacttctcctggaatcactgagacttacctgctgccaagacatgtccaaagatgacctcagacacatcttccggagccacagtggccctcttcaagacttctttgatgacagtggagcccaggtcctggacaggaacagcagctaaggcaccattgaaggaacctacaatagaaaggcggagagcgtggacatcacaagcctgcgggtaatacgggaaccacctacgagcaggggagcctcatgaccctgtttggcaaggccacgcgaggaggcagtgccctctcctcccacacgttcctacacctgctggtctgagcaaaggtcaaggtgggtgccacaactcgcagcagccgagggctggacaggcgacctccagaacggcctagggacgccgctgtagcccttctatttccccaaatccgaaggactggatgcgaccccatgcttcccaaacaaaaggaaccggcgggtcaagggcgttgaaaaccatgcggcacgaaggagacgaagtcacgacttctagccattgtgtgacagcccgaccccagcccaaagccgggctcagaccacctagcagttccgcccctgcygcaggcattaccgatggcgcctcccggagccggccaatcaggggccccgsaggagaacacctccctacgccamccaaygggagaggcaggccacgcgatggctctaccccgggagccaatccaagcacgagggacsgagtrcgcacatcgggagaggagagggtggggctgtagcaccaggtcagggaacgcgggagscgcagggttccagggatcccgcggctcctcgcggcttggcctgaccggcttcctccacatacgcccctctcctacacaagtccggccctcggcgctcctgccgaagcagcaggcgcctcggactctgcgcggctcccgccggccactcacctatgatggtccgcgccgccgagacgatgaccacaggatctgagcctgcattcatcttgcttctcctgccgccgtctgccctgcgctgcctgcaagctaggcaaagctcctcctcgcagcccacaggcctgccgcgggcgggacctgaggtagccccgcccctcgccctccacctccccgcgcaccacctccccgcgcatcccactgtgcgcaggcgcaaggccggagcaggggcgggcggaggcgcgcggggcgcggggcgcggggcgcggggcggaagtgaggccggggcgcggggcgcggggcggaagtgaggccggggtctgggcytgcgggcagaaccgcggacctcggacgcatttacagagcgcctgaaaccccagtgtttctggacaccccaatgttggagttccccgacttgacgtyttgggcttttttttaaaaaatcttagggtttctcgaaacagtaaagactggggggtgacaaagacttatctctcgttcagctcaggactggaatcccacgggcgagaatctcgagtgcgagcccggcccgcrgcgggtctcagcacagctctgatgggtccttttgctctcggcggcttcgggaggtcctatgcgtttctcctggcgccagtcattcgctcgcgtgaggggcttgctaggagcgtctcggtgcgagccccctgccttctaagatcaactctggctgtgaacgggtgaggacgccgggagcgtcttagcgtcacaaaagttcctttggttgacgtttggacagtgaaaggagcatgtaacaagtggggtcagttttgtttaaaaccctttctgacttcccagcctcttactgggcaaagttcataatttttctgagctttctagggtttccaggcaagcttatgaggggccaccgttacagcaacttgttgggaacacctggatagtggaacaagaaagctttgtcacaaagtcatgaaggggaaaactgttgacggacctggagaatcttcctgaagaactttaaagttgattgaaagaatcattaaatcctggaaacctacattaagactttgcagagataygcggatgggtcagataaatcagagaaggtaaagagtgtaggccccagaggtggggcaatagagaaggaaaaaaattgcataacagtgcaatttcaggagaaatctttagggtctggaatagtggtgaaatcagctgtctactctgctaagaactcagcagcacactgaagtctcttcagttgtcttcaatgtgtttcctgtcccctaacatatctgartccaaggaattcaaggaatgcctcccgtggcttttgctctattctatcccattttccccttactccctggccacttctgagtctttgtgggcttactctcwcatccccttaacatgttccccaaggctcctactttgcacsagctccctgggtaataccagtcattcctacggcatcaatcaccacctgtatactgacaagtctgaaatccttacatctaacctcgtctcctaagctgactgaccctcttcatttaaattcttacaagcacatcaggtcgggcaccttggctcacacctgtaatcccagcactttgggaggccgaggagggcggatcatttgaggtcagcagtttgacaccagcctggccaacatggtgatatcccgtttctaccataaaatagaaaaattagccgggcgtggtgccgtgcgcctgtaatccyagctactggggaggctgacatgggaaaatcgcttgaacctaggaggcagaggtttcagtgagccgagatcacaccactgcactccagcctgagcgacagagagaaactgtctcaaataaataaaatttcctataagcacatcaaatttgacatattgaaaccaaactcttccagcctgtttcttctgtaatctcagtgagcagtgaaactatcttctgttaaccaaaccagaaatttacctctgaaactccccctaaacatcacttcttccagaaaaaccttccaatctcctgcatttggtgcagcatcttacccctaacttcctctttcaayttaccatgtaattcctagtttatctgtctcctctactgactacataagctttccaagatgatcctgttacactgctttatgcacagctcctagcacattataggcagttatgaatgaacaccaatattctttatggccagtgcctagcacatttgaatgagtatgaatatattcttctggagccaagggatatagagtttcctgcctgaaggctctatctagagtaagtttaggagccaatcttgagaaggtaattgcatgcttctgctgagtggccaaacagaatctgtcccctgaggagtcctcattatagctactcatatgattatctactcatatgagacagacagagactaagaataatgaatgaaggaaagaagaggaattttttttttttttttgagacggagctcgctctgtcacccaggctggagtgcagtggcgctatctcggctcaccacaacctccacctcccgggttcaagcgattcttctgcctcagagtcctgagtagctgggattacaggcccgtgccatcatgcccagctaatttttatatttttagtaaagacggggtttcaccatgttagtcaggctgatctcgaactcctgaccttgtgatccgcccacctcggcctcccaaagtgctgggattacaggcgtgagccaccgcgcccggccagctggaagataatttttaaaattatgtcttggccggccgcggtggctcatgcctgtaatcccagcactttgggaggccgaggcgggcagatcacctgaggtcgggagttcaagacctgcctgaccaacatgcagaaactctgtctctactaaaaatacaaaattagctgggcgtggtgccacatgcctgtaaatcccagctactagggaggctgaggcaggagaattgcttgaacctgggaggcggaggttgtggtgggccgagattgcaccattgtactccagcctgggcaacaagagcgaaactccatctcaaaaaaaaaaaaagaaataaaataaaattacatctagatctcaaatcataaactacctggactggtgagcagggtgagtgggcaggaagccacaaaaatctccaagtgcttactcatgaggagccatcattacagcagtgctatggagccagtttatcctgaaggggccttctcagcatcttcccccgctggaagatgcaatcattcttggttaagtttcataaagagttgcaggagtccaagccaggtctttgctacaggctggattcaccaacctaccatgcagcaaattcctccttggtctccatgaggggaacagtgaatcaccaaagtggaattgycataggatgaaggtcagcagtgtactccttaccactaggggctagctcaacactccctcagcacagccaccccatgatgggtccagatcagttaatgacattacctgggattatgaaagtgttcactataaccacagggataggtgaactcccaagacagtgacgtagagcagcaggcaatgatttgagtacagggcataactactcatgaaagagggaacatctgagaaagwaagttgtcagaaggaatggctttacattgttttgcaaaagtgtctcaaaaactggagtagtcagttgtatccaatacacctgaggagccaaggaaactgacatctattgcgctctctgtatgaggactaccaggaaccaaactggggcaccaatcagggggcactgtgatctttagacttcccagcctccaaaaacagtgaggaatgcgcgtgtaaagccacccagtctgtggttttttttttttttcacagcagcccaagctaagacagcagtgagtgctcttacaggggagaaaaacaaaacaaaatatcgagcctcgaggatacatttgcccaaatcagttaagtgtaataccaggattcaaaccaattagatgcaraagccactctatcacctctcttatcacaggcataccagaaaataaagcatccaattccagaaatgagaaatactgactctgtgtaccacagaataagtgctctgagttattcatcaaggcagactcaacagaaacatgaaaatgtcacattaacaggtccatattaaattcagtcataaaattgtatcactggttgaaaaattaatttcctatcacaaactcttgattacattacaccaacaggacagagaaattacatttttgtttaaattggtcaagttgaaggatgtacataacaaaagccaaacacagtatctgatatatcaaacaccaaaatgtttaatcacatgcaaattaaaaatcgtataggattttttactcacttgagcagactgtagaaaaggttaatcaaggttgggcgcggtggctcacacctgtaatcccagcactttgggaggccgaggtgggyggatcacaaggtcaggagttygagaccagcctggccaacacagtgaaacctcatctcttctaaaaatacaaaaataagccgggcatggtggcgcacrcctgtaatcccagctactcaggagtctgaggcaggagaattacttgaatccgggaggtggaggttgcagtgagccacgatggtgccactgcactccagcctgggtggcagagcgagactctcggcaaaaaaaaaaaagagaaaaagaaaaaaaagaaaaggttaatcaagagacagtgcagtatttaacatactgctgaagaccggatatacctgtatcagctaaacaagcaaaagcagcaattactttcaaataagttgtacctcagttttcgagtattataactccactcccaaggttccttgattgtattacaagttatgtctaaaacaatactttgcttttaacagaaatggaatttcatttcaaccatatatgaaagctacacatttgaaggccattcaatatcatacttttatacttaattacctctgagaaaatggagcaaattttgacattcttccaccttaaaaacattttctcctacctacattctaacaccccttactcatataatattaccagatatgttgttagtaaaaatcagtagtgctggccagcgttttaaaacaaacatcactractacaaagatactctacttgaaatcaggtcacaaaaaaccaacsctgcttttcaattaaaactcaaaaagggccaggagctgtagctcactcctgcaatcccaacacgttgggaagccaaggcagaaggatcccttggggccaggagtttgaggccagcctgtgcaacatagcgaggccttgtctctactaaaattaaaataaatgtagctgggtgtggtagtatatgcctatagtctcaggtactcggaagcctgaagtgggaggatcacttgagtcgaggactttgaggctgcagtgagccatgactgcaccactgcacttgagcctaagtgacaaagcaagaccctgtytcaattaaaaaaaaaaaaaaaaaaaaaaagcctaagaaatagatgactattttctttatacttttctgtattttaaaatattttgtaacaattataagtcaagaaaaaattttaagtgtagccctaaactccagctccgttttgcaaaataaggcataaattaaaaattgtgtgcaaaatcgtaatcgatgcttggtcttaagtttgactgttgtggtacttgaaggataatgagtagaaattcaatgactcaatgaaaatgacaaatgctaaacatacacccaaaacaaaacaaaaaagctaattaaggagttacaataaaaatctttatttaggtttggtcagtacaggtaagatatactggagtcacagagcaatatgcattaacaggatacaacagttcataaaaactgagtaactatgcacacaaatttcttaaacagtcacctaaagagaaaatgcacagatgtatggtggaaaaaactgtatctaacactgaaactactacaggactccatcaatgagtccaacttttagtgataaaaaactactgtactgggcaaacttggcagtcataaacccacatctactctaacaagtytgaatggtgcataagtacagtaacagcatgagtacgaatgcccttacacagcacagattytaaacagacagatttatacagacatcattgtgttgtattttaaggaaaaatttccatttacaatttcacattaactcatataaaaataacttgaccctacacaaaatgtccttttagcaacattcaaagtaattaactgttacaatttccaaagcggcagaagtattgaagcaaaaaaaaaaaaaaaaaaaaaaaaagaaaagaaaaaaaaaacaaagaaaaaaaacaacaaaaaaaaaccaaaacgtacacccacaaaaaggcaaattgtgacaaaagtatgcattaattttctggacagtatcctctcccaaattaaatgacactgtataaaaatttgctgaaaaaatattacaaaactgaaccctgtacatttacacttgagtccaagccattctgaacgtggcgggaacccacagttcgattacctttcccactcactgctttctcctcttgagggtcatgact

SEQ ID NO: 13272 - DNA, 149382 bp, Homo sapiens
  misc_feature (1)...(149382): n = A,T,C or G, or insertion/deletion polymorphism (see Tables 1-2)
ccagtgtcattcaggatcctgatgtcttccgtcttgttcccactgtgttggccacattttccctcacagttatgaggggacagcagtttcatatagaaattactgcatccagacaacaaaaaaacacaaaaggggaagggatttctgttttgcaactctttttattggagagaaagcattttgcagaagatctcaggagacttcccatcgagttccatcatcaggactgggtcatacgcccttgctctggctgtaagaatgtctgggaagtgagaatctcrcacccacagcctctggtggaggtgggctttgccagcaatcaagggcatgagatgcctgcaggaaggcagccaaccacacctgcctcatgcctctaaccctattcccctctaaattcccatgccaaagccttagggcattatctttgatagttacctggccaggtgttaactaactgggaactgggtgtttttgaaggacacaaggctttctgctgtcgaatttgtcaccttaattgtgatacttttaataaattagcttccagtctatcttaaaaccagatggattttcctgatgtgtcaccgtgaacatctctctttctccaaatctctcaatgaggaggcagttgatgagttaactgcatgggctttggtcccagatcatacagctcacatccaagcrctgtcacttaccaactgcatgaccttgggcaaggtatataatttctttatgactgaattgctcatcttttcaaggagggtaataaaattacctatttggtgggattggtattaacagtaaatgatataatacaggaatggtattgacagtgagccttcagtatgtattattgtatctgctgttattgttccctacttcatatccagccaaatctaagcttattagatgaccatttaagatcctctaggagctgggcacaataaaaattttcaaacttatataaaaattgactacgtcctaaactgcgagctccttgagggagggattatattttatgagcccaggatctagcacagtttttggccaaaagtagtttttctttattcccatgtgacttttgcttaagcaaaaggccttgtacagcaaatacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttgaaaaatgtcaaacctatagaaaagttgaaagaatagtacaagagcactgatatattcttcactacatttgtgactgttaatatttttaacctctgcttgctattcatacatatattctttttttcccctgaaatcatttgaaagttgccaacatcatgacacttcactttcagcatgtatcacataagaacaagcacatcgtcctatgtaatcacagtagctttatcttatgaaatttaacattgattcaatattatttactgtacattttttcttggcagtttatgatcttagaaatcaagaagcctaaaatgaatcactgtgtgttttgagggtcttttggtagaatcatgttcctttctgggtgttctaaaaagttcctggatctttggggtgagattctgtttgagtttcagaacaatgtgtgcatgccatcagtttgatagctcatggtttgtgttccaaaggggcagctattagtgttacctgtccctgctattgctcttgacatcatgcagggacatcctcagtagctgctctttctgcccttggtctgtcatttgagcttgtgtttccaaagtcagatgcaggaagattgggtcctcacaacagggcggtggttggagcacctggatgccaagcctggatctgtcctatcatttgagggacatttgtgttcttggctatttgtgttcttaggctgccataacaaagtacctctgggtggcttaaaatgacagaaattgtctcacacagttctggaggccggaagtccaaaaccaaggcattggcagggtcacgctccctctgaaggctctaggggagaatctgttccatgcctttgtcccagcttctggtgttgctggcaatccttggtgttccttggcttgtagatgcatagcacctccattctcatatggctgccttctccttgtgtgtttcttgcccacttcttgaaagtacaccagtcatactggattaagaacccaccctactctagtataacctcatcataatttatccataaggaatgaccctattttcaaataaggtcacacttgaagtactgggggttatgagttcaacgtattcttttaggggacacaattcagcctataacagggggtcttaggctgatatctgtgagtctctgcttcctcaaaggtttttcagaaaatttaaatgaaatacaggagaattatgccctgcagtatttgactttacagcaggagtcccccaaccctccgggccatggacttgtactggtctgtggcctgttaggaacctggccgcacagcaggagaacgagggcattaccgctgagctccgcctcctgtcagataagtggtggtgcaaaccctattgtgcatgagaggggtctagggtggactgtccttgtgatgcctgatgaaacatcccccacaacagccctccaccatccatggaaaaattgtcttccacgaaattggtgcctggtgccaaaaggttggggactgctgctttaaagtcccttatataggatttacattaaaaattttccagtggtctccaaatgtcccttataccttcctatttttgggtctaggctccaagtaagaatcacgcattgcattttgtcatgcctttttagtctcctttaatttaggacaatggttctcaaacttccatgtgtatgagaatctcctggagagcttgctagagcaatctcctggtgccaaacttccacgtttatgagaatctcctggagagcttgctagagcaatctcctggtgccaaacttccacgtgtatgagaatctcctggagagcttgctagagcaatctcccggtgccaaacttccatgtgtatgagaatctcytggagagcttgctagagcaatctcctggtgcccatctccagagattttcattcaataggttgaggcaggacccatgaaatggcatttctaacaagctggtaggtgacacaaaagttgcttgtctaaggaccgcacttttgaaaaccactgatctagaacagaggttggcaagctttttctgcggagggccatatggtaaaatatgttagcattttcaggtcatacagtctctgttgcaacgactcaactgtgtcattgcaggcaaaagcagccctagataatacataaacacatgggtgtggccgtattcccacaaaactttatttacaaaacagctgccttaccacatttgacccacaggttattgcttgctacatggatttagagtagcacttccactttttttctctttttttttttggaggagagttgttttttcagcgcattaatattttgcaatagtccagttcagttttcttgtcatatgtttcacagtttgaatttgattgttttatctcaattagattaagttgaacttcttggcaagactacttgtgatagtgtgtacggtagggaataactgtgaaagactttgaaatggaccaaaaatattagtggtcaactgtaatggaatgctagctgtttagtacagtcttttgggttatctgattctatggggtcttgtgyctgccactgtctttgaggtattttacaactctgtaaattgtagactactgatggtaatatacacgatttttgtctttagaaatgcaaattgtgtctattgcgtacgcagctgttttttgacctatggttactgaccaattttccatctatagacaaccttatttcagcattcctaactgcttgaatatttgttggattctccttggattttcctttgaaccagctgtgacatgttaccggttctcacattaatgaatgagctaaggaatacctttgatacatgttcattctacatctgagtcatgattataccatcttttaaatattaccctttagcattttttattgcatcactttagaaagcagaaaatgctagttttttaaaaattggtgatactagttttaattacttgattaaggtggttctaccagatctttccattgtgaagaggtattttgtgttttttaaggaagtatactttgaaggtgatactttgagacaaagagaatattccgcttcacaataatttttcaccrgatggttttagtatttactgatggtctttgcctgtatccattataacactggagttgcaaaacacaaaccctttttctttttttttttttttgagatggaatctsgctctgtttcccaggctggagtgcagtggcacgatctckgctcactgcaacctctgcctcctgggttcaagcgattctcctgcctcagcctcccgagtagctgggactacaggcgtgtgccaccacgcccggttaattttttgtatttttagtagagatgggatttcactgtgttagccaggatggtctcgatctcctgaccttgtgatcckcccgccttggcctcccaaagtgctgggtttacagtcgcgagccaccgcgcccggtcaccacaaaccctttttcgacgtccacagtttacacctgagctctccctttgacccactacaacactttcttttcttgggcaatatattaatagcacggtggttatgtcacaggcctgtgactggcttgggctcaaacccgggctttttcacttactagctgcaagactaactagttatttaatttctccattcctcactttccttatctgcaaaacggatgcaataaaggcaccccctcttacaggactgttaggattaaatgagctaaatcacagtgtccgaacacttcagtacttcgtacataattacttgctcaakaaatgttagctattattgggtcatgattatttatatgtgtttgaattccagctttgccacatcccagagtgtctttragtaagtcactgagwatccttgtgcctcaattcctcatctrtaagtaggttcccatctcataggtttttaaagattcatgcttacatgcttagcagtgtctgstatggaataagcactaaaaaagatgagcttttatgatgatgatgattactattttcagtcatgattattttgtatatttactctaaaagaaagtgaatttttttagttcaagwcttttagattcatcgttctactttcattgtggctagctcatggccatccacgtagkkaattaataaagctttgttgagtggcacttgcttgacagcgacacttttgtccactctttcaccttgctggatttgtgctgccttccttgctgtaggaagcccacgcttggsaaataacattcccacagaaggtctgagaggctctgacgggccaaggttgtaaacscccatgatttgactccacgggcagttaaagtgtgttcccaccccccacggatccgctgccactaggctgtgcgaaggcatttacctccctggcactttgatccaagttccctattttcccctactggtcgatcgaggttgggaacagttgctctaacctgggaagcacccgccacgatccagcagggcgcggtgggaggggaaactgaggcccggctaggcacccccgccgcgcccagcccgccgagaggctcaggccccgggaggcacctggagcctgcgccccgcccgcgccgcttmctgtcccgcgcgctgcgctcacgtgacccgggcctgggaggagccggggcgggcgggggtcacctgaacaagggagtcacgtgagcggggggcgggggtgggggggcggtgccgggcggctgtcacgtgacgcggttccggggccgccgtgccgtgtccstgtcgccgagcccagtcgagccgcgctcacctcgggctcccgctccgtctccacctccgcctttgccctggcggcgcgaccccgtcccgggcgcggcccccagcagtcgcgcgccgytagcctcgcgcccgccgcgcagtccgggcccsgcscgatgggggccgccgccggccggagcccccacctggggcccgcgcccgcccgccgcccgcagcgctctctgctcctgctgcagctgctgctgctcgtcgctgccccggggtccacgcaggcccaggccgccccgttccccgagctgtgcaggtgggtggcccgcccggacgcaggctccgctcgcggtgcccggggtgagcggccggcgtggggggcggggagcgctcgaggagctcctggggtctccaagtcgcctccgttccgcgccggggtccgccccgttcccgagggaaagttgcctgcgtggtgtccgcgagtcccgccgsgtcccgtgcgcaggcggggggcgcgggggcacacgcggtcgtggcggtcctggagccccgcgtccggccacttgtggctgtcgctgagtcgggggtggctttgtgcggagcggtcgccccggcccttggggtcggcgcctgccctcgcgcggccgggcgtccgggaaagttggaggcagraactccagtttgctttgttcccgctgcgcgtttgcatcagagtttcgccagcggggcaccggtgaggcccctcggtgtggagaggctcaccggggcgttggagcccgcaggaatggtcctggagttgagtgtttgtggtttcatttgctgattgatttccccccgtgggctcattttctctttaaagaatatatatatatatatwtttttagcaggcggtgacttttgtcttctttagattgggggcagggggtgtcgtccagtgtgagctttcaagacttgacccttcacttctctgagcccaacttcctgcctggttgctcacatgatgtcattgtctccggggcggattattctagtggatcttgctctgggaaccatgattgtataacccatcagtcccatygagggctgttcacctcgcgcaactgctagcagtccagggcctggggaacttcgaatttcaggaattttctgaccatccttttctggactgtttaggatgatggaaaattcagcttttgtttatttttttaaactttggtaaaaaggaagcaggatgaaaagttttgaacagacaacagtttctccctgttactgttacttttacaagttacttttacaagttacttttcagagtgaaacaaagttgagcctactttgggctgaacttggagtttgtggtagggtttatggggggggttcttatttttcccatgcatcagagatagttttrttagcacccctgtgttcagaacatgcagaaattagtctaaggagggtgaggctgatctcacgatagaaactctttggaaaggcccatattttttatgctcccttttttggaaggggaagggtggatggagggagagtttgtgacactagtttaaagaccagttagctaccctaagatacatagttactcyagtaactagtatgatacagagaaatggtggcagcttaaacgaggtcaggctgagaacaacatttagaggaaggcattttggaataatggcttctgtgaccaaaaataagaaattaactcgcctgggcgcggtggctcatgcccggaatccagcactttggaaggccgaggtgggcgggtcacttgagtccaggagttggaggccagcttcagcaacatggcgaaaccccgtctctacaaaaaatatgaaaattagagccgggcgcggtggcacactcctgtcctcccagttaagggaggctgaggtggtaggatarcgttagccccgsaggtcgaggttgcagtgagttgtgatcgagtcgagttgcactctagtctgggcgacagagcaaggccctgtctcaaaaataaataaataaatacaataagaaattaacccagctggcctagtgtggttgaagtcttggtcktgttaacaaattgaagtttgttttcttcacagttaagattaaggtggcttcaagggcagactgatactttggctgattgatgggacccttacttttgcattaggttagtcatggcagtgtcttgaacctgtgttcacgaacttcatctccaggtggaacacggcctcttggtctagtaggaatggcctttgtatctttacgtttttctggccactgtcacacgtgggcatacttagcaaatgctgaaraggtttctgaggttgatatgcattgtgaatataataagatctgccctttgtagtcttagaatatcttaaaagttgtgtttaatttttctgccagattttcttaggatgacaaatctgccaatcatttcagagacggattttcacccacctcttyccctgttacttccctgtagttgcacatgcagacttctccagaaccacttgcaatctctactttaaacccaacatgtgccaagtgaacttcctgtctgttcctgttttataattttttgaggcagggtctcaccgcgttgcccaggcagaagtgcagtggtgcagtcatagctcactacagtcgtgaactcctgggctcaggcagtccttccacctcacccttctgtgtagctgggattacaggtgtgtgccaccccacttggcttattatatattttttaaaatttttaatagagatgacgtcttgctatgttgcccaggctggcctcaagctcctatcctcaagtaatcttcctgcgtcagcctcccaaagtgttgggattacaggcatgaggcaccatgctgggtttatgttcctgttttaaactgatacctctccttaaatactttttgaaaacttttcttggggcgggggaggttatcagtcatctgtacttttatgagataaaactggctaaaatttccgtaaatgtagcatgtagttgaggaataggaatgtaagttgattttttttttaatttgatacaaaaaattttaycgtgtcaccaaggtgtgacgtgttaagctccattttaattttgttcctgggcatcagtttgctgaaatgtaaataactcggccaggtctccactgtgagcatgaaaagtcgagtcctacaaatgtccccgtttgtttttgctgcttggtcacatggaggcagtcccaaatgtacagaaggatcacattccaaatgtttgtaaattggtmatttcatacgtggaatgtgtttttccattgatagtattcttgttcattgtatggcccccagaaagtcattatccttgcaaaggttttggagcacccagacaccatatggctttaacagaatcctagccgtaaattctcattgtctctaaaagatggagttggatttccaggaaaactacctctcctcccaagcccagctctctagaacctagagagaatatttttcatctgcagtcgcttagacccacaagagggacatgagggcctgcttcaggggtgcctgcgaggcaccttgtgggggcaaagcttcaaggtgacctttggctctgagcactcctgggatggggtgcggttcctggtgcagttagttattgggaggaacgaaggagacagcaccatttcagcagcagctttaactgtgtcygtgcacgtggaggggcctgccctctgagttgtgcattgaacagcaggcaygacaaaggcwcatttcccaaagtgtatctggcttgaagcagcgctttaaataagtgcatggttttttttggagagactcagcaaagcatttttcaagtgtcaagtggattacttgccaggtggtcccagtgctgagttagaagttaatgattcttatgcaggtatttcttgggaggtgatattgctagtacaaagttagtagaaaacttgtttctgaggctagtgtgataggctgtgggactggcctgtagaaaagacctggggcaggaaggagtgttgaaggtcagtggagggcgggaatagtagagcaagaagagagggcattcaggargagaggagcagaggccaggccatgcaaaaccaacaacagtgtctaaagtgatctcrgcttgtcagtggctttacttattaccatatgctttaaactttgtaaaatgtcatattatatatgtaatatgcaagtttccaccctttagttaggtgttaacaagatgcttaatgggtgaggtcttagcagtgtgcattaatgataaaataatgctttgggatggttagatttaaggtagttaagagcttcaaaatttgtacaggacaagttttccccaaattgtttaggtataaatgctagaaagtttttattatattgaggacaagagaataatgaagccagctgggagttgaggttggtttagttactgtctctaaggagatttttttttccctgtaatttttccaaaggaacagtgcttatatgcctaatttgggccacatgttaaacctggatcacatccatttgtgtgtgtgcatttcaacagtaagtgtatgtggaagcctaaggttgttaattatggttacattagatctcatggrttaattctcagaacagcatcctgacagattcccaggaaatgaatgcctgcgttgggcctcacgtcttttgtcagcatttcatagagagagggatttttaaaagatggggctgagagaaataattgagatgttcccttccctattttgatcttggtatataaactattgtattggggaaagaactgagcaggctctagaactgagcctagtggcagagagtagcttatcactttgcaggtgctgttctttttcttcctccttttcttctttggattgtcctagccacagagagctcttgctaatgttgtaactggtcatgaatggtgtatgaggaggtgggcgtagcagctgtttgacttcatgggacccaccagactgtaatgccgaattacaattttgcatttccaccagtgatgtatgagagttccagttctatatccttgtcaacacctgtcagtgttaggtttagccattcaagtggagttgtaatggtatctcagtgtggtttcagctttcatctctctgctgactcatgatgttgagcaagaaaggaacatcttttcttgtatttattggaatcctggatgatgttcaccattatcatgtgcttactgactgggtattttttgtagtgtcctttaaaaatcatattttgtcccttttaccccttaaaaattgtttttgggttcttctccttattgagctttaggagctcctcatgtcttctgggtacaagttctttcttagatatgtgtgaggtatgagtgttttctttcagtctttgccttgcctttaaattttctcagtgatatcctttgaagaacagatttaaaaaaatttgatggactataactttttatggtttgtgcttttggtagcttgagaaatcaaccttaaaactrgtgacatttgacctgggtaattttttgtttggagggctatcctgggcattgtaggatgtcagccagcattcctggcctctactcactagatgctaagactatactctaccactccccctcccccagtggtaacaaataaaaatgtctccaggcatatcaaaggccctggaggggagggggcaaaatcacatccaattgagaaccactggcctaccccaaggtctcaaagattttctcctgtctctgcctctagaagttttttggttttaactttgattccttaactctaggatcaatttttgtggtttaatttttatatatgatgtttgaagaaaactcaaaccatatttttcctttgctctcattccatgaacagtcatcaacacagaagacctccgtaatcaaatgtgtggtcgtttttccccaggcaccaagcagtgacccctggccaattcaattcctgaccctgtctacctggagatagtgtcagatgccacaggtttggggctcagttcccgagaccgctccccaccccacaccagtcacaagtccgggcctctggaacttctgaccaactggcttcaatttggggttcccagagtgcctctttgggtctgattaatttgctagagtgacttacagaactcaggaaaacactgatgattagcagtttatgaggatattacaagggatacggatgaagagatgtttagggcgaggtaytggggaaggggtgcggagcctctgtgacctccctggctcactaccctccaggaattgccgtgcattcaactatttggaagctcccccaacccagtttttatggaagcttcaggaggtcagcatttcttctcccgggtatagggtgggaccctcactggggaggatcttaagrcccacagtccaaaagcagggaagatgagagtcctaccttggggcaggtggaaggaggggcaggtggagagattgtttcctgaggcctgacacacccaacattataacaaaagaccaatactaggactgtggaagttggcagccagaaaccagatgggaaaaaaaaacccatacatgtattatatatatttatatatatatatatataaartatatgtattgtgtatatattatataagcatatttattatatatatattatagtgtatattatatatgtattatatataatatataatatatagttatatataatatatacacaygcacatatataaataacaccacaaaaagggtaaaagtttatttatttccatgaatatatctagttctgtttactaatactttatgaaatatgcttacagctctgtttttaagtgagattgggctacagtttttttgctctgctgttcttgatggattttgttattaataatatgtttgctttgtggaaggagctagttagcttttagkatttttgtatgtggtgaaacagtttgtatataagatggacattttctgtttcttaaagtttggtagaattcaccagtaaaactatctggccctggcaggctcttaggtggaatatcatcggggaggacttttgattatgkttttttctagttttattttcagttttatctagtttatttttctattcagattttctactttttcttgggccaattttggtaatctctattttcctagaaaattgtcattttaattgtgtattcatatttaataagtagcatgctactctcatatttttgatactctatagctctaggtaaatttttaaaattcctgatgtttacttgtgtacttttttcttaattatatttactaaagacttatttacctttttaaagtctttccaaaagaactagtgttttgttttttcatcttttcaccttttatttgcaattttattaatttatccactcagtaacttstacatcatttttctgtttctcgtttgacttgaatgcttagctcttttattttaaatcattttgcataattaagaaatatatttaaagcttcatgtttctttcttcggagtrccataccactcatagattctgatacttttttttttctccatatttcaattttgtgtattycctttttggattcaaaagttctatctgtttcaacttcctggacccactaaatttttagatttttatttttttcaggtccatggactttgggggttttaaatttattttttccattgtgcgggtaaatgtggtggaacttactgacatttcccttgtggcctaacacctagtcaagttgggagggtattatgtgtttggaaaaaaagttctctgtttgggtcaaagttactcatggtgctgttcagcttttctttgccctaactcttcttcggtttgtctgttgcttttattatttgtatctggctgccgctgtggacaggcaygtagctggatgtcgtttgctgctgtcrcccagcttaccagttctcccatggttcagatgttcttctgcttccctgttgtcttttgttgcagaatctcagctgatgtgtagtcacagctgcctgttctttctgcgtggacgctgtagcttctgtcaaccctctgaagatctctcttaaagttctgctctgattgctctattaattatttttccttgggcccagtttctttggtttgagtttgtcaccatgattgcatggtgctggtgcccttgcagtgacaggtgactcctgacygtgcactctgcagtgggtctccacccgaccttggctgcctccttgtgcagctgcgtggggtagggctgggagcagttgttggaatttggctgtaaattgttttcagggagactaggggatgggcaggatgtgcctctgtggctgttcttggcgctttaggtcctttccaccctcccaatgtcacccccaagcgctgttctgccaagacacagctgctaaacccctgttgattgctgctggcagcgtgtggcctgagacgggggatctggattgttgagttggctgtgtccaatcacttcttttctctggacctcattttcctcctcaagaggggtgggacttagttttctttctctctttcctatttgaaaacctytcattagggagttagttttggaagtcactttcctgggcttgaatccagactcctcccctcacaggccttgggcaagtcacagaacctctgargtcttcctttccgtgtgtgtccagtcaggatgctaaccatgtttgtaggctaggcgtgggatgctaaccgtgttgtaggctaggcgtgggatgctaaccgtgttgtaggctaggcgtgggatgctaaccgygttgtaggctaggcgtgggatgctaaccgtgttgtaggctaggtgtgggaattggaagacatttgaatgcctggcacgtcctcggtgttcattggtgctgtagtggtagcagttgctttatctgtaagttacagatgctgccttacatcagggatttatttttataacctgtttctcgccctcccagagctctccattagtgtcttggggtttctgcctcaaccagagagcatttcttcttcatctgtttcatgattggcactccacgtaagcttcctcatgagaaagaaaggtttccactgtttaaaaaagtttcaaagccactggactccgtgatttccgggtccattttgcatcccaaattctgcagttctgaggtttgcagccttgaggagtccttcctcactcagattcccccaaacaatgaggagcttgataaywcgaggtgtggagtttggrtgggggccgggggtcaccstcctgcatgtggtggcttggtcccaggctaggctgggagaaagggggctgtcgyggttccagkgcaagaagagccgtcctccctgtttccctgtggtaggatcaggaagtctcagctaacttctgcacatggtcaagggggtcctgtcctcacttaggcctctccaggcctccctggagggtggaggaatgggtgctgttgtaggtgggaacagaagtgtccaggccagtggcttggatgtgaaagtgcttcataaattccaccttgctgtgcaacttaaaaaaaaaaagtacggtcgtttaggttttcgaggtgcccaaagcaatgcgtcataagcctatttttgtctccgtgttagccagggcagaggggcactttcctgtgactcctccagggtggggaaaatcccaggtgctctgtgaacctggccgttcagccagctgcagacctttggtaggagttttctttttccttttgtgtgcttttcratcccctgggggcaaccattattcagtacwtctggagggcaagttgtccaggaagaggaagcagatcctaggagtgtcgtccttcactgggagaggtgtaggaagtgagggggatggtggaagtactggcccgagctctgttttcaggagtgtgtgacagcaaaaactggcctttgcagttgagttgcctgtgggctrtggcctagagggaaggccaggagggtcttgctgttagggctgccaccttcttcrtgcctgctgtgtgctgggaggagagagctccttcagagcggacccaccrttggattttgagtgtgtgcaaaattaacttgttgctatctgcatggttatctgtactccagaatcagttatacattttaaaacagctgtttagtactgaaaaaactcccccaacactccctgcgccccaccctggcctgcaaatagagtgccaagccaccagaatagaagtgctaaagtagtgagtttcctagaagtggcaagcctgagactccagtgagtcaccctcattgttcccctgaggcaccctgcctccacctgctctctgctctcgaagcgtcagttataccagcacttctctcttctcttttgtctctttttacagtcacccctttagagtgacaggcagcgtgagctcatggccttgactttgctggacatgcggagggagaggagagctggtggcagagtcgggggttgggccctgaggatggggctgttttattggagagtccgctgtcaccaggcctttctgtaaaaggctggaagtgagcgagtgaaccaggcascctggtggggggcctgcatgtcagacccagcgggaagcatgtctgacttggttgagaggcagctaagggcccagtgtgtctrggtgggctgagccattgggagaatggagggaggggccagagagcacggaggattagctgtggccagatcacagaggctgtgggactttgggctccctctgggtaaaagccagagcccttgaggacttcagtagattggtggattgaaaggcacatgggccggtgctgtggctcatgcctgtaatcccagcactttgggaggccgaggcgggtggatcacgaggtcaggagatcgagaccacrgtgaaaccctgtctctactaaaaatacaaaaaatcttagatgggcgcggtggcgggcgcctgtagtcccagctactcgggaggctgtggcaggagaatggtgtgaacccgggaggcggagcttgcagtgagctgagatcgcaccgctgcactccagcctgggcaacacagtgagactccgtctcaaaaaagaaagaaagaaagraagaaagraagaaagraagaaagraagaaaggtacatggaagattygattgcttggattgccttagggaactatgrgatccctaggtgagggttgcagttgagcatggtagctgcttttcctcttcaggttgcctttaggctgcgatggagatagcatgagctctggagcaggacaggcttctttctaacatgggcttggccactttgtgaatttgtgatcagagacaaggtcacggacctcactgggacctccctaggctgtccattctgagtctgtaagaaggtggagaggggcagccccagctgggtgttaggctttgcggagcctctgctgtctgatgtttggctccagcatcttcaaagcaggggcttttctcctctgtccacctgattggcctttgtgaggaaccaccacctggcrgtggcctcattagcatcatgggccagccagctgagctgacagcccgcaggttttctagaaaggcccaccttcccttgtagtttgcacactccaggaagggccctgggtctgggagggttttctgggaccttggtgacagggagagtagggggctgaacattaaggtctgaattctgcgctgggggctggattgtccttaaaggcggttggcctcagacatccacatggcaaagcagggagtttagcccatctacaactcttctttatacatgaggagcaaagtatgagaccgcccaggtaattgctctgattggaagaaaatcatcacggagcagggtttagggttgaaatactggcctgcatcctgtactgttgagttgatctgagccaaggatagcagagaggaccagccatttttgtggtagctttctgttgtggagggcacttgcccacctcctgggaacgccacaccctggtgtgtttgcccttgttctgtttcccctgctgctcttctgctggaagctctggactcacctgtctctgttgtggatggtgcagggcgggcaggccagagtggcatccttgtcctgagaggtcccaggaggcagttgagtgtgtatgtgtgcgtgagtgcgtgtgtgagtgcacgagtgtgtgagtgcaagtgtgtgtgtctgagtgtstgtgagtgcaagtgtgtgtgtctgagtgtstgtgtgtgagtgtgtttgtctgagtgcgtgtgtctctgtcttcatcagctcctaggagatgcctccggacaggggcctgcccrtctctccctccagttccttgccagtgtcatgtgacactcctttcagagggcaccccccgcccccagccaactcacctttttttgtaaacttagtttttaagcagtccaactctctctctggattcaaatgaaagctttagatcatagtctgtttcgatagctctgtgttcctggtggtggttttctcctcacaatgaccttgtaggctagctgagttttgtcgaggaagttgagctgggagagactrgctcacacagcttgttagtcagcgctggggcaggaatcyggcccaggcccttcatggcacctttcttagggtagcgtgccccctctctattccaggtgacctctgttacgcagtccccattgcctgycctggttccctgggctctgacatcaacttagatgtcgtgtttgacttagggcttccagccggatccctctccatacaccgggcttccttccagaccctgcatacctctcagggaaaaccaaaggctgacgtttggcatttccctgcttctatttatttgtatttgtcggccctgtatctttgtccacagctttgtgggtttgttagaataggaagtgaagtacttcctatataagctctggccrtgctgtgtcaaactcacgtgcttccccagccttcagctcggggtaggagtcttcatgcaaatcagattgtttctcttttagtgtaggcaacagcaagttgttgacgacagtggttaycttaggctcttgacattctgctcccaaggtccagtgtgggaaccctgcytccttgctcctcttccttgctgttttttccctttctccttagttaaggagactggtctggatttctgaaggtgactgtgctggatatgtatgagctgaaacactgtctgatactgttgagrgacagtagtgagccaggtgatttcttgaatactctgttagaggacttgcgtgcatgtcgaaagtaggagaatcttttttggatgttcaggttggaaacacttcacattctctttgtctccaacatgttagatttgttgcttgctgtagactcaragaaacatttctctagctagtgaccatgtatcttgttawgtgaatttcacttatgtgtcaccaactgggtttctgtcttttaaggaaaccaaattacagattcacacgtgcctacttttattattactgatyccatcctgcctttatcttgctttattaattgcaggccagtagtaaaatgtttaatagttacatgaccattagcataaccccaagattcacagggactgaggaaactaagatatattttaaaagagtttggatatatggyaataaatgaggaagggacagagtgatacttcatggagatgttttgtgttgaagggaaggaacccagttttctaagatttattttctttaagagattgagcataccatatattttgatcatagaattttacatactttagatgctagctgtttttaaaaggaaagaactccaaattacatcttgcaagctattgtggttttgcaagcattgagtgatggcatatatgaaaactctgagaggtgtcatattaagataycaatgtcagtttaaagatattctatatctgtatccctatgacattgtattttgaattttttatttttcatttttggacagacatttagaactcactcagtggagatggctctgcatctctgttttaagctttttgaactctaggcagctgtgtcggcctggggctacattgacttcttcattgcagcccctcgattggtttcgtctggaccagggtgggtttcgattgcggcccttgctggaacagtagcaggaaagtagaaacaccttcctgtctctgggttaaccagctgacagtctgttacttgtgtgcttccttctaattggtaatctgccaacacctttcaggatattatgaaatttcaagcaaatgaggttaaaatggaacctctgtacttctgaacaggcgtggactgactgcagttctccaggatagtttcagcagaagcagtgagattacagtcaggagcaaaacagtatctgagctttctttatgggaaagattcygactgtgtgcttggtttatatggttaaattaattgcccttgttaaattaaaaaaatagggtatgtttctgccacagactttgctttaaaagcagagatcttctaaagtcatttgccttgtatttgacttctgctgctccccgtttcctgctgggcctgatggtttgattgtagaatgtttctgagttgtgtcactgttggactctgctgagctgagtagtctcattaaaggagagtgtgcatctgagttgaggaagacaatatagatgtggaccttgtttgyagagttcacaagctgcttacatagaaatagcaaggacagtgcagccagtgggaaggagccggctgagggacttgatattatttccatggaaaccagttgggtatgggaagagaggttgtggaaggcaatgctctggtgtttggcaattcacactgtgcagaagagaaagcagaactggactgggagtatagagtagcagaagtttaagcttggggaagaagttgagcaaggaaaagcatatgatctgttgatcagcrtgatgtgatgtggtctgaatcttcagacagttcacagctttttcatagaggctgtcctcagatgggttcaaccattctgagaattctgcctttacgatayaagtagtatccatgacattaaaaacgagaagagaagcgttttggccaatgacggactgcataaactacagtctgcataaatgaccttggtcctagaagattaggatgaagctgaacaattcttatcacctagtgatgctgtagccattgtaatgtcgtagcacaatgcattagtcacatgtttgtggtaatactgctgtaaacgaacccrctgcgctaccagtcttatgaaagcrtccagtcaggtcctaggcctttaggtccactcactcactgactcacccagagccgcttccagtcctgcaggctccattcattataagtgccctaggcaagtgtgccattttaatcctttataccatatctttgctgcaccttttctacgtttagatatgtgtcacatgttacagttgcctggggtattcagtgcagcgtcatgctgtgtgggtttgtagcctgggaacaataggacataccatatagcctaggtttgtagtaggcgacaccatctatgtgtgtgcagatacactcgatgatgtttgagcagtgacagaattgcctcatgacacatttctgatgacgtatcgccattaagtgagtgactataaaccagtccccccatcagcagttacacttcctgaggtttcagttacccatggtcacttgcagtctgaaaatatgaagatattttgagagagagatgccacattcacataccttttattacagttataattgtgctattttattattagttgttaatcttttacaactaatttataaattaaacttaatcatgggtatgtatgtaaaggaaaaaccatatccgaaaccgtattcctggttccaggcctctactgggggtcttgtatctgtgattacaaggtgctgcgaagggataactgtaatttttctatatgactagcattttattgaatcaagttgtgtagatggttggcaatataataggaactcagagatctttatgccatacagagtctgtccttttaatggcatttattgtgacaagatttaaactaaagttttgtggaatgttttgccagtttttgtgttgtaactgaaactaaatgttttctgaaaagttaaaaccatttctttaaatggaaaataaatgaagccgtttacctaattggttaaggactcacccgtgggcctcacaccgcctaggttaattcttcactttataattccgtgatgttgggcaagttcctyattctgagccttgggatatttggcttcaaagctgaggaacttgggagggttggataatggcatcacgttctgtggggagatttggctcacatgttagctgtgtgggtgagagccgtgctgtcatgcgttcttagccactggccagtttccttctcaagccatcagtagagatgctgatcctgcatctgccagtcattgctccaggagggaagacattactgtcccagagtgacggtgtcaytggggataacagacacttcagaaaatgccaccactgagctgtatgaagtgccatggcagctagtgctggagctgtggattcagccggggagcactgtctggaggagctgctgcagcacatgtgtgtctctccagctgtcaggctggcctttggagtgcatttggattttttgagaatgagagagggaccattggctaactgttttacgctctgaaaaatgacatagaatagcaaagattttacttatttttgctgattttctagaacattttctgtcccagagtgatggttttgaagaaccagcgttcttggaaagatggttttgcatccagaagagtgattttaactaaaatcaggctgcctcccttgaggatggtcactgaattttgtacaactgggacaacggacagggatcctgggttgtttccagtggacaagccgcttctgtgggggcctttgcagttctccccgctcctctcctgtgtcccgctggtttccttcagttgagatggaatacagcatagagtcagtgacttttagaagacttgacagagtttcaggaaaatgctcactgggctttcttacctatcctgctgcagaactttttttttttttttttgagatggagtctcactctgtcacccagtctggagtgcagtggtgcgatctcggctcactgcaacctccacctcctggattcaagctattctcgtgcctcagcctcccgagtagttgggactataagcgtgcgcgaccatgcctggctaatttttgtgtgtgtgtgtgtgtgtgtgtgtgtgtktktkkttttttttttaagtagattcagggtttcaccatgttggccaggctggtctcgaactcctgacctcaagtgatcctcccaccttggcctyccaaagtgctgtgattacaggcatgtgccactgcgcrtggcctgaagttctttctttcagaaratgtattcaacacattcttttgtgtgtgtttgagtgaagacggtgtttccacacagcttgcagatactttcttccagaagcttgtttgttgctawcatttaacatcttactgttacagcttagttttctctttgattgaatatattgatctcttttttttttttctgttggcttttttcttaagtctttacttgtgtaagctcagataacttagtctagaatgtaggctttttctgggaatctcagctgaatggtttcatttgcttggctgttaaatgaaccatactgtttggaatagtttcctaattctggctgtacatgttcacttcaggtagagaattttctaacagacaaactttcagacaaaaaatttattattcctcaaagatatcattacattttatttagtctgtaataattttattgcttctgaaaccattttctagttctataatgtgatcatggtgcttttaaactttaatatcaagttaattttaagaatgattttagcttaggccattctaggggcttggcctttaatctgaaaagaaatttagaatcctttagtttcaaacatgtgatttcttaaaacttgttgtcagttatttatacgattttcaagtttattatgaaatagtctttaaaaaatatttactttagtggaaacatatctagtgatagtttaaccagggtgcataccagaktacataatagtttttggaatattcttcataaattttcagagagattatttaaaccacatgactgtttctgagctcctgttgatactaggggctaggcatattcgttttttctttttgagacagagtctcgctgtgttgcccaggctggagtgcagtggcacaatctcagctcactgcaacctctacctcccaggttcaagcgatactcctgcctcagcctccctagtagctgggactataggcgtgcaccaccacgcccggctaatttttgtatttttagtagagacggagtttcaccataytggtcaggctgatcttgatctcctgacctcgtgatctgcatgcctcagcctcccaaagtgctgggattacaggcatgaggcaccacgccctgccattagtttgttttaaaggagacataatgtccgttgaaacatcagaatgttttaagtactgacagcttgcaggtgtctttggagtgaagtttagaaacctgctgtgaccattcttcattttaaagctgtgactaagaactctgagatattggtgccttcgcctcaagtgctgctgatgggtttgaatggcattgaggttgccaggcctggaggagggctgccttgtgctgagtggttaaatcacccccctgaaaaaagtcagtgtttcaagtattttaataggctcctcctttcctactcccataaccacttacatttgataaatcttgacaaaacaagtatgaaatscaagtagagaaaataatataattgaatagagcaacacttttctttctagcaaccctgatttccagattatcaggacaatatccctcattttattcttttttaaatcttgattctgctccccaagcaaacacactctttaccttatttagatatcccctttgcaagaatggtggatttcttttaagaaaagcatagcaggccgggcgcggtggctcacgcctgtaatcccagcactttgggaagctgaggcaggcggatcacgagatcaggagattaagaccatcctggctaacatggtgaaaccctatctctactaaaaatacaaaacattagctgggtgtggtggygggtgcctgtagtgccagctacgggaggctgaggcaggagaatggcgtgaacccgggaggtggagcttgcaatgagcggagattgcgccactgcactccagcctgggcgacagagtgagactccgtctcaaaaaaaaaaaaaaaaaaaaaaaagaaaagcatagcattttaggtacgtgtggatctctttagcgttgattcctaccagttaactcattttaaatgacaccctcatgcaccaatatcatatacttaggattgtgaaatagtttaatgatgccactgccgctacttgaagtttgtctctgttatcctggagaaactagtcatggctcctgaataagagattagcatttttcctgagtagtagccaagtctttgtttacttgtttatcttgtatcctgcaacctggaatatacactccgagagggcaggrcgtctttgttttgttcattgctgtactctcctgtgcctcccgcagtaagtacttaagaaatacttgtgaaacacatgaataaaggttaacgaagggcaaaggaaacaagcctttattgatgatttttctctgtgcccagtaatacttgggttattttctcatgtccttgagtcatcttgactctaggagacacctcttaacatgttcctgctgaaaaagctgagctgaggagtcataccccgagggtatcaccctaagattgggcacctgagtaccccagcctgctcttcaggtctgtagctgcttagtggctatcagaccttccaagtctccatgcttttgaaggcctatgtgtgyggtttggtttcttggcaggggggtttgatgggttcccagacctaggagttcttggcgcctcgtcttccagtgaccccaccagggctgctctttctcctccattgctgaaactagttcagggytggggaggagggcacgtgggggggcctggtggttggttttgtgctgagtcattgccttggtgcactgtggaaggaagctctgggaggtggacggctccttctgtgagggagtgcttctgtcgtcamgggagtactgcatagggtgaataacacagttatgtagatawatatggtggtcttacccccagggcctccacaactcctggatgggcctagcctaagcaattctgatttaacttattgcccctccttttagcaatactgttgagttaaataacagtttttgcattgaaaataaaaaaattttatttttgtagagatgggatcttggtatgttgcccaggctggcctgaaactgctggcttcaagtgatcctctggccttcgcctcccaaagtgctgggatacaggcacgagccactggccaggtctttattttttgcattttgcaaggacattttaagtcactttcttccttttctgtttttactcctgctgaggagatgatccccattttacaaaatggacaaaacattctccccagggaagggaagagtagacatttgagaataattgttttcacagaaccgggaaaccacctattttgtcccaagtatactgattgatgcattagcaataactcactatctgctttgccagaggtttgaacaatgagtgttaatgcttggtgtagtgaattttgtgtgatttcgaatctgatagctgactcattgcacagctctgtcttgcgagttcagatctgaactgtagctctaagaggtaaaagcagaagtggagctgcctttcatgccatagctagttttttaataaaatagagttaaaaaatcctttggcttttcagcattttggtgtgattggaaaggctattactatcttatattcagcatgagtcttgagcaattactgattaatatgrtttggctgtgtctccacccaaatctcagyttgtagttcccataatccccatgtgttgtgggagggacctggtgggaggcaattgaatcatgggggcggttacccttatgctgttctcgtggtcatgagtgagttctcacgagatctgatggttttataaggggctttttccccttttgctccgcacttctccttgctgaaaaagaatgtgtttgcttccccttctgtcacgattgtaagtttcttgaggcctccctagccatgcttaactatgagtcaattaaacctctttcctttataaattacccagtcttgagtatgtctttattagcagtgtgagaacagactaatacactgatctgagttgatattcttaaattaatggtaagatatttcttttttttttttctttggagacagagtctcgcactgttgaccgagctggagtgcagtggcacgatctcggctcactgcaacctcygtctcccaggttgaagcagttctcctgcctcaccctcctaggtagctgtaattataggcgtgtgccaccacgcccagctaatttttgtatttttagtagagatggggtttcattatgttggccaggctggtcttgaacgcctgacctcgtgatccacccacctcggcctcccaaagtgctgggattacagacgtgagccaccatgcccagccagatayttctattttgataatctttgagtcctgaggtagcttcagaatggattgaaccacagacagatggtgttagtagtttctgccctggcttctttgcaacttaacatacttgactttttagtgtttttggctaaggaaagtgtattttctagtttgtggcagttttaagcaaatgtggcttgaataaaactagagagaagtttaatttttgataaatcagtgacaktgacaagttgtttttcttcctttccagttatacatgggaagctgttgataccaaaaataatgtactttataaaatcaacatctgtggaagtgtggatattgtccagtgcgggccatcaagtgctgtttgtatgcacgacttgaagacacrcacttatcattcagtgggtaagtagaaytacctgaaattactggattggcaatatgattccccaattttgcaaaaatgactgtgtatagctatacgtatayagcgatacaaaaattttgaatgtttagaaatcataagtgtttataatacataatacacatttgttagtagttaaaaatgctaacggtttgaatrtctagtatgagctaaaactaggttggttctgtctagtggatactatacagacagctgttatgaagaattatgtagatgtgtatttgatattgaaagctgtctcctagatggctctcccttctcacccacacttttcttaaaccctgtttttacattctcccccagcccacatttccttttagtgctcccccgactcccattcctttgtaccttccagctttggctgtagttcccagacagtgtttctgctgtcaaagatgstcactggagttaggcttacattaaaggttaaataaatagtcctgaggattggcagtctcagagaaagagrtgcagccccttctttcctagggttyrtttcattccccaaatgtatgccttttgggtcaggatcgctatccttctgtgaagaatatgaatccaagtggattaatatatcagcaccaggttacatagagtggagtcagggcagatgcctgaaggaagggaggcagggcagacagaaaagcagaatgcattgcccttggatttggcaacatgratgtccgtggtgacctttcactaaggcagttagaataatgaggtttgaccacaatggatgctcgtgacatagagatggtatatgactagggactgtctgataactagaagaagatgctaggtgggcttttggatttgggagagaagcttactgtggtagctctgtcattttcttttgtgttttaaacattttaatatttttatagatttggcagttcaagtgcagtttgttacatggatatattgcatagttgtaaatctgggtttttaatacccgtcacccgaatagtgtacattatacccagtagataatttctaattcctcaccccccaacctttctgagtctccagtgtctgttattccactgtccgtgtccatgtgtacctattatttagtttctacttataagtgagaacatgtggtatttggtgttctctttctgagttattttacttaggataatgkgctattgttcaattcatgttgctgcaaaacatgtgatttcattcttttttatggccaacatgtggaatttgtccatagaaaagaatgaaatcacacacacacacacacacacacacacacaamamacacaccacattttttgttatccagtcatccattgatggacacttaggtttattccatatctttgcaattatggatagtgctgtgataaacatatgagtgcaggtgtctttctgatgatttttttccttcaagtatatattcagtagtgggattgctggatggaatggtagttctatttttagttccttgatagatctctatactgttttccatagaggacatcctaatttacattcccaccagtgtatgtaagcattcccgtttttctacgttcttgccaacatcttttgctttttgactttttaataattgccattccagtgggtataagatggtgtctcatggttttaatttgcctttctctgatgattagggatgtggaacatttttacatatgcttgttggccatttgtatgtctttagagaaatgtctgttcatgtcctttgccctctttttaaaggggttctttttttctttttgaattgtttgagttccttgtagattctggatgttagtcctttgtcagatgcacagtttgcaaatattttcacccattctgtaggttttctgtttactctgctgtgcagaagctttttagtttaattaaatcttacttggctatttttgttttgttgcatttgcttttgaggttttagttatgaaatctttgtctaggccaatgtccaggagagtgtttcctgggttttgttctagaatattcatagtttcagatcttacatttaagtctccaacttttgtatatggtgagagatagggttctagtttcattcttctgcatgtggctgtccagttttcccagcaccgtttattgaatagggtgtcccttcgccagtgttatgtttttgtcaactttgtcaaagatcagttggttttaagtatgtggccctgactctgggttctctattctgttccattgatctgtgtgcctatttttatatcagtaccatgctgtttgattactatagccttcargtataatttgaagtcaggtaacatgatgcctccagctttgttctttttgtttargattgcttttgctattcargctttggctactcatatggttccatatgaattttargattgtttttctaattctgtgaaaaatgacattggtactttgataagaattgcactgaatctgcagattgctttgggcattatggtcatgttaacaatactaattcttctargccatgatttttgcatctgtgttcattagggatattggcctatagttttccttttttgttgtgtccttgccttgctttggtgttagggtgttactggcttcatagaacaagttagggaggattccctccaacttgatttttttttttttttttttttttttcagggagtagtctcagtgggattggtaccagttctttgtacctttggtaraatttggctctcaatctgtctggtcctgtgctttttcttgggaratttttaaagtactgattcaatctcactcctttttactggtcttttcaggatttctgtttcttccgattcaatcttgggaggttgtatgtttccaggaatgtatccatttcctctaggttttctagtttttgagtgtagagatgtttatagtagcctctgatgatcttttgtctttccatagtatcaatgtctactttttcattyctgattgtgcttatttgaattgtgtctcttctttttttggttaatttgagtagtagtccattgattatgttcatcttttcaaagaaccaactttgttttgttgatcctttgcattttttkgggggggtctcaatttcgtttagttctgctctgatttttgttatttcttctgttaggtttcaatttggtttgttcttttttttttctagtgcyatgagggttacattaggtcattaatttgtgatctttatttttgatgtaggcatttagtgctataaacttccctcttaccgctgctttgctgtatcccagaggttttggtccattgtgtctctatttatattcatttcaaaaaatttttacatttcatcctaactttgtcattgacccaaaggttattcaggagcaggttgtttaatgttcatgtatttgtgtagttttgagagttctcctcttggaattgatttctagttttattccgctgtgatctggaaagatagttgatatgatttcagtttttaaaaatgtactgagactgttctgtggcctaacatatggtctaccctggagactgttccatgtgctaagaggaatgtatgtcctgtggttgttgggtagaatgatctttaaatgtcttttaggtccatttaatcctgagtccaatttaagttcagtgttttattgttgattttctgtgtygatgatctttctagtgcttgtagtgaggtgttgaagtctctcattattattacattgctgtctrtctcctcttaggtctagtggtaatgattttatgaatctgagtgctttggtgtggggtgcatttgtatttaggatggttatatcttgttgaattgatcccgttatcattatttaatggtcttttttttttcttttttaactattattgacttaaaagtctcttttatctaartgttgcttctcccgctcacttttggtttctatttgcatggaatatcttttcctacctatttaccttgagtctttgtttttaccagttaggtkgttttctgtaagcaacatatggttggatcatttttttttttaaatctagttcaccaatctatatcttttatgtaaaggatttaattcatttatgttcagagttaatattgatatgtgaggttttgttcctgtcatagtgttaattgttaactagttgctttttagtgtcaattgtataattattttataagatgtgagttttataccttttgtctgactgggttaattcaaacctgtctttaagctattagattctcttttctgctggtctagtctgctgttcaagctttcaactgtattttgtaattcctacaatgaatttttcatttctggaatttctgtctggttttctaaaaaatagctttctctagtaaaattttaatttagatcctatatttttccgatttctttgtgttggttttttgactttctcttggatcttattgcgcttctttaaaatcaatattttgaattccttagctggtatttcaaggatttcattttctttagggtccactgctggagagttagtgtgagtctttggggatgttgcagcgctcttttttttttttttttttttaatacttctagagttgttactctgtttcattctcatctggataaactatctcttctttatttttgaatttactttggcaggatttttttttttcccttgagaatgtgaatataacgtatgttgtatatagttgtttgacttcagttctgggtactttcagtgacagagactctgagtttcttggttatagttggcctttttgtggtagctttctcaaatgctagtgatagtaatgatgtgcttgggtgtgtgagcagsatcctcaccgtctcccgcggggcctggaaggcagagttctcaggaagttattttgttctcccttgctttgcactttggcagcaraatttatattgggttgtgcaggccagcaggtggtatttatgggtaaaaaccagctgcagtggaatccgatgggtgggtctatgagtctctgtgcttgacctttgtttaatgggggaagctctgttgcttcaggcagtggagtggtctgtggaatgcacagtggcctgagctacctgctcagcccctgagtgggggacaaagctggacagaactgaactgccagttcttctcttggatactccagtggctcaagcaccagccctaacaggggtagcaggggtagctgtgtagaaggtgccaaggtgtctgcggggaggtgtgggggttgctccagctccatggcctgggcaggtgggagcacaatctgcctccctgtcacaccccgtcctggcgctgggaatattcagaacatgagaatatcgctgtctgtctcaggctgcagtgtagtgagtgctacgagagacacctgtccatggcttaccaccaatgtgtcttctgtagtgagcctcctccctcaacccaaagcacacacatttgtagctctcctgctctttgccgcaggaatgctgtgggtccgtgtagagagggtgaggccccacctttcgtgcaagtcctggctcagtggaagtcgtgcaagtccactgccagtggaaatgcagcttcccctaacagccacagaatggccactgtcctgtgtgcctgtgccaacctgtgggagcagccatgactgtgcccacagcagtgggtagagggtgggggaggagaagtcctactacccacatccgtgcccaagcactgagaccacctggctcctgggctggaagcatactcctcccttgcagggctgagtacagcacccctgtctccactgcatgtggcacaggccacaagccatgctcctgggcacaggaaagtgcatgctcctttgtcccaaggagtgcccccttggcatgctgtactctttcttcccttaggagcagcactccctgagggtagatctctgggaaccctgcagctcccctgggtccagccagccctgtgtggctgctgcagtctcagcaggtgccaagaaaggtctgcagggcctctggtgatacggagacatcagtgctgagcttccccaggcagtcctcccactgctgccgccactgccacccaggtccagtggagggtgagcaacctggcataagtggtagtctgatgtaatgccctcaggaagtccccaaattgctgcccgcaccagtgtttgggtttgtgagggcagaaaagctctcccacagttcgggtaccagcagtcgrccacagaggtgaggggcagcaacagcattcccgccacccctttcaaaggaataccaagtccctcagggctcctagccgctctctgcccctctcgtttcctgctttttattttttgccctcgtttcatcccaggggttctccaccaggctccagtgctctccacttgatactccattctggcgacggttgctcacctgtaacttgggttcttctgagaaccggcctctggcaactctgttcagctgtcttgaaacaaaagaaacccccacttgtcattttgcatggaaattgctaaacacagttaaaagagctttgtagaaagcagtgtttagagtacgaagataagggagtgcgaggtctgctgattgaggcccagctcctgtttgatttccctctctctctacaaagagaccatccagactgaaaaacctggtgagagggatttgaggcctgggattgagatctgagaaagcrctagattgttgtgaattcttgggtctgacattatccttggtgatatacttaggaaacttacaggtgagatggccagtttactcattgtgctcttttgagaactcacagagaaaggccacaagtaattctgttggccagtgttatgtaggtgttcagaaagaaggaaaagtagctttcttcttgattttattataatacttcaatatttttggctaatgaaagtatgtcttgagtttatggtagtatagtatggtatggtatagtgtaataccacatagactgatgccagatggaggcaacttacttgaaggataatttgtgagcttggcctcactggacaaagtttgagtttgaccaagttctgtggaccttgaaagccagggaggagaagagttgttatttttttgtagggagtggatccattacagatcttttgtgatggtaacggggaggtgatgtgatggaaggtgtttttaggaagctggccccgtggaataggaaacgatgcctacaggggagataccaaagataactagatgactaaaaagtaacttacaggttaagatgatgatgatactattataaaccagcagtttccaatctcattttttcccccagatatgtgtgacagatccctttcccagagcttgaaacttccagagggagtcatcatatatactttcaggactctcagtaacggctccctttcttcaactggagagagcagtttgtatgagtcaatgagagtgacattcacagtagcatagggataatccsgaatcaaatctaatttgcatatacaataaaaatacctaaattttgttgcacattcatgtgctaggcctaatgtttaaaagtaaaatatctcatttaattcattcaacaaccctttaaagtaggtgatttcatttccctcatgttataaatgaagaaatggaagcgcaaaatggatctgtgttctacagtgggcaggtctgtgcaaatctgcccccgaagtccaaggaagttgagaggctgaagaaggaggctgacacccagtttctcagaaagaaacatttaatacggacttatgaatagaagccacatctcaagaagtcacgagatgggatggatccctctgccatcacccactccagacccagggatcatacaccatagggaaggggtggttcagaaggaatgtgtaggacaattgaagtaggttttttgacctaaggggaggattcgtgataattacctgctcttacacaaggaacagtagakaaactggaaatcttggaggccttcctggaactggggttaatcggaagtcagcagggctgtttggcctccagaatggcgttactttagcctccacaatgagcaccttgctggaggtggtgtggttatggatttgaatgtggacagccggctccagagcctgtgtactcactcagggctgtgyttttgtgtgagtcatggggtcacatcagacagattggagctgaaatggagaccaggatgggagatctgaatgtgtggctctgagaggacatctgagaacgaacttcttttgatcttgttagaaaggaaaaaatgtgaaccttcaaaacaaccacaagaactggagctccccgcagatcagaggaacagaagagctagcrtagaaatagatccaaatatgtatgggaacttaagataacttacaaccaaaaaattgggtgtaagtagctattgtctcttacgaaacaaagttcaatccctcctttagatcacatactgaaattacagctcagttaagatttgaaagtaaaaagacaatwgaacattggaaaaaaaattagtaacatatagatataatctagaagagccttccttaaggaatcctggaagccatacaggagaagaggaacatttcttattacataccttttaatgactaaaaggtgttctaaagacaaaagacatacrctagactgggaaaaacatttccagcatgtttgccaatgtactattaggatgagagcttttcttaaaaattggtaagaaagacagacacccaggagaaaaatggcaaagtcaaagaacaggtaattcacaaaagaagaaatccagatgctcaatacaacttcactaataagccaggtggattagtcctttctcacattgctgtaaagaactacctgatacttggtaatttatgaaggagagaggttggattmacagttctgaaggctgtgtaggaagcatggctggggaggcctcaggaaacttaaaatcatggcagcaggtgaaggggaagcaggcagcttcttcacatggtgacaggagaggagtggggcggtgctacacactttcaaacaagcacatctagtgagaactcttatcacgagacagcacttggggatggtgctacaccattggaaaccagccccgtgatccagttacctcccaccaggccccacctccaacactcgggatcacaattcatcatgagatttgggtggcgagacagagctaagccgcatcaccaggtataaatgcaaatcagagcaattatgagatytcatttttctttgagaagttggcagaaatttaaatggttgaatcatagagtgctggcaaggagcctggaaatgggcacatttatttataygttgctgtaggaagacggttgtctytaaatccttttgggaagataatagttggtgtgaggttgtttttttttttttttttttttttttgagacagaatcttgctctgttgcccaggccggartgcagtggcgccatcttggctcactgcatcctccgccccctgggtttaagcgattctcctgcttcagcctcctgagtagcttggattacgggcaccaccatgtccggctaattttttttttgtatttttagtagagatggggtttcaccatgttggccaggctggtcttgaactcctgacctcaagtgatccacccgccttggccccccaaagtgctgggattacaggtgtgagccaccacgcctggcctggtatgagttttaaagtgccctgaagcaggggtcctcaacccccgggccacagactggtagcggtttgtagcctgttaggagctgggctgcacagcaggaggtgagtggtgggtgacagagtgaagcttcgtctgtatttacagcygctccccattgcttgcactactgcctgagctctgcatcctgttagataagtggcagcagtagatgcttataggagcgcgaaccctattgtgaactgcacatgcaagggatctaggttgtgaccccttatgagaatctagtgcctgatgatttgtcagtgtctcccatcacccccagatgggaccatctagttgcatgaaaacaagctcggggcttccactgattctgcactgtggtgtgttgtataattatttcaattacatattacaatgtaataataatagaaataaagggtacaataaatgtaatatgcttgaatcatcccgaaaccatcccacccccagtccaagtccatggaaaaactgtctttcatgaaaccagtctctggtgccaacaaggttgggggctgctgccctaaaattttttatagtgagaaacaaatattaagacctcaatgctggtttaaacaatattacattattttaaattgaggaatcatacattatccacacatccaaggagctcagaagaaattaaaaaaatcatacattagtttttccttaggcaaacratattacatatgtgaatcttagcaaatgttagccatcattttcatagggcctgtgaacaatatttggtcccatttgcaacctaattattttcacattttaaagtggtttatacattttatatgcatttgacccttgaacaacgctagagttaggggcaccaaccccctgcacagttgaaaatccacatttaacatttcactccctctaaccttagctgctaatagcctgctgttgatgggaagctttaccagaaacataaatagtcgatcaacacatattttgcatgttatatgtattaagtactatattcttacaataaagtaagctaaaggaaagaaaatattaagaaaatcaggccgggtgtggtggctcacacctgtaatcacagcactttgggaggctgaggtgggaggatcacttgagcccagaagtttgagaccagcttggacaacatagtggaaccccatctctgcaaaaaataaaaaaattagccaggcatggtggtgcatgcctgtagtcccaactacttgggaggctgaggcaggaggattgcttgagcccargaggtggaggcctcaatgagctgtaatcaggccactgtactcctgcctaggtaagagagtagtgagagcttgtctcaggaaaaaacaaatsataaggaagagaaaattatgtttattattcattgagcggcagtggatcatcatataaagatcttcgtccttattgtcttcatgttgygtaggctgagtaggaggaggaagaggagggactggtcttgttgttctggggttaccgaggtgaaagaaaatctgtgtataagtggacctgggaagttcagacctttgcagttcaactgcatttgatttccttttcaagtacctcagatgtctggcttaacagttaaaatttcagtgtaacaataattataaatttatgagtattattatttaataattcttatatatttactagttatgctaaaattctaaaatttctaattctaaaattctcttaaatgttctaatactgtgtcgtaagtctgaattaattgctgagttataaactttggattggagttatattaaacattgcagtaaaaataccaaatacattcacatttttttctaacacatcaaatattaatattatgattttaattaatcttctgaggattacagctctatatccatttcaggaagcctgttaccagcccatttaacttgaggtaatgtactcactaaggaacagtgttaattgaggttacctctggagcctggaattctgtttggcttcttgttggtgacctggtaggacacagtgagtcygactgtagttgccgtcccaggtgattcatttactttaaagagcctggcccctgacttccagtgatttgatagtgtctgattcttgtatgcactcacagaaatctacagcaggcactggattgatcattggattgtatctttcatctctttgactcataagatgtgaaaatgccttttcctcttaagtcttttattttcttaaaacctagaattctgttggatatttaagatgatacctggttgagttttggatacaactcatgtttttatctgatttatggtctctcctgatagtctggcaatacctgttaacattttaaaacgtatattcacataatcttttgtgactcaaacggatagaagaagtagtactatatgtagatatttgtacaaaaggtttttggtagcattgtttattgtggcaaatatgctggaacaatctactgtgtgggtatggttcaataatttatagtgtattttcttcttatttacttggttaaatcatctaaaattatatgtgtacattatattaaaacatagccaacagttaatgtttatttataataactatttgactatcagtcatatgtaggcaccggtttaggtactggaattgaatcagtcactacaacaggcaagaatctctttttttcatggagcttacattttagtagggtgggagacagatgaaaaaagcwatggctaagtagtatgttaaactgtgatgactgctacagaaaaggaaaggaagggtaatcaggagtactgggggctcgggtgtgtgtgygaggatattaaatagggtaagtgtcactgagaatgtgacacgtaagtaaagaccttgagttgagggagtgagctgtgtgtctctctgggggaacagccagttcaggggacaagaagggtagccaaggagtgtgttggtggtagcaagaaaataaaaatcttttaaaaagagtatccatataaatagagaagctggaggttaaaaaattggatgagtatttttttttttaatttggcaaaatagcgtgaatagtatatgttgaaggaaacgctaagtgggtggtgcaggggagagaggaagacttgcttgagcacatcgggaagtaggacaggaagggttctctgtytgccttgtaggttctaattgccatggcaataatataattgctgtggccgctgcggtaggcaggagggctgcctgtgaagtcaggatcaccaggctttgtggcttcaaggaggccaaatcaccatgggcttgcttgggcttggaggtgcgacctggtgggcctgcagaatgcgacttggtggcctgactgagcagcacgtgagggcctggtgcagcctggcatggtggtacccttgagagcgtggcctagagggctccgaggtgcagcctggccagtgtggtctggaggggtctggcaagcgctatctggagcactcagaggtgtggcctgtttttccgggtgggtctagtgagtgtrgcttggagtgctgggtggtgtggcctggctggcaccgaggtccctgcggattctggagaacctcaaggtgcggccccgggggtgtggccaagtrtggtgtgtggagggcccttgtgtgcagcctggtggttcctgtgagcatggtttggagggcctggtgaatgtgtcctggtaggcctggtgagtgtgtgagcatggcctagagtgtcaccaaaccaaagtggacccrcctgcctgtgcaccagggaaagccaaacaccaaagcgcagggtttttgctggagagagtggactgcactgcgacgagacaggaggaaaggtcaaacctgtctccccaagctggcggctgggtcgggttttataagyataagcttattaccataaggtaatgaggtgtgttctgwttggatcttgcaattagatgacaccagggctctatctgattggatcctggatcttgccatgtggtgtgcgcttcttatttcagtcccgctcctcagtccagcgcttaggttcctcccgtgttgcaagcttggttcatctgtgcaggctccggtgacatgatgtcgaactgggagccatggcrgctgaaaaacaacsaacarctttgtacataaaagatgatacagcttggtctaatgtggttctaaggaggctctgccggcgagtcttaggggttcyggcgggcagccgcgtgaacctggagcttggggtctgcagtgctgggaggccgaggcctggcatgttggggacaggtcttgggagctgactgggggcctggcgtggtggcggcagcccgcagtccctgcctggcccttgtctgggaggcygcrgttctctgcggcctctcgcyggkgtcgcccttggccactgggctgcgaggaagccggcgaggagtgggtgtgcgccccgcccggctctaccggcgagggatgcagtggccgccagcgtggccgtgcggctgggtcactcccttcccgcttccagggcctttttctgcctccttttcaggacgtgacccgcacattatgagggacccgtaggggctcttgacacagaggggtcaccctatgtgtgaacaggttacgaggttgggggcttggcttctgaacttgccaggaaacaccgcatcccttttcctgcagcggccgccccccatcccccacccgccccattctctcccctccccaactgcagccttccgcgcctccttggcccctcgagcctccctgggtcccctgcacctccccatgtcccccacgactcctaggcctctcgcgcttccccaggaccccgcgcatcctgggcctcttgcgcctccccggtcctcagcgcctcctcggccgccgtgcctccccgcaccttttgcgcctcatggggctcccggtgccttctgcccgccgcctcgccgcgcccctcgcctcctcatgcccctccgcgccccatacctccccacccctgtgcctctctgcctatcccctgtaccacccggcatcctccgtgccccatgcgcctcacccctcacgcctccctgtaccctgcatgccccgtgtgcctgctgtgccccacgcgcctcccccctcgcgcctccctgtaccctgcatgccctgtgcgcctgctgcgccccacgcgcctcccccctcgcgcctccccccttcgcgcctccctgtaccctgcataccccgtgagcctgctgcgccccatgcgccttccgcgtctccagccctcatgcgcctccagctgcgcatctccctaggcgggtacctcagcaccgctgagcccacccccgcccctgctcagtgcctcccagacacgcccactgcgggcgggacagtgggagctgtccaggcgcggagctgtccaggcgcgggagctgtccaggcgcgggagctgtccacgaggcactgwccttggtttcagagcctctgcagggcttctgtgtccttttggctgagccgactgggcaaaagttttagaaaagaccctgggtgttgcagatggagaaggatgatcgtggctgacttttgcttgcaggcagaasaaccacggggccatcagcctggtgctgtgggggcgcgctgactcgtggtccgcccctgccccaagacttcaggtgtatatgggattggatcagctatcatcccgagctcatggcacgtacagtgagccatgtgttaatccatagactaacctttttccttttaaaaaattagttgttttgtataatgtagcgagcactgtttccaacaaaaatctaggatcttggcagtaaccactayctgttttactctttcctctttcacttttcgctaggagtaatcattagctcccatcttgtattaatttttttttttttttactgtatctaatttccaaaaaaaaaaaatctgtgtgtttgcaactaagttatcttcctatgtgtaactttttgggacttaagtgataacagtaatattactaaaaatcaaccrtattgttgtttttcactgtggtttattccttctgactgctgtgatattttgtgtggatctgcygaagttaatttatccactcttctgttgatgggcctttggtcatttccaggtttttgctcttctgaagagcatgagatattctttcacattttctgctgtgcatgttccatatgtgcatggttttctcttttatatagacctgagtggagtaactaggtcatagggcacacgaatgttcaattttaggacataatgtcctgctgacttacatagttgttgaaccagttaacatttcactagcaatacaggagagctctgagccacctcatgkctgacacttggtatttaatttttgccagagggatggttgtaaatggtataccattttggtcttgatttgaaattccttgatcaccagtaacattgaacatgtcttaacatatttattgatgtacatttttctttgatttgcttgatcatgtcwtgttcattttatattgggttattgtgtgtgacctagattagaattttttcttttcattggatattaagatccaccattgtgtggctaggagtgggtttttccttctctctcctttccagcatggtgtgtgctttctcagtcagaggtaattcatcgtcctttatttcctggaattatacagacattcttttcttgtttgtttgcatgtgaatgtgtatgtagagattcttgatgctggttctttgccagttctgtgtttttcctagtttataacttacttcygttttctttaagctrttttttgatgagtataaactcttaaattgaataggtcaacctcattaatctttttgagtcttaagaaatctttctctatcttaagatttctgccaagttttgaagtttggattttgatgtttacatctttaatccatttagacaggggtgtccaatcttttggcttccctaggccacattggaagaataattatctttggccacctaaaatacactaatactcatgatacttaatgatctaaaaaaaatcacaaaaaagatctcataatgttttaagaaagtttacaagtttgtgttgggctgcattcaaagccattctgggctgtatgtggcccatgggccacgggttggacaagcttgtgtttagagttgatttttgtacccagtactgggtagggatccaattttgtctttttccatatggaaaactattttgtttccrgttccgtttttatttccagttctgtttattgaacagcctcctcttttccctgacctrttacttctgtcataatcaaagtttaattcacatttgtgtctctgtgctctctcttctagtcgattggtctctattctagtcttttgatcagtttattcctatgccaacycccatcatgttgatttttacatagactttttattctggactgttacagtaatgtcctggacaagcagagatgtggtcattctacttgtgggcctttctagagaatgttgattttgtagcatatgtgatgggaagtattgaaacatttcagtggctgagttatatatcctgatttgtatttttgaagatcacactggtgcaagatggatgaggaagtggggctggygagggatgagactagtgtggaggcagggggagcagttaggtggccrttgctggagcgcaggtagtggttttagcgggagtagaggtggagaaatgtggacagatttgagatgggcgtatagctgtggacctttctgatgtatagaatgcagcagacaaggtaaagatggcacttaatgtaatgtaatggggrtgccactctgagatggaaaattctgggaaaggacagttttataaatttataagctatcagatacattataatgctacttttaatttgcttttccttggaaatagctgtttggttatgtatgttttatagcctgttcactctcttttctctccaaataggtgactctgttttgagaagtgcaaccagatctctcctggaattcaacacaacagtgagctgtgaccagcaaggcacaaatcacagagtccagagcagcattgccttcctgtgtgggaaaaccctggtgagtccacacaggcacttgatgtatttctttaaaaaaaaaaaggtctgccccttggtgttctggctgtagaggtattccaggaagaatcagtgagcaaacttagaaacacaaataagaaaaaccctaccaaatgaccatcatcatcaagaaccaataagtaaacaaattctaaacttgttacaacttttaagtaaaacatagaccatgtcttttgtaaaactacaattcaaagtgattactgtgttaaaaatcagtgcactgtttaatgtttaagttataggcatactttttttttctctaaaacctcttcttctagcatttcattttgataggttttagggcagcatatttagttttytaaaaaatatttttctttcctcatttatattaaattagagatacccacatctatttaggagaarccttggccyrtgggtatggggttctcaagttttttggatrttacctggtgtttaaaggggacatmattrtgtaaattattatgattgttcttattatgggcatattgtatgtaatttgttgattttaatctttagtttttggaaaggaacttgcagtaaataattgttttagctcttgggagaaggaattggtatacaaattctatgaatgttcttgaatcccagtaagaacccaatctttaggaaagtcaggttgagtgaaactctgtggctactaaattgctttaaaatatcattttagaatttgggactgtgactattgcatcttcaggtccacagtgtcttatctgaagaactttgaaaataaaactaatattgttaattttggatccgcatataaattgcatcrttgtgcatattgagaccyaaaaaagaatctgttcgcagcagcattaaatgagatttatattacagaataaaatatatagctcctgttttaacttcagctaatttcctttatgaattctgtgttcaccataccagaaatagaactgtgaaggataactccctagacttgcacgtgggagtgaagaggccagttcctgctgtgcttgtgtcatcctgcgatgctggggttgacctgtttgtagtccactctggttgcggttaacaggaggggctgccttggagggttggcgtctggtgggtgtactaacttggtcagatgcagatgggctcctcatgggagccttttcaygggaagcatgaggtcacgttttcyggctttcrtttgctggcatttgcttaagagaacatttggagtttragaggagaatgactgaggwtttcttcccatgaactcactcaatgtacttgcacagctggggcggtagaattcctttggattagttacacaaaatcccaacatgattttatgaagctttggtctcagaatttgcagatttgggaacctcttgatgaccccgtttaactaaagcggttgcatcccctgcccttcttgctgctgctttctttattttagtagcctttactgcattctcattttaaagaagaatctttacaatgtgtggtatggtaacattataattactatttttttttaatagggaactcctgaatttgtaactgcaacagaatgtgtgcactactttgagtggaggaccactgcagcctgcaagaaagacatatttaaagcaaataaggaggtaacatgggaacttcaaattacatgcttatgaagtatactctggggaactttatctttcaaatactgattctaacctttccggrtraaaatcttttttagcttccaaattgcatttgagcagagataccatgtgatttaatttttaaaacttttctgagtggttcttatttttaggacagggcatttaaaatatcacaggatgtgatttttggtccagattggaaatagaatggctcatccatatagggcaagttagttcttggtttctggtgctgtgcaactcagtaaactaagtgacgtgtttgggcttgggcttagagtattcactctacctgcaggagccatctgtttctgacgctgcctgcttcatcttcctttgcacctggctttccacctgtgttgtaccccgcttttgataagtctcctttacctgtttgcattgttaaatctctcygtccctctcctcagccttgggatgacttctggctgcaatgtgagtccaggtcaggtawcccttaaattcttttccagctcacctcagagactagattactaggttactgttactattacgtccaccccttattatttgaacccagcattccttggtcaagacattcttcttgggtgcatgtatgtatatatatctatatacatacacactgacctatatgtattatgtgcaacatgatattttgaaatatgtatacattgaggaatggctacattgagctaattacatatgtgttacctcacatatttcgtttttttttttttttttgtgaggactcttaaaatctactctcttagtgatacgcaagaataaattacattgttattaactgtggttgtggtggtgtttaatggatctcttgggcaggtcattcttgttgactaatggaatgtccccttccccagcctggawtccctcatgttgcactgctacttgattctccctggtcctggggaagagcagactgtgttccttctgccgcttctccatgcccaccaccccagatcctaaagggartttcctgttctcaccttgataacaatcttaattaattgattatctcacttttctctcctactttctgtttttaagaactttcaaaggttgtaaggattcaggaactaatgaatggtcataatcagtaatttttactagtggcctaataccatgcagtttaataagacaaaaagaaatgtttatttaaaaacattaattcagattaaattatgaacaataaatcactgatattttcagatatggtcatctatgaagggaaagacagtgtcatatggaagtggaagtggtaaaatactgcccaggaaagccataaggagcattcaatgaaaaaaaaaaagtttaaagtggaaagaattaaggctgatatttaggagacagtgtcaaatgtaagcttcatttaaaaacttaggtgaagctgttagatgacatactgttagcggtgggaaaagcatctcaaagcagacatctgtttggggtttgggggtgagggtgggagcacagtgtgttcattctcgcagtgctataaagaaacacctgagactgggtaatttataaagaaaagaggtataattagctcacagttcygcaggttgtaaaggaagaatggcagcatctgcatctggagaagcctcaggaaacttacagtcatggcagaaggcaacagagtatcgagcacctcacgtggccagagcctgaggaagagagtgggagggggaggtgccgcccactttgaaatgaccagatctcacaagaactcactcactatcatgataatagcaagaagggggtgatggaatctgccctcatgatccagtcacctccccaggccccgcctccaatgttgaggattacaatttgacacaagatttgagtggggacacacagtcatcctgggattacaggcatgagccaccatgcccggctaatttatatatatatatatatatattttttttgtttgtttgtttgtttgtttgtttatttgtttgttttgtagagacrgggtttctctatgttggccaggctggccttgaactcctgacctcaggtgatccgcctgcctcggcctcccaaagtgctgggattacaggagtgagcccctgcgcctggccccacacacagtcatcctcaagtgtccagttggccrgatctgagttgcttcctgtgggaggtggaggctgcggtgacagtggtgccctctgctctcctgttagaccccagacctytcagtcccacagatactctcctgggctctgattttccaacctgatcatgataccctttttgttttgttttgtttttgttttatctgagtgtacctcttatgtcacgttgctgaattgacagttgtgtcttctaccacctaggaaaaaattgctttccaaaataaaatgaatagcaacttgttttcaatgggtcagaaatcaccaactacagcccatggttcaaagcctgccctggcctgtttttgtacaaccccaggactaagaatggttttcacatttttacaggattgttacaaaacaaagaggaatatgccacagagacctatgtgacctgcaaaacccaaaatgtagataccacatggttctttgtaaaaaaaaaaaaaaaaaaaaaaaggtgctgatctgtgttctaaatagtttttggggtgggaatggggaggtatagtctgtgtttttctcaaaacaatgacatttaatttctcttagaagcagattgaagatgcatgagaaacatttgtactttgtactctcttacctcttcaggtgtaattggcagctggggctttattcattgagttttcatttattgagagcctattgtgagctaagcagtaggaattttgttaaattttggaatgctttcagggagcctatagactaatggtgtgaaggacatatccatattcattaactcatttttttttgtcttatggatagattaaatggaaagaactgaaaagcataatgactgctaaaaatgtagtgctgtcactgttagcaaatcttaataaagcgtatgcccttttttctgctttcagtttgatttgattacaccttacaggcttggtatgataagtttaaaacatattgaaggtttatgtacttataaaaacctcatcattccctaaagaaaaaaaatctcaatttggtttagtgtcattgtagtcttgctttstacatsttactaatgtctcatttatttattcattttgctctgtcacatttagaatgattttgatgggcaaaaatcatggtagttacaaacagccctttaaaactattgttatactttgttcagtggattctggtagaggctttaaggtaattatttctttaaagcattgtgtaaatatacctcctactgtagtgcccttgggaacaggcaaaattcagaactggcctgctagcagtcttaccagggttataaaagtaagattattatatataaaacagcattaactcaatgcgtggtgtgttgcagctggcaaacaacctcgctccccaggctgctaaattcgtggtcttatgaatgtctccattgctgtgtttgctgtagcaggaagtgggagggtgttccccagtagccttgactgtttaccaatgcacactccagttctgtggagtgctgtgtgaggcatgtcttctcttccctcctggagtagggagacagccagtagttgctacctgccccgagcagggtgcttgcagrtcttgcckatgtggaatcctctaagtgtcttggtgaaatgcagctgttttcagaatgaagagttctttcattttcccttcttgccatatgccatcttgctcccttttccatcataggcttttattttgctggttagagaattgcatcttgtcttgcatcctacccagtccactgactcactcccctcttgggttaatgttttcatatgatcttgctgtgggatgacaagctttagatttgcaggataatgggcacttgtggctttttactgtaacccaattatagtctgtggcaataattttcttttagttgcctttctgcatgaatctggtggtaggcttaagctccatgtgctggtaccctctgarcactagaggttctaacttcctccattattagtagaaacacttaggtgtctgagaagtattttaggcgacaggcaactttgctttgaggatatggtcaaaatgagttcaagtgcctttgaggctgtgagtaggtgtaggtcgtttgattcactctattagctctccatgaatctctgacagcaggactggggaaaaaggttagtgggttagagcattcctgcagatttgatagcctatttctaagagaaatttgaaagctaaatattaagcagtyaacttttgtaaatagacctgtctgtgaattgcttcagtctaaaagataaaattttgggaaacttatccacagaaaataataaaactatctactttgaaatgatttcagagaacatgaagttttagaatattctttggaagaggtaattaaaatgatgccagtgtattattttggaaataaaacttacaggaatgtttcacatagtcatggttcacttggtgaccagggccttttttactctgggggggattcctttctgggcttgagttcttgctgtgatgcggaagttgggtgcccctacttcatgaaactgtaccgcaaagatgtgggtgcccctacttcatgaaactgtaccgcaaagatgtgggtgctcctacttcatgaaactgtaccgcaaagatgcgggtgcccctacttcatgaaactgtactgcaaagatgtggcctcagagccatggtttctgtcctgggcagggagtcttgcagcctggggcagtttcaccatctgagcacagaccctgatatagtttggattttgtccctccccaaatctcacattgaatttgaatccctaatgctggaggtggggcctggtggaaggtgattaaatcatgggggtccctcatgaatggtctagcaccatccccttggtgctgtcctcatgacagtgagtgaattctcatgagatctggttgtttcaaagtttctggttgtttcactctcaccgtcttgctcctgcttttgctgtgmgatatgcttgctcccacttcaccttctgccgtgagtgaaagctttttgaggcctccccagaagccgagctatgcttcctgtacaacctgcagaactgtgagccagttaaacttcttttctttataaattacccagtctcaggtatttatagcagtgcaaaaacaacctaatacagactgcttgggactgggctggcttttttggcctgctgccagcgatgggccacaggtgggagactcactgagttaagggcattagaacttggtgggtcctgctattgcctgctatgctgtggagctcaggctgcacctctttttaccatgtgggctctttgatgtggtagaggcgcctctgtccctccccagaatgttgccctggaggcccgctgatcaccrttggggccagtgcttgtctcagctgttggagagcctgaatatgtgcttgcctgacccagctccacccagctttccttcctcaatctgccttgctggcagaacacaagacagtgatgcttaggtgtcccatggccccacccattgtctgggacatgggagtagcctcctcgttaacaaaagccaagcataaatcctgttgccaccactgcagctgcctctttcctgcaagtaccacttcctggccaggagatgaacttgcgtagcccatctgctgagacaagtgcacaattgcacagtgctacggcaggagacaagctttccatgacctcagttaccatcatccctcaccacaccctggctactcagaaggccctgagcctgctcaccagcctggtatattactactacaactgatgtttgagaaagtcaccacacaaagcctatctataaccaaggaattcatacagtctttgacgctgaaagcgtccagaagcaaagccaaataaaactatgcaacatacattatagtcacattctcagggcggggggaaccctctagtcaaagcaaaagtaaattcaaaccaaaaagtgacagtttctctagatgagaaggaagcagggtaacaattctggaaatatgaaaaagcagggtgttatagcaccctgaaggatcatattaatcttccagaaacagatcctaaccaaagtgaaatgcttgaaatactagttaaagaattcaaaatattaattttaaagaagcttaatgagatacatgagaaagttgaaaaccaatacaaagagatcagaatatcaatccaggatataaatgagaaatttaccaaagagatgttttaaaaaaatcaagtagaatttctagaaatgaaaaatttattataggaattataaaattgagttgaaagtttcaaccatagactagacgaagcagaaggaagaatctcagaacttgaagacaggtcttttggattaatccaatcaggcaaaaacaaagattcaaaggaaatgaacgaagtgtttgagaaacgtgggactacatgaaacatccaaacctataaagcatagatattactaagggagaagaacaaacaaaatctggaaaatgtatttgaggacataattgatgtaaacttcttyagtttagcaggagatctagacctccaaatataggaagctcaaaaaattctaaggaaatatgttgcaaggaggacttcaccacaacatatagccatgagactgtatgaggtcaacatgaaggaaaaaatcctatccacgagaaaagtatctaatcacctataaagaaaatcccatcaaactaataggggacttctcaggagaaacttaagagccagagagattgggtttctsttttcaaggtgcttaaggaaaaaaaatctgtcaaccctgaattttgtatcctgccagaataagtttcatgtatgaaggaaaaataaagtctttctcagacatgcaaatgctgagggaatttgtcagtactagatggaccatacaattaatgcccaaaggaggtctatacagggaaacaaaagtttgatacttgctatcataaaaacacacaaaagtataaacactcttataaaacaattattcaaacaagaccacaaagcaactaggaaacagttagcattatgacaggaataaaacctcacatattaatattaactttgaatgtgcatggattaaatgctccacataaaagatacagattgggagaatggatttaaaaaataaaagacagaatccacccatatgctgcttacaagaaagccagaactaattggtaaagacatacactgaagctaaagggatggaaaaagatattccaggcaaatggaaatcaaaagcaagcaggaagacccacctatacttagataaaactgactttaaatcaacaacagtaaaaaaaaaggaaaaagatggtcattatatgataaaaagattattcaacaagatgtaacaatcttaaatatgtatgcatgcaactctagagcacaagattcataaaacaactgctggtagacttcagaaaagaaatggacagcaatgcaataatagaattcaatcactgagaaagaaaatcaacaaacacggcacataaattggattcaggaccacgtagacctaacagatatttatagaacattctccccacagccgcagaacatatattcttctcatcagtgcatggaacgtttttcgagatggactatatgtcataccaaaaaacaagtctcaataaattgaaaaaaaccaaaatgataccaagtatcttctcagaccacagtggaatgaaactagaaatcaattcacagagaaactctcataactatacaaataattggaaattaaatagcctgcttctgaatgaattttgagtcaacaatgtagttaagatgraaattaaaaaaaaattgaaacaaatgaaagtggatacacagcataaaacctgcgggatacagcaaaagcagggctaagtgggaagtttatagtgttaaatgcctacatcaaaaatagagatcacaaattaacaacctaatatcacacttcaaggaactagaaaaaaaagaaaaaaccaaattgaaacctagcagaacagaagtaacaaataccagagcagaactaaatgaaatggagaccaaaaaatgcagtacaaaggataaaaaaaatgagaagttggttctttggaaagataatattcatagactgttggtcagattaaccagaagagagaggattcaatcagaaatargaaagtagacattacagctgataccacaaaaaagatcatmagagacttctgtgaacatctgtgtactcacaactgagaaaatttagaggaaatgtgtacatttctggaaacattcaagttcctgagattcaaccaggaagaaatagaaattccaaaaagaccaataacaagtattgggattgaatcagtaatttaagaaaaacaaaacaaacaaaacaaaacaaaacaaaaacctcccaacaaaaaaagctcaggaccagacagattgacagctgaattctcccagaggcacagggaagaactagcacaaatcctactgaaactgttaccaaaaatcagaggagggaatcctccctaactcattatttgaagccaatattatcctgataaccaaagccaaacaagcacacaacaaagaaagaaaactagaggccaatatctatgataaacagattcaaaaatctcaacaaaatactagcaaactgaatgtaacagcacttcagaaaaataatacatcacgatcaagtgggttttaytccagggttgcaaggatggttcagtgtatgcaaatcaataaatgtgattcaccatttaaacaattwaaaaaaaagtctgaccatctcaggagatacagaaaaagcatttgatgaaattcaacatcccttaatgaaaagacaacactcaaaaaatattagaagggacatacctcagaataataaaaggcatatacgacagaaccacagccagcatygtactgaacagggaaaagttgaaagcatttcccctaagaagtggaacaagacaatgatgcccactttttcatctctcctattcaacatagtactggaagtcctacctggggcagtcaggcaagagaaagaaaacgcatccagatcagaaaagagacagtcaacgtgtctctgtgtgctgatgatatgatcttatacctagaaaactctaaagtttcctccaaaagtctcttagatttgatacgtgaattcagtagtttcaggatacagagtcattgtacaagaatcaataacatttctacacaccagtaatgatcaagctgagaatcaaatcaagaagtcaatcccatttataatcactaaaaaaaaaaaacccactagaaatacatttagccaaggaggtgaaaaatctctacaaggaaaactgtaaaacactgatgaaagaaattgtagatagcagaagtgggaaaacatcccatgttcrtgaattggaagaatcaatatcattaaaatgattatattgcccgaaacaatccacagattcaatgcaattcctatcaaaatgccaacgtcattttttatggaattagaaaaagtcctaaaattcatgtggtcccccaaaaaatcttaatagccaaaccaatcttaaggaaaatgaacaaagctagaggcatcacaatacccacctacagattttactggagggctatagtaatcaaaacagctagtactgatagaaaaatagacacacagattaatggaacagaatagaaaacccagagtcaaagctgcatacttacaaccaactgatctttgacacagttgacaaaaacatacactggggaaaggacaccctatttagtaaatggttctgggaaaactggacagccatatgcggaagaatgaaactggacccctatctcttaccacatataaaaattaactcaggtcggattagcgacttgaatgtaaggcctgcctgaaactataaaattcccagaagaaaacccaggaaaagctctctcggatcttcgcctaggcaaagaattcatgactaagacttcaaaagcaaatgcaacaaaaataaaaatagagaaatgggactttattaaacttaaaaacttctgcacagcaaaatacatagtcagcagagtgaacagacaacatacaaaatggccaaaagtgtttttaaactctacattcaacaaaggattgatattcagaatctacaaagaatgcagacaactcaacaagaaaaaccacaatccctttaagaagtgagcaaaggacgtgaacaaacatttctctaaagaagacatacaaatggccaagaatctcctaaacatactccacatcactaatcatcagagraatatacaaattattataaaaccacatggaatactatgcagccataaaaatgatgagttcatgtcctttgtagggacatgaatgaaactggaaaccatcattctcagcaaactgtcgcaaggataaaaaaccaaacatcgtatgttctcactcataggtgggaattgaacaatgagaacacatggacacaggaaggggaacatcacacacctgggactgttgtggggtggggggcggggggagggatagcattaggagatatacctaatgctaaatgacgagttaatgggttcagcacaccaacatggcacatgtatacatatgtaacaaacctgcacgttgtgcacatgtaccctaaaacttaaagtgtaataataataaaattwaaaaaaaaagtttaggaaaaaaaaaataaactgcatatatggaacgtaataaaaaaaaaccccacaatgagataccatcttataccagtcaaaaatggcaattattaaaaagtcaaaaaacaacagatgttggcaragttgcagaaaaaaaagagaacacttatacaccattggtgggaatgtaaattagaatgacctttatggaaaatagtatggaaattaatcaaagaactaaaaatagaactaccatttgacccagcaatctcactactgggtatctacacaaagtaaaagaaatctgtctgtcaaagagatacgtgcactcgtctgtttattgtggcactattcacagtagcaaagatacggaataaacgttaagtgcccaccaacggatgactaggtaaagaacacacacacacmcacacacacacacacgtctatcatggaataccactcagccgtaaggcagaatgaaatcctatgttttggagtaatattggtggaacttgaggccattatcttgagtgaaataacttagtcagacaccacatattctcacttataagtgggaactaaataatacatacacatggacatagagactggaataataaatattggagcttcagaaaggtgagagggtgggagggcagtgagggttgagaaatgagaaatttcctaatgggtacaatgtacagtattccagtgctggttacactaaaagcacagacctcaccactgtgcaatatccrtgtaatacaactgcactcggtcctcctaaatctaaatraaacaaacaaagaggcacccccttaaagctcagggtcttgccaactctaacagtggggtttcttgatgttttttaaaataaaaagaccattagttcataggtatgagagactgtcataaattaaaaccaagtaaggatggattgaaatacccacaggaggaactcatcttcacagtttatggaacaaatatagaacaaatatttactgagctcccactatgttgtaggcatcatctttagcctgcagtgacaaacccttgacctcaaggagcccctattatagtggggggaaaatgacaaaagtcaacagatggcagtacctagtatcatacatcacagtgctgtgaacaaaagtgaggctgagtatgggagacagagagaggtagagagtgctgttttaggtaaaggtgtcagaagaggccttactaagggygatgtttcatcagagacctgaatgaagtgagggaaagagccatgtgtatatttgggtaagcacatctcaggtagagaggacttttgagtttcaggagggtagaattgcatcaagaggtgagtgtggctgcgttgagtgaggagagtggtrggttagggcggtgtcatgaaggagttggaatttccttctcagtgtaatgggaagctgctttgaacagggagaggtgtggcctgatttaattctgaagtgctaatcctgtgcttgtggagacatgggctgaggtagtagggcactgaagctggaattggggggccagttaagatactattgcaggcaagagattatggtggcttggacagggtggcgatggtggaggtgataagtagggagtggatccagggtttagtctgaagggagagctggcaggacttgccgatggttggatgtagacgtgagagaacttggcggtggggcagggggaccttaaggttttggctcaagcaactggttgaatgatggtgccatttgttgagatgaggaacactggggtaacagtaggttttgggggagaaatcaaaggctcattttaaatttaaatacatgaaatttgagatggttttgtgtatccaagtgatgatgataaacaacagcaataaataacacttatgccaacctgccaggagctgtaccccaagcttcacatacattagttcactcaggccttacagcagccccatgaaggaataactgtcattattccagtatggcacgtggggaagctgaggcatggaggttaacttcattcatggtcatgcaaagtgttcatgccagaggttgaaccccaagtgttctgcttcgagtctgtgcttataaacgtagcttctgctattgttggctgtgtaagcctgcagttctgtggaaaggtcaaggctagagacatgaatttgggagtctttggcagacatttataaccatgcacgaggtcaccaagggattgggtgtagacaggaaagagggctgctcagtaagctgtggcacacctctggattgagagtcagttagagggaaggtgagaagtgtttccaggaggctgaaaaagagctggaagtggggcagaagaaaaccaggagmctgtggatgcaagccacaggagaaggggtttcatgaggtggagaatgatcagtagcatccagtgccacaagagaccatgtaacgggaaggctaggacacgagcactggatgtgtcagcagagatgttgtgggtgagctggtaagcggggttttgctggagtgggaggcagcaagctgatgggactgtgttcaagagagaatggaaggcaggaagaggagaagacgtgtagggacaattgaagaaattttgctctaagttgcagagacatgagatgatagctaggggaatgtagggaccaggaaggacgtttgtgaggtggtagatctcatggcatgctgacggaaacgatccagtgsagagggaaaacctggtgatgtaaagtgagaggagatgattgcacaacagtcctcatgtaagagagaagagataccgaaaagaacgcagaggagscaagacgtttattgacctttgcctgagttcgttattaggggacaccatarcatgatagtccctaaggaatggagagcagtgttgtgtgacattggtcataagcttttctgattgaccaagatgtatactgaagactcacttttttcttcctcccttccaggtgccatgctatgtgtttgatgaagagttgaggaagcatgatctcaatcctctgatcaagcttagtggtgcctacttggtggatgactcygatcyggacacttctctattcatcaatgtttgtagagacataggtatgaatctttgtggggctgagggggtggtggtgagggatttcttctatggcttcratatctttgcctttctacctttatttctgttttcacatccatgtttctgattaggccctctaataaagcttttgtccccaaaaatgttctatttgcacaacccacctcttctcccccagtagattccatgcctcctccccaacccctgtagattccatcctaactgttgatccattccatgtgggtgttctctcggccagacaccttgggtttcgggattctacagaagtgagggtcggtcttgttctctgtgtgtgcctgaatcccttggctctgagttacgggctggstgaaaaagaaaaagggatgatcaaggacttgggtacttggtcgggatgcatatttggcccaagctgacttgttcckttctctgtacttgccaaaactggtgtgagaagctttagcttaagctttagaatctttgataaattaactaaagaccgtaaataaatggtctttatctaaaaagggccatgaaaagttttactaagcctttgactagccttcagctggttttactaagccaagtttctaaaacccagcttgatgttcccctcagggctatgaattgttagtcctgtaggccaggactgtctttctgcagtgctagccatgagtaaattctgctggtgattaactaatctaaaggtcatttttagtgttcttctttgttttttatttctcaaatagtacataatgctttgcccttagaaaagtttggagaaaattttaaaaaataaactcaatacatggaagtattgctggatagtagatgagtattaatttatgattattctttaaattrtatatatacattatgtactatcttgtttatgtattatttctaaacagttaaaaacagtaaatataccccattcagggctcaccaaaagtaaccaatgataactaggtttttttgtgtgtgttagagtattacatctttcttttgttctccaaggataacctttattgattttttggaaaaagactaatacagtctttgtcttaaatgggtctgtaactcaagtttggttatagagttgrtgagttgtagattattgaattctggaataatacgctattttgatttggaaaacatttaggtttctggtctcttaacattttacagatcatctgaatttgctgagtattttcttacaagttttttctttccaatttattggcaatttgagtagagcttgaatgactttgattcacagtagrggtgccctagtttttactcagacattctccattcccaggaaattgccctaagtctcaaaccaagattgaatgtgaccctcaaaacctcttggatagtttcggacttgccatcatgtgcttacctccttgcatcctcagggcgcttgctgtgtattctgcctttggtataccaagtggattgtcttacactgagtccccatgagggcaaggagcctatggcacagcagatactataggtggaacaaagcagtccatttgtgaaatttcataattccacataatttcataattgtttggaaggcttgagagttaaaggtttgcttacctcttcactagctggtgcaaaggtagataaccctctccatctttgattaataaggcaggtaaaacttaagggaggtaagattattcactcactcattcgtgggagaagggttgtttgaatcccttctgtgtgctaggcactaatctaggcactggattatagcactgaactcaccacagttcctgttttcctggaactttagttagataggagaaaagatagatagtaaacaaataaatcccaaagtatactgtgtaaggtattgagtcatggtcatagaaatgaatggtaaagagcaacctagctgtaatcatagctgttgctatactggcaatctgtaaagcctgcgggatgttctggacatattctgggtatgttttcatctttaatcctccaccaaacctgtgcagtagcacactggcaattggatagttttgtagttagaccaacgttatcgacatagtaagtggtcgatttaggatttgaacccagagctgtgggttctttccctaatctcctaattgttccagtcatctgtggagtgcctgcattttctagtctctgtagcttgaaaggggatagtgctaatgttgttgtacctcaagcagaggatgggtacatttcttgattacaaataacatcatarcctgtttcctgtgcacctsttatataccagtgcagagccagtactttacagtccttcatcmtgagctttgtttgcagagggttaatggcttgcccaaggtttcagaatagttacttagggagacttttaggaattcaataatgtatttaaagggaccctgggtctaagggtacgtgtgattatcactcctaacacctaatctgatttaatgtaatacatgattttcagacacactacgagacccaggttcacagctgcgggcctgtccccccgrcactgccgcctgcctggtaagaggacaccaggcgtttgatgttggccagccccgggacggastgaagctggtgcgcaaggacaggtcagtcaaggcctccgatgctgttggcgtttttaatctccagcaaggacctgactttcagggagctgcaggaacatcctttttcagcaaggcttgggatagtccctgcagcattrctgcttcacatgtacttgtaagattgttggtcattgctgtgagtcacatagtctagtgtgcttgtctactttttaatcatttgtctcttacagcagtaaaaatacatctcatgatccagtccatagtacatacctgtatttgcctcatgaaataatgcctatcttaaggtgccatctgatatttttcattctgtggcacccgtgaaattgattttgtgtccattgtgttctcatcttgggagggcaagagacaggagggacagtttgctggtgaccttcactgggatgtgacagggaccttggttcccagtggggaatggtgttccttataatgtgttgtgcygtgtacatatgctcttgtactgcctttgtatcttgccttggcagacatacgcatttctctagtgtgttgcacatgaccatatcctgaacttcgatcaaggattcacattttctccccattcagaggcctttggtagacaccttgttgtgcttgctctagtctggagctcgtggcatgkctgggtggttgtagggagcatgtgcaattataatggcactctgtccaaagaaaaaacttgagcgtaacctgaggggaaaagtgtttggaattttctatgtgtgtgtctgtattagtttgctcaggctgccataagaaaatacgataggctgggtagcttaaaccacagaaatgtatttcctacacagtctaaaggctgcatgtctgaagaaggcgtcaccggggctggtttgttctgaggcctctctccttggctcgttagatggccgttttctttctgtgtcttcacgtggccttccctctgcgggggtctgtgtccgaatctcctcttctgataaggacaccagtgattttttggattaaggcccactcacatgatctcctttttccttgttcacctctttaaaggccctgtctccaaatatagtcacatgctgagctatggcttaggccttcaacatacaaattttgaggggaaacagttcagtccataacagagtctttaagtgacacattggtaattcttaatatgaatgagtttgtgtgamgatttagtaacatgtgggacactgagcaagtgtgagcttctcttgtgggaaaaggcaggtcatctgtgatcagctattctctagcaggcagccaggggcactgggccctttccacactgagtgcagtaaaccctggtggtgggggccatgttggatggtggtttgggtggtggaagagaaccccagttcagtaactgctgtaactgctgggcaggtgctgtggggttaagacaaaacaaaacttttggctggcacttagaatttgttgtataaagaggaaatgattgactagccttgtgggcaaaaatgcacctggcctgcttgtctgcctttttttttttttaattttgttatctcatttacaaccgttttttgcttgttttagtcaaatggtgtttcttcctttttttaaaaaaaataatttttttgttccttttctctttccttattctaggacatgaagcagatcaaacaggttttgtttttgtttttgcttttgtttttgagatgggtcttgctgtgtcacgtaggctggagtgcagtggtgtgattttggttcactgcaacctccgcctccctgttcaagtgattctcctgcctcagcctcctcagtagctgggactagaggcgcactaccatgcccagctaatttttgtagttttagtagagatggaggttcgctgtgttggccagggtagtctggaactcctgacctcaggtgatccaccaccttggtctcccagaatgctgggattacaggcgtgagccwtcgcacccagccaggttttcttaatatatcaaatttatgtgctggtcactttagatatttgattttttaacaaaataacactcactggagtttacttaaaacytttttttttttcaaatggaaataaagtcattttataccatatctacttttatattttaatatttcttctgttaccctctcctcccccccaagtgaatgtgctgaatgctcagggcaacatatgaatttggatgtactttatacttttgtaatactcttttctcaatgtggctctcccaggcttgtcctgagttacgtgagggaagaggcaggaaagctagrcttttgtgatggtcacagccctgcggtgactattacatttgtttgcccgtcggagcggagagaggtaagtgactcgtctcctgatcactaatgtggcgcacagtagcctgggttgcccatgcgaaygcgtttctgggcttggggcagggtgggcctggatgcaggaagctgggagccatgacagaggcactggtgggttctcaggagaagacaagcttcctgggatagcttctgtcacatgcagctcactcagggagagctgtttgcattttgccttttgcttttttacagcaatccggaggggcctccacatataatgggatggtrttttgttctagtctctgtgagattattttaagtagttcacggacagatttttttttggtagttgggttgttttagtgaatagtggaaaaacgaagtagaatttcaagcctgtgatttcttatgagaagcctttccctccctctctcttcccagtctgcccctaaacccccatccatgccttctcccctctttctcatcacaggccagtttattgctgtgccctctgctgttgatgaaatctccagcgcagctgtaaactcttcgagtgtggctgctgagacttacttgtccttgagtgcccagcgcctgcaagtgttttaaccaggggcaggtgctgatggaaaggaggcgtcccccagggagggaggggtagggcagggctttcctttagtttctttctgccttcttagtaatagggtgaagtagggaggggctgaattcttttgccagagaaccacactccccttcccccaagcaaatgtggaatttgctctgacgtcaggctggcagctggcctggtgtgtgtgggatatggagacagtgcagggctcagctttccactttctgtccccagacttccacatcaagtgctgtcagctgaatgaaggccggagtgtctgatgtttgttctgaatgtgaatggggaggaatatttattcacacttttcatttgtacctacagatgtgagttgaaatcttttaagcccagtgagatgttctcaggcggtagtggttttagtgttttccctttttatttgttctacatttggtaagaatcattttacactgtgagaaccaagagaattgggagttttcctcctttttcttcgaaggggtatgaggcatttcttggtgttagaagaagaggctgatttgttattagtggagcaagaagttccctctgttttttttttttttttttaaagacagtgtcttgctctgtcgccccggccggagtgcagtgccacgatctcacttcactacaatctccgcctccctagttcaagcaatcctcccacttcaagcaatcctcccacttcagccttctgagtagctgggactacaggcatgtgccaccacgcctggctaatttttgtatttttagtagagacagggctttgctatgttgcccaggctggtcttgaactcccaggctcaagtgatctgtccacctcggcctcccacagtgctgggattacaggtgtgagccaccgcaccggccaggtttcttttcaagcttaactgttcactgggcagaccttgtgtgacatgtgcttggacactgtaatacttgggaggtttgtttaagcatttacatttgctcattgaatgattttaggagctggtatttagtaaacactcaccttgtcatatagatcattttaaaaatgctttatttaatttatttattgggtttacatactgtaaagttcagttttttttaagtacaattcagtggttattagtatttttttttagaactgtgcaaccatcatcacaatctaattttgcatttccatcaccccaaaaagaaacctcctgcccattagcagtctcttcccattcataccccaagccctggcaactgtccaccttcttcctgtctctgtggattggccttttttggatgttttatgtcaggagaatcctacactgtgtggctttctgtgcctggtttctcttacggagccctggggtctgcatcaccatgtgtcagactgcactgagccacgtgggcagaagcatcgattatgagtcaaacagaagagggttgggcctgcagctctgcaacttactaattgtgtgcgacctgtttgtaaacctggcacctagtgcctggcgtgtagcaggtgctcagtgagtatttacggaatgaatggtgctgggaagcagcacggctatgcccggtgctaagcccagtaagtcgtgtctcctaagggtgattaaaaagctggcagtgacattcctggtgagcagggaccccatcagcccccttcatggctcacatcaaagacgaatggtggagctcctgctctgtagaagcaacacaatggcagaatcgggtttgtgtctgggtggtgccctggcttcacccaggagcaggtgtgggtacagatatggtggtgcccaggatcccaaaggggttgtggaccgtgtctctggttgtgcacgcatgtgataatgttcactcagtgtcagggttgcaccactccagttgagcacctcgtggaaagcggtgaatggaccatgcaccctgcacggcctgttagcgcttgccgatgtcctagtgattgccacgtgccactgagtccaggtgcttgctggccgaagcttgagtgtctctctgaaggtgactagactagaaagggaatagagtgtaaagaggaaatggaggtgttacgagtcaaatggaaaaaaaataacagtttagaaaaaaattaaaagtaactttactgagttgttayaagtcaaataatcttaatgtgttagaggcaattatgattcaaaaaacagaaacagcaaaatgtagaaacctaacaacctgtctttgagcttttcataagtgtggaaaatctgcattaagctgcatgaaacattttttattttgctkctttcacrttgttcctgatagggcaccattcccaaactcacagctaaatccaactgccgctatgaaattgagtggattactgagtatgcctgccacagagattacctggaaagtaaaacttgttctctgagcggcgagcagcaggatgtctccatagacctcacaccacttgcccagagyggaggtaagcaggtgctttctgcctcctggcgctgcttaggaagaaggggatcgagagagggaacgggacagtaggggccaagtcagtccatgcatgcttctgggttggagagagctgtartttgggctggtgtttcaraaataggattcaggtttgactaagtaagactgtaatcttctaatacctattcatataaaacaagcctcttcttgttaatttccctgtttttaggttcrtcctatatttcagatggaaaagaatatttgttttatttgaatgtctgtggagaaactgaaatacagttctgtaataaaaaacaagctgcagtttgccaagtgaaaaagagcgatacctctcaagtcaaagcagcaggaagataccacaatcagaccctccggtacgtcaacaacctctgtgcgattttcctttttctttgtatttcttgagatagggttgcactctggcgcccaggctagactgcagtggtgcaatctcggtgcattgcagccttgacttccctgcctcaagtaattctcccacctcagcctcccgagtagctgggactacaggcaggcaccaccatgcctagctggtttytgtagtttttgtagacatggagttttgccatgttgcccacgctgatcttgaagtccttgcctcggtgatcctcccacattggcctcccaaagtgcgtggattagaggcgtgtgccttgggaytggcctgcataattttcaagtgcgttgtgtgtattcttgtgaaacataactccctctccttttcttcctctttccattttccgtaaggtahgggagaatcagttactccagcattccttcctagtagacttcggcaagttgccgtttgtcactaaacaatcaaatgtttttcctggctttagagtaagaatgyttctgttagaactgttcactttataaacttgctgtttgtacggaacctactgtaggaaaagtatttaatgagtttacagttgatagggttttttattttaaaattcgtttttaaggagttttgatttttctctggcagtttgagaatctgaagcaccatcaacataacagaaaattttaaacaactaaaaaaatgcattcagcacatttcttttgacccttaacttggtagttgaccttcataaaagcaggatgaaaatgcagttttctgaaaatgtgttaggggcagttacgattcaaaaattaggaacagaaaacygcaaaaaccccagaactggtctttgagctttttaaaagcatggaatatctgccgagaagctgcattttaaacattttatttttgcttctttcaaattgttcaggatcagtatagtccaaggcccctcaggcacggctgtgttcatggcggctgttaagaaggctgtctaattcttgggcgttatttattttgtacgaaatctaaaagygagaacaagagaagtcttcatgctcacagcaaaaccttcggcactttcttccagccagttactactttgaagcragaggatgtcaagtccatacatttggaactcatttcctgtagatatttttccctagctggctagagagcttgctgttttagatccgtartgatttgttgatgctacgcaaaaggcttaatgtagacatttaaaaagattcaagtttttttcttggttctcccaaacacatttgtctgtgtattcacaaaaatctagatattcggatggagacctcaccttgatatattttggaggtgatgaatgcagctcagggtttcagcggatgagcgtcataaactttgagtgcaataaaaccgcaggtaagtgtgcgctggagttcagcccctcctctttgcattcatgggcatgtgcttgtgtgtgtgcacaggcgtgttcttggaagtgaacactgaatggaggagtcagatgccctcctttggactggccagctctagcccccagactgggttttttctgttggagtaacactttccccacccccactgccccagtggacacacacacatcctgtttgtgttttcctcggttttctctgtttgttttgggaatgggcccagcaatgagcttgttgggaaagttttcatcttgaattttggtgcacactaaactacagcaaggacagattcggcaggggcgggatggcttgtcaattttgattgagtgacctcttyttttatgtaatgagtatcaagataatcctttttgcaaagtggtgaccctrtggtagagtttggatctggggattgcagaatgtcactgggtgcrttgaagctgaaggcgtgcatttctctgagtaatgagaagcacccttgagtcaccaaggcactggcatatcaaaaagcggtgccgctgtccatatcttgacgattgtagacacagttgtagctgtagagagatgatgggattcygtcatcatcagagacctgccccatctgttgacccccaggctgtgactccaggcaccctgcagggcatcccaccactgctcagagcaattctagggcccattctggtttccagcctaagtgctgccccacccagagggtctttctggcccttgcttccgtgtgttctgtgtgtttttctacagcagagctttgggtggcttggttacaggatgggttgctacaggattcactgtgggatgagggagaggcagctggacatgatgtgaaccatgctctcgaagcctccggagatcaggtctgcgttgggagagacaggcacccctgccctggtagcaccgcacccctgcgaacgtcctagcaagcaggcaaagaaccagcccagggtcttgccactgggaaggctttcaagcccaaaatgccccagtaactgctgttgtggcacctgcccctgggatgcccttgttcacaggtctgccattgctgtccttgttctctacatggccccttttgttactttcacaatacacacattttttaagtacctatttgcttaggccctatgaggctggagggtgttgtgaggatagatggctctctaggtgttcacagactagcagcagagagagataaggagcatgatgatggaggttcagggcagtgctgctagagtagagcgagtgcttagtgttgtcgctccgctgctttaccaggagggaggcaccgaggtcagctggctggggtctgggctgggtgcaggggtcaggcagttcagagaggaggaagtgctgcctgagccacactacattgaggagcatgccagtcccgtgttggggtggctttagggcctgggcctccagacattcaaaggcatggaccaggggaactgcgagcaggttagaggcgtgtatggggaatgtggctgaagatgaccctggaacrgtgagtgtgcagtattgtaagaaacttgtatgtcctgcagaggagctggattatatctggaaatctgtgaagtcccaaggattttcagcaggggtatgacatacatctgactcgtgaatgagaaaatcagtgtggcctstggatggacctcgcatctggtctgagcactccctgcacccctcagcttctccatcattctctcatcgccctcacctcctagcctacctacgctactagcctccttagccatgtctgcaccctgaatcacgtctctcctacttggtgtccccagtccccagggatgcagcctgtatcttccccatgtgcccagcccctctgatgcctgaccttggttctggctcccaggtcaccccaactggctctcctggactccggctggctcargctgctctgctgtggtctgaatctccctgcaactttgtgatgacctcctttggcctgttctgttcagggctttttattaatgacttggccgagatctttgagagtgtgctgatctcatttggggatgctgggaagacagaatcatyatccaaaaagatcgaaatggacgagcaggatatgagaagggcattatatcgtttcagacttacagggaagaggtgtggacatcgatgagctgccaaccaaacaaaaaacacaggagagaaaaaccaaagaacagaaagaaagaaaaatagaaaaaaaaaagaagacccgcagtagagtggggagatcttgccttgtagttatgagcatagatgaggccacaccctctgggtttggttcccagctgccctrgtttttagttatgaaatcatgggcccagagggagctaaagcccagatgagctgaggcttgacaaaacgggtgaaggcctcccatagctccatttttccttttcattataaaaattttcaaacatggaacattaaaacagaaatttacatgcctgccactctgacagccattgatgttttgscagatttttcatgtaagccatgcgtcattgatggctcatatcaccccaccctgatgccaagaacgaacattcctttatgtaaattcagtaccatcgttgtacttaacaaaattaacagtgacatcctgatgttaaaaaacccatgttttcctaggctgttttcattatgattgtaacaaggagcctggacagagagatgtcaggtgttttgtgggagggttttgagctggctctcaggcaggagttggattaaaaaatacttacatttccttccagctctgtaattcagcactccaaactctgagagcaaattgtgtactgtaaaattagttcattattattttgctcgaatttaaacttagagtttttggagaatatcccttggtagactctgtttattagatagatgtatttttgaaggtgaacgagtgttaattggctatgtaatagaagtgtggtttaagttggatctctaggaattattcatgtgaatctaggttcatgtacttttcaggatgcaagcgcatcttttggtcataatattttttaccagtttaaatctagtttgttgtaaagcgatgctttattattggtgatttttttaaataaagatgttagataattttttggaagagcagaattcattaggataggctaataaactactcacaayttaagtggctcagcccattaaaggtttattttcttagttcagtgctagtctttggggatggggctggggtcgggggtgcgggctctgctccatgtggtcatttggagacctacgctttttccatcctgtgtttctgccatctgcagatgtgacttccaggggctctgcaggatgggaacatcaatttgctttgttttattttttttccaggccagaaataagtcacttggcccagcctgaatatcaggggaggctgggaaacggagtttagctatgtgtctagaggaaaaattaaactagttgggtaagaggtagcattgtttttgccacagagaaatgggtgctgctgcctcctccttaggcagagagctccttggttccatttgaaaaccttccttccccttttgctggaattgagagactgaggacacaaagtggtgtgctggakaataaactagagcctgtggtgccagactggcaacttggggattgtgtgagtgagggagagattgtgcagagctaatcctaacattgctgatgagtggacagaaaccataggcctcatgaatagtgatttctgaagtcaaagcccagtatgcttaaatatcaacccaagtggtttgggagaggggagcacagcttactgttctgctaaaattctttgaggaattaagtaagaatacgtgtaaggtacgtagcaatggttatttacaaaatggactctgcctgcagattattagtatgtctcagatgtaaaaccagctcaaaagtactaggacgatttgtagtagtatttaattatttgtaaacttasacgtttttcttcacgtttgcagaatacaaatctttgtcagtagtgaaatgtgaatctagtaggattaaactgtgtgtaaaccttgtgggcgggatgaagagaggcagaggcgcgtcactgttgctgttagttgaccggcaagctcaggggcccagctatggtagctgcctctgggttgtcagctgcgcccaggaggtgaaggtggaaggcattccttaaagacagtggcttagtgtacttattaaaaaccaaaccaaaccagccaaccaaacaaacaaaaaacacaggagagaaaaccaaagaaaaaaagaaaaatagaaaaaaccccacagtagagtggggcaatcttgccttgtggttatgagcacggatgagggcagaccctcagggtctgattcccagctgccctagtttttagttatgaaaccataagcaaattatttagccaccctaaatctgcaaaatggtgctaaaattgtacctttgccatggggttttgaggatcaaatasattaatatagtcatgtgttgcttaacaataggaatatgttctgagaaatgtgtcattaggcgattttgtcattgtgtgaacatcatagagtgtacttaacacacacctagatggtatagcctgctgcacacctaagctatatggtgtagcctattggctcctgggctacaagtgtgtatagcatgtgagtgtactgaatactgcatgcacttgtaacacaacggtaagtatttgagtatctaaatatatctaaacatagaaaaggtccactaaaaatacratactataatcttttgaggctaccgttttatatgcagtctgttgttgaccaaatgttgttatgcagcacgtaactgtataaagaaagtacttaaacagagcctgttcttctgcagcttgcctttatgtagccgaggtgctgagctcagtgcctggctgagattgtgctcactacaggtttgccgctgtggctggtattataattatagtgatgataatattaaagattggatagaaattacaattgaaatatcatttgctcttggtacagaatcttacttcctgttttcttagatcattacctagcttatgataccaaacctcaagaaggcagatcacatggtgggaggctcagacaaggattatgaaaccatcaggggtgggaaaaggagtgttgtgcccacggacccctagcctggaaaggtgcagggataggatttccagcaaggagcaagtcagcaaagcctctgaatctcagcgtccatgggatggggacgtggcctgtgaagagctggttttcagacttaggcctgaactattcctgctgatggatgggaaatctgggtggctcactcttggtggaagaagaggcttgatttgaggagggtgttacagacaggtgcactgacggaaccacagaatttcagcactgtttggagttgtgctgctaacattgtggggctggcataggaccttggcgtgcttcactgggagcgactgactrtagatggcttccactcttgttttactttagggatgagtcccagagaacttgtcttgttcacagtcgcatcactaagtcagcagtgcacagggaactagagctccatttctgtcctcctttctgtgagtccccaktgtcacccagagatgttcaggagcctctgggagctgaccacagcccgggagcagaggatcccactcactgctcttgcgttcctcctgcctgcccttttaatcttatctttggagrtgctgtacayagccttctgtcaatgtctcccaaggtgaaaggcatgctggcctgccatcgaggacttagggttaagcatctgaagcttaatagaagcctgtgtcaactcagatccccatggtctctaaaaaaacctggacctgaattttttaacggagcagttggcattggtcctgttcagtttcttccttgctccttagctgttcctcaattttggtcacgtatggagtttaaatttctcctcttgaattgtgcaggtaacgatgggaaaggaactcctgtattcacaggggaggttgactgcacytacttcttcacatgggacacggaatacgcctgtgttaaggagaaggaagacctcctctgcggtgccaccgacgggaagaagcgctatgacctgtccgcgctggtccgccatgcaggtactgccctccttgccatgcgggtcttagtccacaygctcatggaacattttcccatgagtayttttggaaatgcggttacyattttctttgtcagtgggttgcgtcacagccctcccccagttttttcatgtggctgtgtgaattattagaaggagcattggactgggaggtgaaataactgaatttgagaccagcatttttgaccttgtgttttcacccttttacacactgcctctcttccatctctgaggtgggatctgcagcctctgccccctggggttcttctgtttggatcctctaggcagatggatgtgcaccttgggctgctgttcaccgctgcctcagcgtgcagtgggcttgtactcgaggctgagcttgctgttgcacggcaggcaccggatgaggtgccaaggaggcagcagcgccccccacagcacaacccctgtccttgggggcctggaatttagcaggaaacagagcaggtggaataataagaatgggagtctcaagcagggataatctgatgggggggatttctggttttaccctcttggcagctcaaattaggtgtacagaagccagttgcctctgtaagggggagatgacccgaagcagagagaatgacttgcctcatgtaattaccacccagaacagtcacagaactgctggcggtatgttctcgctcgtaagtgggagttgaacattgagaacacatgggcacagaggggaacagcacacaccatggcctgtttagggttgggggtgaggggagggaacttagaggatggatcagtaggtgcagcaaaccaccatggcacatgtatacctatgtaacaaacctgcacgttctccacatgtatcttgtttttttttaaagaaaaataaaactgccagggtgacagcactgctgctcctgtcttctgagtcccacctggtttgctaaataccaggttagaaagaggaatccctcttgtggagtgtttgagaacctgcctcactgtgaaccgcctgggcagggagtgctggcagtgctgttgtggttaaacaccctgtgtgctgctgggaacggtgccatagttaattctggcacatgtgtgctagtgaagacattgrttttctgtgaagtggaaagagttctagctgcagagttggagacctggctgaggactggtgttgccgcatccaaccacatttgcttgagcgagctgctctccaggcccgggtttcttacggtgaactgggtggtgctgttagattccttaagttaacttttttttttttaaacattactgtgtataagagacaacctaggatctatgagataaggagagatacatttttcaatctrcagacttcctgacatagctctggtttcttggaatctgcagtatttcgtggtatttgtgcgtagatagccctaagtaaattatgaagggagagctaaaaccattccttactgcttgaagaagtcccttaagactttacagcccacctggctccaccccagacttccagtgtttagggcaggtccttgttcacatgcacagtcttgtatggtttcttttaggctgttgacattggaaagtacttctccaaatgtactgtatcaccactgatgagtcatggggttttgccttccaaaccccagtacccaacctgcaaagggagcattttcaaatgagaacgtgtatttttatatctttacctcctccttgacacactttgtaagttactccttcagcgactgttcgccgtgtggtttgctttttgtggatgccctcgcccttgcttgctgtgctggtgacactcagctggtgccccctcacgtcctgcaggtgcctaatcagtgtctgatcacactgaccagctcaccagtcttgtgagttcagcggccacctgtggtaccttgcttgtcttctgtggtagcatgcattgcatcctgcactcagtctgcagatgtgtaagaggttgctggtttcttttagcttcacaggccttcacaggggccgagcggggtgtattagcaatggtgttaagcggggtgtactagcaatgatgtaccactctactgcgtcccaagacacaggctggcttcttgatttgggttttcagtttctaatttcatactgtggggcttgggagaattttgccgttcagttctctgtcccccagttggrcctactcttctgaagaagtattgggatgtagtttgtttctgtcacattaaatgagaaacctgagaatctcggtgaatttttgtgctttcagtctgcccgggttccagaaacagcgctggggattgagtgacgaagtggtttgggaactttgagcccttgacttttggcttaatcactatttattctgtgactcagagaaatcagcattgcttttggctaaaatacacttttgttttgttacagaaccagagcagaattgggaagctgtggatggcagtcagacggaaacagagaagmagcattttttcattaatatttgtcacagagtgctgcaggaaggcaaggcacraggrtgtcccgaggacgcggcagtgtgtgcagtgggtgagttgtgcctggatggaagatctaggtgatgcttttctagggcatccagtttggaatgagttagaagatctttctgtggttcatctaagcctcctctttctrtaatcacatgaaggatggtaaaaatttttcattcataactcaaatgtcagtaattgcttgatgcactctggaatcctgaagttggctagagctccctgacatkggctaaagccataactgggaacagaaggaaccacgtggaaaatamtacatcatctttttagtttgtaacctgaagaataacattgccagtgtttgtgtacaagtgattttattttattttttaacaactttattgcctagaatcgttcaaaagttatggcttgagtgaagtgtaatctcagctgtagccctagtgtaagaggggcttgcatgcttcgcttccttttgctgtcattgttttggtcccgtagctgtcatgcagagacttctcaattatttgatacaggtatttagcacttcatttttgtcatttatgactcactttgaaaatgccaggctatgagaatagtgagaatctgttaaaagcattcaataaggaattgtgagcctcgttggattttaggaattatctcggtrttcagaattgctggtgtgtctttaaaagcargttcaggcatgtccatgtctttactaagaaggactttggaacagagttttaatcctttataacaaaaagcaagtgaacyaagaagtaagyggcctcctgcttgggttgctaaacaggtttygttaatttctgctttggatatgagacacattctcaccctttggctgtgtggctgtgctttcaaaagactttgtgtyttggggtagctgaagccctgacagtaggggacaatgtcagtttacagttggtgctgatgcatgttgcaagccatttggtctttcttgccctggaagggcattgtgcatccttcatggcrctttctggctgaacctatggatgaccctggaggaccccaatgtggctgttaatgtctagccaaacgtggcactctagggaaacccwtcygctgccttggtgggttcagggggctggagaagggctgcrcktgctgggtttgggctgatttctttctttctttctytttctttctkttttttttaagtcacttctttbcgtgatgatcatttttaaccacatcttctgttttctccccctttctcttccagataaaaatggaagtaaaaatctgggaaaatttatttcctctcccatgaaagagaaaggaaacattcaactctcttattcagatggtgatgattgtggtcatggcaagaaaattaaaactaatatcacacttgtatgcaagccaggtaaaaattttaaaaaagatgaaatcttttctggcttctgccagaggtcctgcattcttcatakctctgttcctcatcagtcactgcaaagctgatcagacagattggcatggtgttcagcattttgagttccagactctggcgatgggagataggtcatttggaatttttccctcatcccctcctcaaaaccaaatcagaaatggagaaaccagatggtgtcagaagggagttgtgggtctcagcrctgtatcctcttcctcrggactgatactcggccagtcatgtggttacttaacttccttcaaaggggaaaaaaatcataaatggtttaaaacattgcccgtgatctcaccacttaaacacaatgttaattttcattacctttatttatagatgtatgttgtttttacmaagtcaaaatttttatggtaacaaatcttaatgtttctcaaagtgtagtattttgtaaatacttttctatgtttcacagttccattaataatttttaggaacttccttgttgacatggtgtggttttactatttttgaacattttccttattgttggattaatagcgcgtttccagtgttgctaattgtgctattatgtatcctctctytacctcccattgaaatatttcctttggataagttcccagctgtgggataaagtcagaagctagggtcattttgtttgtttgttttatatggtaaaatatacaacataacgtaaaatgtaccatcctaactgcttttaagtgtgtagcttggtgacattgttgtgtaataccaccaccatccatctccagaactttttgatcctcccagactgaaactcagttcccattaaacacgagctctccattccctctcttctactttttgtctctacggatytgactgttctrgatacctcatataggtggaatgctacagtatttgtagggctgttttttgacccttctatgcattatacctcatttcccactgtcccttccaagtctacttctagcagagaagaatgaggtaagatattttaggaatgaacggattagtgatccccatctcttttccccattgacaggtgatctggaaagtgcaccagtgttgagaacttctggggaaggcrgttgcttttatgagtttgagtggcrcacagctgcrgcctgtgtgctgtctaagacagaaggggagaactgcacggtctttgactcccaggcaggtctgtgtccaagcaggacctctgctttaatgtgacttggaaccacttaaggttttttccttaacattctgtgtgaggttttcaaggtgacccgccttagaattttattcatgctgtttgaacaaaattctgaacatccgatgtttgaggcttatttgagatactgaaaataytatcttaaattcattattgaggtggttttgctgaatgcaaaaccttcggaacacaagggaataaattatgtttgaaaaggctttcgtgtgaattctaggcaagaaacctctctgagggagaccttacaagaaggccataatatcatgctcgtcctactttgaacatgctgttgtttattakcccagcagttaygggctttgaatagcgctttaggctaayccagtagaagggaatggtggagttggatccatctccaaggaaaatgttagtaatcgcggttctggtggcctcaaggggcagcgtctcttctgcctcctccacttcttcctgccgttgggaacctcctgggaagaacctctccctttcaaactgtggggtgagaccactctgttaactgtcggactgaccttccatacttttattgtttttattctttcttagggttttcttttgacttatcacctctcacaaagaaaaatggtgcctataaagttgagacaaagaagtatgacttttatataaatgtgtgtggcccggtgtctgtgagcccctgtcagccagactcaggagcctgccaggtggcaaaaaggcaagtagcttctcagttctgtttcattcttaggcattatatgctaagaaatattattttcaggaataggtgtgttctcacttaatgtcattgctttatgacaagcatttaaatactgatgagacctggtctgaaaactgaaggatgttaggagtttaatttcccagagaaaggagcaggcccatccttgggaaagaagggtggattgaggtyatgcctcactattgcgcattttgtgcttctcagtgcctagatatctctgtgcrtatttctgcattctgcgtaactgcagttcaaatgaagtgagttgtctaaaccagcggtgccaagaggagatttgggkcccagtgttcctgctgccgttggagaccttgtgtgggttcctgtggtctgcagcccgggcctggttctggtgactcctcacgtcgctcacgggccctcccttcagtgtggcagccttggagtgcttctgcccctcaggtctttgctgagagaaacgtgtrtttatttcagtgatgagaagacttggaacttgggtctgagtaatgcgaagctttcatattatgatgggatgatccaactgaactacagaggcggcacrccctataacaatgaaagacacacaccgagarctacgctcatcacctttctctgtgatcgagacgcgggagtgggcttccctgaatatcaggtaggaatgtttgtycctcatcgcgctccctgaggatactcatgcctgtggtgggcctttcrtttaagcagagcttgtatcagtctgggtttccagccaaatcatcaccgtcattagatttgccagggtgcctgggcagtattagtattttaagctgtttatttagtgggttgtgcaccttaatracagcccacaagcctgtcagttttgggtacaaaacatacaaaagcataaaaaaaaatcctgaattaacccccacttagcagaggctaaattttcatcctgatttgttactggacartcytctttttaataaaatgaagggagatgggcagactaagcttttcttcacagtttctcattgggaacattgctstcgtccttttttgaatcctggttttatgtcacgtgtctttctctttttgccatccctccgcgcatctgccgtggattaggaagaggataactccacctacaacttccggtggtacaccagctatgcctgcccggaggagcccctggaatgcgtagtgaccgacccctccacgctggagcagtacgacctctccaggtgaggcrgagtcagctgctctgtttttggcctggtacagatgctgaggttgcaagtgttgctggtgagcgtgtgactgagctgatgatggggagtgatgctggctgtggggctgcaggaccaaggtggggcattttcagcagagtgaattctaataacwgtctggtcgcctttgggatagcaaccagtcttggccacagcagagcctcrgcctttagcttcatcatttaaaacaatgactgtcagtgcagaggcacgggggacagttaaggtccactgcatactgagttcagcgaaggtggagtgtaatcctggtgcgtcatgcgcccagacaagccaactcctggtagtgtgattggtggagcatgttttatttggtagctttacttccmcaactacatagaaataaatgagactgaaatgtgtaagctctttaaaagcatatacattttgctttgaaatyttagtctggcaaaatctgaaggtggccttggaggaaactggtatgccatggacaactcaggggaacatgtcacgtggaggaaatactacattaacgtgtgtcggcctstgaatccagtgccgggctgcaaccgatatgcrtcrgcttgccagatgaagtatgaaaaagatcaggtgaatctgttttcactgcttgtctcctttgccctcctaattccatgacttagtgggaggaggtggttattctgggacatccagatcaaaggcagcacagctgctcgagagaaaccctctgagtaggagtggggcctccatgtgaactcatctgcctcctgtaggagcagaagtgtgtcacacaggaatcattgttcacatggagaatgctgtgttgcagacttttgatcacacaaagggcagaggaagcaccgaatggttatgtctagcctgaattcaaaagtgtctttaggtgctttcagcagacacctgtgaaaaakagagttttgcttccaaaagctcttgtttctggattgattagggggaaaaacsgatttgggagagttgctgtggatgaaccagattcaagcacacgctctcattcgctgcagttcrtccctgggttgaatgcagtcaccgccagaacatttacccgtctcctgtggtcgttgtacgtggtgaatcttaaaagagatgtctctggacatctgtattggcttctgtaaaaatagcatgttgggaatgtacttttcttggtgtatgctaatggcagcttggaggtttttgaaaggaaggtggcaagtgtgctctggtggttaggaatcgagttcctggttgtgtttacctctgcacatgtgtgttctttactggagcaatgagttcagtgtatagtcagtcctctttattcacagattctgcatctgtgaacttgcctacttgagaacacgtgtaaytccaaaatcaccacgcggaacactttctcagtcattgttggaayragtgtagtggcccaatgtgcatagtacccgacaagcctgttcctggttgaagttgaacagggggacactctggcctcttgtttctgcctcaccctgagatgagcaggggatggagagggcgaggcagtgcagtgcaaaagctccagccctggggccagttggacggggtctgaattccaactctggcatctcaactcagagatgctccagagctggaacttccgcgctgcactgcctggtaaggtctccctaagagaagtttcttgcctagaattcacactaaagccttttcaaacatgacttactcccttgtgttcggaaagtttagcggggcagccttaggtgagccacttaacactccttaacctcgtttttccttctgtaaaataaagagagtagaatctgtcagcatgagttgtcttgggatttcagatttataatctgtgtgtaataggtttgtttgcctgatgtgcggccagtcagtacrctgagacattggggattacagccgagaaagagtttaattgtagggcaggcgaatgaggagatgagaagaaacctcaaattcacctccctaaggaatttgggttgagggacttaagggatttggagsgggccaaggtgtggggattgtttattggtagaagagtgcrgggtgaagtcatcggatggggagatgaagaaactgcatttggttccctgtagggaggtcttcatagtggttagtgtcagccgttccaccggaattcaggatctgaagaacatcttacacgattattgaacgaaagccttatgatkccaatgccagtgattctttctgtagcaataatggggatgtgactagtatctagtgctatgtgactttcagttacaggccagcatgcagcctgattggtgctcaattgcatgcctggaacgcagcatgcagttgttgttaactctttgaggatggtttcctattccatatgtaataaggggatttccccaggagcagtggttctgtattcaataattcattgtttgctgcagctttatagaatgtaaccaccaccaataacgaatcgactgtatcttcagggggaaaagcctaacaagactggttttcttgcagggctccttcactgaagtggtttccatcagtaacttgggaatggcaaagaccrgcccggtggttgaggacagyggcagcctccttctggaatacgtgaatgggtcggcctgcaccaccagcgatggcagacagaccacatataccacgaggatccatctcgtctgctccaggggcaggctggtaaggcactgctgctggctggtgaccttcactgctgcattttttgactgagcgttgccttatgtgtytcttaacagcagcagtcttggggtgggtggyggagctaggccagtcttagttctgcttaaggtcagtgtgcggtatatatgttcacaggcagggagtgatttgtggtaccttcatggctgcgatttctgaagtgtaagcctcatcttttgctgcggagtttgaggctctggtgacatacactgtttcctggattttttttctgagtcgtacagacattatcttgcctcttagttcttgtgagttgaggatcgtggcagtggaacggggcttagagatagkttggtcctgtaggggccaagggaaagcttccctttcaccctttgaagtttccctgaaaatcagctgtcaacaggagaaaagacattaaaattttgacgtgcatagcaccggggaataaatagcaggagaaagatgacccagtagcctaatgcaacacagaaggttatgtaccctatttcacaggggagagggagataggggatgtagacagttcttttgacggggcagcaaatgattatttgggagaaagaatggacagaaattaacttgcaaatgattctctttggagcctgaatgaggaaggcattatcttgtgcacaagtctgtccaggtgtgattgctgtcctcagtcttcttttgtgggatagataatgagatttccgagtttcttttggaaagaagccttcttggtcaggtaaggaaattccagagaaagtctctccctgtgcttgagggtggaggtaacaaggcacggttcaaaggatgaccttgattctcaggcagcttctcagcatgtcaaagcactgatccttggggtattgctttctgagccccagcagtccaaaccacaaagaccacagataggaatctgaggcttggtatagctcaggcctgtgggtgaacgatgagggctgtatgtgtaatacaaaacaggaataagaaattaaggctgagggctgggcacagtggttcagatctaacccagcactgtggaaggccaacatgggaagatcactcacttgaggacaggaattggtgaccagcctaggcaacatagtgagaccccatctacaaaaaattwaaaaaaaaatttagccaagtgtggtggctcatgcctgtagtcccagttactctggaggctgaggcaggaggattccttgagcccaggaggttgaggattcagtgagccatgattgcactgcagcctgggagacaaagcgagcccctgtctcaaaaaaaaaaaatygggaggcagaggtaggaggattgtttgagcccaggagtctcagactagcctgggcaacttagtgagaccccatctctacaaaaaattagccaagtgtggtgatgtgcacctgtagtcctggctacttgggaggctgaggtgggaggatcacttgagcccaggaggcagagattgcagtgagctgaggatgtgctactatactgcagccccttggcaacagagcaagatcctgtttcaaaatagtaatcatataaacaacttcagcaaagtctcaggatacaaaatcaaggtgcaaaaatcacaagcattcctatacaccattaacagacaaagagagccaaatcatgagtgaactcccattcacaattgctacagagagaataaaatacctaggaatccaacttayaagggatgtgaagaacctcttcaaggagaactacaaaccactgctcaaggaaataaaagaggacacaaacaaatggaagaatattccatgctcatggataggaagaatcagtgtcatgaaaatggccatactgcccaaagtaatttgtagattcaataccatccccatcaagctaccaatggttttcttcacagaattggaaaaaactactttaaagttcatatggaaccaaaaaagagcccacattgccaagacaatcctaagcaaaaagaacaaagctggaggcatcatgctacctgacttcaaactatgctacaaggctacaataaccaaaacagcatggtactggtgcaaaacagatatatagaccaatggaaccgaacagagtcctcrgaaataacaccacacatctacaaccatctgatctttgacaaacctgacaaaaacaagaaatggggaaaggattccctatttaataaatggtgctgggaaaactggctagccatatgtagaaagctgaaactggatcccttccttacacytgagacaaaattaattcaagatggattaaagacttaaatgttagacctaaaaccataaaaaccctagaagaaaacytaagcaataccattcaggacataagcatgggcaaggacttcatgactaaaacaccaaaagcaatggcaacaaaagccagaatagacaaatgggatctaattaaactaaagaccttctgcacggcaaaagaagcatggatgaagctggaaaccgtcattctcagcaaactatcataaggacagaaaaccaaacactgcatgttctcacttataggtgggaattgaacaaggagatcacttggacacacggtggggaacatcacacaccagggcctgttgggggctgggggggagggatagcattaggagaaatacctaaattaaatgatgagttgatgggtgcagcaaaccaacatggcacatgtatacctatgtatcaaacctgcatgttgtgcacatgtaccctagaacttaacatataataaaaaaaggtattaaaaataataataataaaatgaattaaggctaggaggtagaggaggtgagtgggattgatgttggccctgagttccttagccaggggacaacagcagactgtgtggagtttgctctgctcttctctccatggaaatgctttggggccattttatacagtcccaattgcttctgttttttaattggggtaaaatatatataacattaaactgaccattctgactgtctttgggttacatatattatacacatctctggtgtcctgtatttatcaccagtatccatgtccaggacttttacagggtcttgctgtgtcacccaggctagcgtgtagtgggtgtaatcattgctcactgaatcactgcagcctcgacttcctgggctcaagtgaccctgtcacctcagcctcctgagtagctggaactacaggtggagttacctgtagttatcaaaatggtttttaaattttttgaagagatggggggtctgtctatgtggcccaagctggtcttagaactcctaggttcaagcagtcctcctgcctcagcttcctaaagtgctgggattataggtatgagccaccatacacagcctagaagttttttgatggtctcaaatctratttggaaaggagagctttatttctcataaagatttgcagcctgcagggtggccatttctgacaggctgggaagtgtagcctcaggccagaagccagaaacaagcgctgggagggaggaagactaagacacgaatggatgctgaacaggttagtcaagtatacatattcagcaggttacaggagcagctatgcatattcacgaagggatggcacacacatgcgtggtaggcaacatgtatgcagcatgtgtccccatgttcattttgggttgaagacataacatttaaatatattacagttgggccctgtatgtcgaaaggtgaagcagaggacatgaaggccctctgtgtgcagcctccttagaaggccaggaccacctgggagttgtggtctcttatcagcagggaatgctggtcgattgttgtgttgtcagaaccacaaaaagggatggacgttgtcaggtggtaggttgataccagcagcagagtctttcaaaagggtcggcttctgtttagcacttagggaagaaagcctagtggttaacgaggaaaggggtgtaatggggtatgtctcacctcccaccccgtcatggacaggaatgcaatttttaagtttctctggagtccccttggctaagagtggggtgtgttcagtcagttatggggcttaggattttattttcatttcttattacctgtagttttaggtttataccagggtcatgtgtttttgagaaattatcaaatggttaggagagtggagagactggaagccatgttcattatcaactaaattattaacaatcccttgttaagggtgtgtggcagcttcctcaagccccactgaaatgagccagcaggatgcgttctttccctgcagtggcccagtggacgctgcgtcactcacctgcctggtctgctttgtcattggctaacactctttttcctgagagacacttcctttagagttgaagatctcggtgatcagggaatgaatgacgggcaggctgagcttggcccatgctctctgcgggaggtgttctacccaggttgtacacactctccttgggttcacctgagcttgggccgcccacttcttctctcagtctcaggaaggatccaggtttggtgttccacggggagatgcctaggttgcccagttcagcctgctggtctgtttttgggcacrtctgtgcattccctgcctgtggactgccccctccttctctggtttcttgttgccattgagacactgggtagttccagaaagttcttggacccttggttttccagcttttctgtgataccatatttagtttacagggtagcttcacattgttgtcgtgtctctcagcactcatatagggcctgcagcacaggaaatacactcactgaaggaagaaagggccgctctcccaggggtttgcagtcacagaactttcacaggctaaagctcagtccctttcacaagcacattgtgaagtggaaggagcaggtgtgtttttattctactgctagtgttgctgaggcctggagtgggtgggggctttcaagggtagagagcccttgacggccaagggtgtggactcagtgttagtggctgttgttcctgaacccgtgaccctgggcaggtgtcttaacttccttgtgcctcagttttctcatttgtaggctgtgtttgtgggtcactgtgaggcgcagttgagaaatactaacaaaactcatagtgcagtcctggtgtgtgataaacactccctgatcggcagctaccattgcctgtgtggtggtggtgctctcacaaagctaatggctctttgggggagctttttatggaaacatacacaccgaagggcacacagatgataaygtgacacagctgggtgagtgtccataaactacacatcaagaaagaacatgcttccccctaggagccctcctgtgccctcttcctgccactgctgagcatcctcctgacctctgacagcgcaggccattgttgcccaatcctgagctgatgtcagtgaatcctacgtaccgttgcctttgtgtatggcttcttgcattcaactttttgtgtagggtacttttcagaaccttgagctcagacctaggtttggatctgaattctaccatttactgctggcacgatttctatatttctgaatatccaagcgtaggagattattttgtcttcatagggagaatgagaacattaaattctaattaggtaatgcacattaagtgcctagcttattggctgactcataataaacatctagcagattttggctatttttatgtctcaggcgagtattcttttggttctatcaagttccatgttactgtattgacttttaccctggatttgcccattcagaacagccaccccatcttttctctcaactgggagtgtgtggtcagtttcctgtggaacacagaggctgcctgtcccattcagacaacgacggatacagaccaggtacgtgtgctttcacctggccctcgtgctgagctgcctgctggacatcctcaactcaccccagtgttccagctctgaaccgacccctgccccttctttctgaatcagttactatgttgcattgacaatgggtgtctgcaggtcacccagagttcctctccactccgcagctcccagctcctgggataagaaccaggtccctcagtcttactctctgctcactgtagtttccttccttttgtttcyattcctttgtgccttccatgtggcagtggtatcctggtgggctctggggcttctgcaccaccggcagatgtctgactagtcratacgtcactccacacctaaaccatctcagtgcctgtcccctagagggtagagcccgtatgttttaatgtgaccctatccatagagcacagcctgcaggtgttaatgtgatcctgtctatagggtaaggcctgtgtgtctctcacctgtgcataggccagagcccacaggtgttaatgtgatcctgtctatagggtgaggcttgtgtgtctcaccgtggccctgtgtgtagggcaaagcccacaggtgttaatatgatcctttctatagggtgaggcctgtgtgtctcaccgtggccctgtgcatagtgcagagcccacaggtgttaatgtgccacttgagtctctcagtgcctactggctcctcccgccttctgcccgggtccatgccctccacttgttgagtgcaccctgcagggcatagtagtaagctgctcagtgacgttctctctgacctccccaaggtagtgagttgttttcacagcaccgtgtatatttctttatggtgggacctgtttgccttcccacttcctgttctaagctacactgcagactctggcagcagagascaaggcttttccaaaccaayggccccagcacagggtcctggctttgtaactgctcagtgagggcaggatgccaggcaccctgttcatggacaatgtttctggggctgtggccaccgtctccttccctgcattcagtggacagagggaggcccagggcaaagttaaatatggagaggagaggatatcatttgacagtcacctggtcatacttcccatgattaccttaagggaataattgagacagaaaacagaacatgagatttcttaagatgtttattttctttaagaaactaatttatgagtcttatattycctctccaactttagggagtagcartagtcttcttagggaaatgcagtagccttaacagcttccaggtgagtgtaatttctgagtctgggctcacacttggtatacttcagggtggtgtatttgaagaggctacatgtagggctacatttttgatagggattttgaaagtaaatggagaaacagttttgtcaggtgcatacttgcaggtttctggaggtgctgtatgtatgttatgttcctgtggaattggtttgaatgcgcccctttttccccattttgtttcctgtaggcttgctctataagggatcccaacagtggatttgtgtttaatcttaatccgctaaacagttcgcaaggatataacgtctctggcattgggaagatttttatggtargagcgatatgatgcatttccagtttgctttgaaacagggggagagtgcattattgaagtcacctgcacgtggtgatatgagagaattgcccaggccactgtggtggcagctcttactcagaaggagatgggaaaatccagatttaagggaaagatgaagtaaaaccatttaccaccattctggcacagttcagacgtgaagactgttattcttcaaataataagttgttctctttaaggaaacactttctaaaggtagtgctgaagcctgtactcattgtccattggtctctccttactgtatcttcacaccagagarcataattgacttcatttttacaactataatataataatttttaatggaataacaaatttaagaaatgtagggtaccactttatatttacttrtaattaacatgatttcaatgatacatactttctcataattgaaaatattataacattatgacttctgtgtcttccctctcttatatatggtacattattacatgcagtagatcttacacatttatagatacggggatgtatgaatttaaakgatgtatagatactaaaccttaaaggcagtttatagatactgccctttggacttatgtactaactgtrctaacatgccagaaagtggaaagttggcaagttaactaacaaataagaaatgtttaacctagtgggatttggagttgctagggttcttgtctrtggtgagatacgaggcataaatttgtttgtrtggctcttaccgtctgacctgcagtttaatgtctgcggcacaatgcctgtctgtgggaccatcctgggaaaacctgcttctggctgtgaggcagaaacccaaactgaagagctcaagaattggaagccagcaaggccagtcggaattgagaaaagcctccagctgtccacagagggcttcatcactctgacctacaaagggcctctctctgccaaasgtgagctcagagccatgttgttttgtagctaaaaagggccctggtggctctgtggctggccatgcaccttcctgagtgtaggatgtgcacatcccccgccaccatgggctgtgctgtccaccttgctgcaggagccatcacggtggtcttcctgcgtttgacctcgcagaatacaggggtcccgttatccgtggcttcacttttgtggtatcacatggtccgaaaataataaggtattttgtgagaaagaatgagagaaaccacattcacgtaactgtcattacagatattgttacagttgttctgttttattgttgatctcttgctgtgcstagcttacaaattgagcttcatcctctgtatgtgtgtataggaaacagcatagtatatatagggttctcaatttcaggcattcactgtgggtctcggaacatatccccccgcagataaggggggctgctgtagcctgtattcaacacagcagtcagagtgatgtttctgaaacatcacatcatatcacttcccagctcagagccctcggaggctctgcactgtacctagagtagaagccagtgtccacartacggccatgggacgcccgtgggggctctctgagatgatcaccccctgctgctcttcccgcttggcccgctggcctccctgtttctgatataaacaaagtgcactgtctcccaccctcccctcttgaatctttgtacttgctcctcgctctgcaaccagcacagctgcaggcaggggttttcgtctgcttcattcattccgatacatggtaggaacttagtatttgttcartaagccaacgaattagagttacattgtcttctaatgcttggattggtaaactcgtgggatttaaatattytctggaagagtaggaatgccaggatgttaggcttatggtagaaacctgtcataacataggccgctgttgcagtgtgtaaagctgtcatcacataggccaccattgcagtgagtgtgtaaacctgtcataacacaggccaccgttgcagtgagtgtgtaaacctgtcatcacataggccaccattggagcgagtgtgtaaacctgtcataacacaggccaccgttgcagtgagtgtgtaaacctgtcatcacataggccaccattggagcgagtgtgtaaacctgtcataacacaggccaccgttgcagtgtgtaaacctgttgtaacacagrccactgttgcagtgagtgtgtaaacctgtcataggccactgttgtagcgagtgtgaccactttgttcatgtcgagtccctcgatacacacttggtgccctggtgtcattgctcccaygaacggctgtgaagcttgttgccagtggcagccttgtcctgttgctgcactgtgcttgtgggctgckccatgaayactgttctgtctcttaaaatctgggccttcttgctttacaggtaccgctgatgcttttatcgtccgctttgtttgcaatgatgatgtttactcagggcccctcaaattcctgcatcaagatatcgactctgggcaagggatccgaaacacttactttgagtttgaaaccgcgttggcctgtgttccttcyccagtggactgccaagtcaccggtaaggccgtgcggcctaagaactgagaggccggtcaagagtcagtgtgtgtgtgagtggatatgaaggtgtgtttctgtgtgtatgtatatttgtgtgtgtgtggtgtgtatgcttggttatgcaggcagcgtgacatttctgttatatattctctttgaatgatgcctagagttgtaatgtttttcttgaagagaatctgactatatagttaatggttttaagctatcttttgggatcagatacatcttaagaacagagaagaaaatgcagaggaaacacatttcacatgtactgtcagagcttcttatttgagggtgaaaaaaaaagaaaaagatgttaaactccctaagctgtgccctggaagctgacagtgtatacaggagaccttgacctctgggattgaccctgcctgctctgcaacagtggtacttccttgtcaagggcagtgggggtttggcttttttctttaaagagtctttagggactcactatgttgcccaggctggccttgaactcctggtcctaagtgatcctcctgcctcagcctccaaagtagctgactacaggcgcatgccaccaggcccggctgtgaagggcagttttgagggacagagtgggtgtgktttgtaggcaaagcctctcagcctcccgtggatttccttatcctcacagttaggaatgccaggttcacgcctcctcagggcttatttagggtgaaaggcagttcttgagtgctcacaaggaggcagagttctccagcgtggttttttgttgtgtttcagacctggctggaaatgagtacgacctgactggcctaagcacagtcaggaaaccttggayggctgttgacacctctgtcgatgggagaaagaggactttctatttgagcrtttgcaatcctctcccttacattcctggatgccagggtgagttctccttggtctcttgattggcgtctgttcattttattagagcatttgactcaaggtcatcgccttcctcatgcccaaaccacttattctgttcttccaggcagcgcagtggggtcttgcttagtgtcagaaggcaatagctggaatctgggtgtggtgcagatgagtccccaagccgcggcgaatggatctttgagcatcatgtatgtcaacggtgacaagtgtgggaaccagcgcttctccascaggatcacgtttgagtgtgctcagatatcggtgtgtgttcagaccagcaatgagatgttgtccccgggtgactccatttcccatttcccttgaacctctgaatcttctatcttgtttaaaacttgcctgtgttttcgtggagtttcagccattgctagggtttgacgagaatgcackcatttcttcaggtcttaaatgtttaataaatgttayrtagtttgcacatggaggtcaragattgggtactaactgtggctatcatttatttaatttttttttttttttttttttttgagatggagtcttactctgtcacccaggctggagtgcagtggtgcaatcttggctcactgcaacctccgccccccaggttcaagtgattctcctgcctcagcctcccgagtagctgggattacaggcacctgccaccacgcccagctaacttttgtatttttagtagagacggggtttcaccatcttggccaggctgatcttgaactcctgaacttgtgatccaccygtctcggcctcccaaagtgctgagattacaggtgtgagccaccgtgcccggccccatttgattaattttyaaaataaacaggaaacaaatcaggctgctgatttatattacagggctcaccagcatttcagcttcaggatggttgtgagtacgtgtttatctggagaactgtggaagcctgtcccgttgtcagagtggaaggtaggactgggcctgtccctacaagtcattttaaatgtatagagtagcagacgttctgaacgatgccttagatatgagaccrtgtgataacagccatagctggggtcatgagacacacgctagggggaggataatttcttttccttgagcttttttttttactgaagcatattgctaatttcacgagtgacattttccttgtgtgcctggattgatgggattttggcgtctgatgcttgaagacactawtgtggggtttggttttgtgttgtttgatgaagcaagtctttattcggggacctagactttcctagaaagctgtttgccaggcgatttgtattatatataaacaaaatcatgtggaaatggcttttaatgcccatttatagctggtatttacctaaccaaaaattgtaaaagtttttttttttttttttgagaccgagttttgctctgttgccaggctggagtgtaatggcgccatctcggctcactgcaacctctgcctcttgggttcaagtgattctcctgcctcagcctcctgagtagctgggactacagggtgcctgccaccatgcccagctaatttttgtatttttagtagagacggggtttcaccatgttggccaggatggtctagatctcttgacctagtaatccacccgcctcrgcctcccaaagtgctgggattacaggcrtgagccactgcgcccggccatttgtaaagctttttgcttgaaaatgtgaatgcgtgtgtggttgcagttgcccttcacttcttccatgttcttgaaggggacaactgtgaggtgaaagacccaaggcatggcaacttgtatgacctgaagcccctgggcctcaacgacaccatcgtgagcgctggcgaatacacttattacttccgggtctgtgggaagctttcctcagacgtctgccccacaagtgacaagtccaaggtggtctcctcatgtcaggaaaagcgggaaccgcagggatttcacaaagtggcaggtaccattgtttgtcgttttccttttgttgcaaaggaatggaattaaaatattaaaatattttgctgaagatgaattttcccttragtcagaaacatgagtgttctactgtaaaaaaaaaaaaaagcatattaatgatatttcggattttgcttgattttcttaaacagagtacatactgaaggatgttggtagagcatgtctattttattcttagttagccatgccagttactgactctaaggtcatatttctcttctttattacaacgttgggacacagtgagctagccagtgttggatgttctggggtagtacttgatagcattgagtcacagggaatgcatttagtacgaggtttggctgtagaaattacagggcacgctgttggtcattcatrctgtttcagcagttgggcaagatttaaatacatttaggaacttgtaaaaatgaagtcaaagtagctggtggtgagtacgtggacagccctcaggcacagtggagaaagtgacattcccttaggtgatgaggctraggaatgcctcatgtcatcatacacgggtcagtctgtgaygttgcagcagccttggacaaggggaagcctgattttattcccaaagtgtaatgtgacaggagtgcatggtatggtgctgggaggccagggatactttgtctcacactcttcagggtgtgtggtgtcacatgtcttrggctaagtttgacagcctagggacccgaaccaaaccttgtttaatgttctccttctttacaggtctcctgactcagaagctaacttatgaaaatggcttgttaaaaatgaacttcacggrgggggacacttgccataaggtttatcagcgctccacagccatcttcttctactgtgaccrcggcacccagcgggtgagcatgtaccgacggccctcagcggggtcttctccccaccctcaggctgctgggatcatattagaaagaatctgtcytcagatctcatcaaatctcctggttaactgagtttaaaataaccatttacagaaaatatgttgaaactttcatcagttagtattgattttcatgaacgtaaccattctttactattttcattcttaaaactcaaagtataaactaaagttttgcattctcacttttatatatgtgcctcttaacttttttagccagtatttctaaaggagacttcagattgttcctacttgtttgagtggcgaacgcagtatgcctgcccacctttcgatctgactgaatgttcattcaagtaagtccatggatgtgttgtctcttttggacagactaacttggtatgattttgctttaataattagtggtcttgggtgcaggggattagattagtcagktaatttacctaggactcggtttgctcatattaaaatgaggagtcgggctrgrttaactctcagctccgtcaccacctggagctgctgtggtgactgcatggggaagggattggagctgaagcagagagtgracccctggcactcttgcgtgatccacatgtcagtgagcagagtgggccaggagcggtgtggtgacccctgcgatgaagggaggtcttcgttgcatgtgatcgtccacagagctgctctcaacagctttgccagatcgccctctggacacctggggtcccatccttagagattttggttttgtgggtctgcrgttctgttttttggagggatgccctgtgttctgccgtgtgaaacacccagtatgagccacttgatcactgttgactttcctgggggaaagtgcaggtgattctgtttccttccggcctttgtcctgttgtgtcatcggttatttatgtaggtgaaatcatcatttaagttttaggaacgtatgtaaatgcaagcatttagtaatttatgttcagtgactttaaatcataattttagtaaccttaccttttccagttaacattttgtaaatattttcatgtgaaacaaatttgtttctcatttctactggatgggaaatgtcctcagtagatatccccagttcacttagcagttctctttctgccatgtgaggctgccttcagttttctgatatttatatacaaggaataaaattttgattttctttgcacataaagcatttttcctagagatatgtgtatgtgtgtgtgtgtgtgtgtgtgtgtgtgtgtrtrtrtrtatatrtrtatatatrtatatatatgtattttttttgagatggaatctcgctctgtcacccaggctgaagtgcagtggygtgatcttgtctcactgcaacctcctcctccctggttcaagcaattctcctgtctcagcatccctagtagctgggattacagacaccaccatgcctggctaatttttgtggtgtttttttttttttttttaatgagacagagtcttgcactgtcgcccaggctggagtgcagtggcgtgatctcgactcactgcaacctccgcctcccgggttcaagtgactctcctgcctcagcctcccgagtagctgggattacaggcgcccgccaccacacctggcgaatttttttgtatttttagtagagatggggttccactatgttggccaggctggtctcgaactcttgacctcgtgattcgcccgccttggcctcccaaagtgctgggattacaagtgtgagccactgagccagcctattttttgtatttttagtagagacagggtttcaccatgttggccaggctggtcttgaactgctgactgcaggtcatcctccgtctgccttggcctcccaaagtgctgggattataggtgtgagccactgcgcccggccttcctaaagatatttttatgctaagtttttaaaagtagaattaaatcagaggagaattttataatctcataataaaagttaatatatgtctattgtaattgagagtccaaaaatattaatagatgaaattacccaccctcacctctccctccccaacccctagcttcactccactttttactgtttcttcttgtggttctttttggaaccttctataactctaaacctctgtttgtcagcttctaatggtgtctgttgactctcttttaaaagatgaaagctgtcctcacctgtgctgttctcctctcctctttcctctgccttggctttgttagttctatttctgtttcttctgttgactacttttagagcatttggtgatattcactaagctctgttcttgtcccatcaccttcaggcagctttcccttcctgccacctgcccctggtttgggcactcctcctctcgtgcgtgcagtactgcagctgccactccgaggtctccttgccatgtcccttgtcacacgtttggttagtcccacacagtaattagaatgatcctcttgagatataagtcccaccatgtcgctcttgctgaaaccttcaatgcagtgagcgcccatctcattgggacctacaggctgaagttcttcctctgatggacatgacccccgtgttgtctctaataacctcactttcactctgttccagccacacggggtttctgtctttctcgggtcatgtcgggcttatgtgcctcgggccctttgctcatgctgttctctgcctgggatgcgctttactgggtgccaggatggtcagtgattccatttctctcagagtctattcacaggtccccttctcggtcacgccttctctggctccactgtctaaaatttcaacagctgcctctgccccccgaacttcatatcccccttatctgccttttttccttcagctcttacttccatcaaatacagtatgtatttttaaaagtcttatcttgttcacggtcattttcttccacaggtaattttggtaaactttgtaagattgatgatgtttaatactgttttgtttaatacagtacccccagtttagcacacagcttttgaatgaatgaccagtttttattcccctctgaagcgctaagagctgccgctgaggtggcatctgtagctgctcccgttcctgctccgtggtggcagagtgtgtgtctcactcactgttaatattgctcctggcatggggttggttcccagttactgtctgtatttgggatttgtgtagttagtgaacctttagcctgtgcagaaaggtcagcaagcccattttaatttcagaatttcagtaactgctggcggccttggttttaaacaacaggtggcgtgcggctgccccgggcatggcccctgctgtgtgtgctcctagcatcttggctgcttacctttgtcaccagcaagttccacttctcagtggcctgagcacagacggcacgcactttgcagacttgagtttttctgttaaaatttaaatttttttttaagtgagcctaatagtttcctgaactattatgttcagggaagttatgttgttgctgattctgatggkgkgtgtgtgtgtgtgtgtgtgtgtgtgtgtgtgtgtgtgacagasacagagagaagtcgagtctaaagttctgtcaggcttagactatgcctgaatacttgaacgtttctagacagagtgcccartgtttaaagagaatacgaccaagcctaactaactgcgggttttcttcttttcagagatggggctggcaactccttcgacctctcgtccctgtcaaggtacagtgacaactgggaagccatcactgggacgggggacccggagcactacctcatcaatgtctgcaagtctctggccccrcaggctggcactggtgagagagggcctcctcgtggggtggtgtttgcagtgagtgtatcacaggccagcactggtgagagggggcctcctcgtggggtggtggttgtagtgagtgtatcacaggctggcactggtgagagagggcctcctcgtggggtggtgtttgctgtgagtgtatcacaggccagcactggtgagagaggtcctcctcgtggggtggtggttgtagtgagtgtatcgaaggctggcactggtgagagaggacctcctcatggggtggtggttgcaatgaatgtattgaaagctggcactggtgagagagggcctcctcgtgggatgstgtttgcagtgagtgtattgaaggctggcactggtgagagagggcctcttcatggggtggtggcttgtcatgagtttatcagggaagatcaagtaggatggggattctttggaggcgctttactctctgcagcatggacgtggttcggccgagaaacagcaggacgaagaatgatttaagggtgttaacagttgatccctagtatggcccagggtaaatcagtgctgaggactgctgggaacatgataaccctttctgaacatgaggagatgaagatataatagatagaaataatagccatggtgaggaatccttcttagcaggtagaagatggggggtgtgacgtggagrtcttggtgtgtgcctgcgtatgttgagagttgtatggtcggtccttttgtgatgcagggacagctcactcaaacctgcrgtggttggctgagactggatgtcagctgtacatgggaaaccaagggcacctccagggatcttggtaccactcatggcccctcggaaccctgaagatgaaactcatcccatgttcgtggagtttcatacagccccacctgnatcttgggtggctcacctcaaaggcggtgtggttatttttagctgcagaaggtggttccatcctctgtgtggtttgaggctgtggttccacttccccttgctgcgttgtgctgtgcagacttcgacagtggctgtacccctgtggcatgggactagttcttcacccagggcacatggcacaggcattttagggactgggaaacaggcagaattcttggtagcttcttgaataaagaaggtgcatggacgtaggccatttaaaatgttcctctgtcttamtttgggaatataaccttcatcctatatggggttcagaaagaatttcgactgctayagcctagctattcctctacactcacgcccgcctgccccagtccatctgtgacaaaacagcatgtaagtgagtgagaactaaygtgatgtcattgtcatctgacttatgtgaaagaaatagcaggtattttgaagtgactcttagaaagcgtatgaagttctgcagcgtgtgtgacatttattgcctgatgaagttctgttctagcctggggagtcactaaaggcaactctttcttgtgtctggtgctgcagagccgtgccctccagaagcagccgcgtgtctgctgggtggctccaagcccgtgaacctcggcagggtaagggacggacctcagtggagagatggcataattgtcctgaaatacgttgatggcgacttatgtccagatgggattcggaaaaagtcaaccaccatccgattcacctgcagcgagagccaagtggtaagggactgttcctgcaccttctgctgttgcagctttgggaattgagcccatgtgcagggcggtgagccgcacgtcctcatctgccttgggatgcgagttctagagcctgggatgatgcgcccttaycagaggttgggggaacagcgtcgccgcggcctgcaatctggggaaccctcrtgctgtctggctccttagaagcttgcctggcagttcccgactcagaattggttctcttcagagtttgactcagacccctaaaggctgtggaggagattgttgtttgactacatgcccttttgtcttcacggcggcagcttgggaagcacgagaaggttggctgggcccgggtcacaggtagcrctgccacttcccagccacataacttggttaattactcaggtagtctgccctgctcagccgttcataacatgaggcatacttgtcctgcccattgcagggtttcgagagaagaggtaggaagtgccaggtgtcatttctgacacacgggagatgcacagtcagtgagcatgagtgcctgtgatcagttcttcccttacttgtttggcatgcacgtaagcaggtgtcgactgcatacaggtttttctgtgtgtgagattgtggtgagccccagtgctagcgtgcatgacrarctcggtggctgagttgggcattaactcgggcaagaccagctcgctgggtgtcagggtggctcgccccatgctctccagcggtgggcagcagtggtaggggagcttgggatggggggctccaggagcttcaggcctgccctcttgcctggagcrgcagggaagtttcctcttgggaagattgtgcagaggcttagtccagactcatgagctgctggggcctctgagcattctcctctgtgacctgagaggctcatggccgaggacaaaagggctgccccacatgtggggggcaaaggtgagagggtgtgtggggcccctgtgcccagggcccagaaggctgggagggaagggtgaaggggtgtgtggggttccccatgtccagagcccaggaggctgggagggaaggatgagggtggtgtgtgggggcctctgtgcccmrgacccaggaggctgggagggaaaggtgaagggtgtgtggaggccctgtgccccagacccaggaggctgggagggaagggtgggggtgtgtcgaggcccctgtgcccagggcccrgkaggctgggagggaagggtgggggtgtgtsgaggcccctgtgcccagggcctgggaggctggactgcagcgtggcttatcagggtgcccagcaggaatcatggggtttacctgggaaggaaggtgctgctgaactcatcatgctaactctgcagtggacatgaagcgttttgagatgagcagagtaagccttggctggtgccagtgggaggatgcgtggaatgggctagttctcttggtatatctttttgttttgactgtgataatggattttacctcatttggtttttagaattttatcaatgatttacacattygtgtctccctgtagcccttccagcatcctttgcacgcctgtccccaacccctgtcctgttcctcagcctgagggagcttcctggtcccctaagtgtgttgctgcctgtgggtgtttcacytacctgcaggggaagcccatggtggcagctcaggacacattctgaccctttgcttttcctaatctgcgcctcatcccacaggcacatggagacagaaatgtcacatgctgtggagtttttcagagaagcttccactkgtaagttgaaatcatgatagacatggagtttttgcgtgatcccttcaggacctgtctgtgctttgttgtagaactcyaggcccatgttcatcagcgccgtggaggactgtgagtacacctttgcctggcccacagccacagcctgtcccatgaagagcaacgagcatgatgactgccaggtcaccaacccaagcacaggtgagaggtggtgccagtcgttaaccccagcgcaggtgagagacggtgyccccaccaaacccagctcatcaggggagagacccaaagagaagctatgggcagcaggcgccctgggcagaggtgtcatggtgtgtgggtgtgtttggcctttctctggatgggctgctgtgtgttctcctggctctccttcagtggaggagagmatgctcccacagagaatccatccctcctgtcactctcctggtgtgagaggtgctcctgactggggttactgacagtgtcagtccagcagctctaggctctccagggcaggttagagctagcccctggctgcctttcagcatcagtgtagtggattgccaggagtctctcrcctgcccttgtgctgggcacccagaaaggcacaggcacagtccattggcagcaagaggtgtgctgggcaggctctccccatgcccaccagactcttagtggctgctgtggtatggcccagcagagggtgctgtgagccacgatcttttcagctaaggatgggacatctcatggatcaagggactgacagtctcatgatacagcctggctgttggtggaggatttaggacaggggtcgtggtgagaagtcagaagtcccgatgctgacataatctgtgtgtgagctcgccgatratgagcctcccaagtctcagctccctggagtcactgtgtccccatcttcttccaccctacaggacacctgtttgatctgagctccttaagtggcagggcrggattcacagctgcttacagcgagaaggggttggtttacatgagcatctgtggggagaatgaaaactgccctcctggcgtgggtgagtgctgtggtctctcgtgtgttgtctgactctcccgtcctctggggtygtcctcagtctctttgcatgctaatggcaaaaaggatgagcagagccaggaagctgagacgcttttgtctcctgcagcagtcaccccatgtgggggacayatggtcatgtgatggaatgaacattcaatgtaaaacaatggttaaagccggattggacacttgaagttataagtgttggctatgaaattgatggtcctgacttgcraaagttctcatcagaaaattggccatcgagtctgtgattgtgttttctccgcctttcccttgtggtgcaggggcctgctttggacagaccaggattagcgtgggcaaggccaacaagaggctgagatacgtggaccaggtcctgcagctggtgtacaaggatgggtccccttgtccctccaaatccggcctgagctataagagtgtgatcagtttcgtgtgcaggcctgaggccrggccaaccaataggcccatgctcatctccctggacaagcagacatgcactctcttcttctcctggcacacgccgctggcctgcgagcaagcggtgagttttcagatgggcaygggagaagtgcatgtccagtgcctggctgcacccgggccccttcgtcaggttcacttgcccactagtagatgcccagctgaactgtccactcctgatcaccccaataataaagttgactggaagtgcccagtgctatgtaatgaagcattttgacacctttctactttttttgttgttgttattcagcttttaaattcttatggatgacctagtggtgattaggaaaatttttttgtagactcaaagcagtctttcctacttaacagaccgaatgttccgtgaggaatggaagctctattgttgacttgtctccccttattcatcgcactggtggttatgaggcttatgatgagagtgaggatgatgcctccgataccaaccctgatttctacatcaatatttgtcagccactaaatcccatgcacgsagtgccctgtcctgccggagccgctgtgtgcaaagttcctattgatggtccccccatagtaagtatgacaaatccaagggtggagataatttttgcaagacttttmgtgataacctttgcgttgtttcttgccttcagtggggagttgctcaagcataaaaaaaatggagaaagtaagtgggactgtgtatgttctgggtccgctactggaagattaaaggtttgcacattgaactgttcgctgatgatggtagccagccagtctttgagcatgggaggtaacacgaatatgtgtgtagggactctacttgtcatgagcctcagggttgacccaaatcaagaagtttttaggtgaagtgacaggaaagcacattgccctagcctggtttctttgtgtgaaatgccttgtcttctgtagttaaaacgcttgcgaaatgcaaacagtttctttggcaaggagttataattaagggcaagagtacgtttgctaatasctaaatattttgccttaaaagctttggttttatgcattaaaaaattattttgtagagatgggagtattgctatgtcacccagccaggctggcctcaggctcctggccttaagtgatcctcctgaagttctgggattacaggcatgagccacagtgcctggcttrctagcatgttttaatagaaatttggatctttaaaaattgtctccatgagttatattcatattttgtcaaatccttggtatgttttaatatttgaatgtatctcacaagtcgtctgtatttctgtctgtatcatctattatgctttaaagatggatcctcttgtaacatatctagatgtcctttagaaagatggccattatatgtggcagtgatatggggagatgtcaggagtgtgtaaggagatcggccacagcctgaattagcacagctccagctctgtgtgagatggaggcctggacaagctgagtctccccaggaagctctttggtagcgtcctttctgacagcgcagaccggggatcctcgatygggaatcattgcctggccacccattgtcaaatgttaaaagatgtagaaagttatttaactggagaaggtgtggtgccacrtggtctgaacgtgccccacagtggtgaatgaagagcactgtagctgagaacaaaatcatggggaagctgcttatacacacactcacacccacatgcacacacacgtgcatgcacacacacattcatcacatacacagttcctggccattcacctttatttactttttaaaaataaaaaaagagttttktgttttttttctcataatactcagactggtcttttatttatttgtttattcactcaaaaatatctcttgggcagccgctgtgtgccaggtgctgtgctaagcaatgaaaatgaacagtgaacacctcctgtcccctctcccaaggacatagccagtggttactgctgggccacgtcagtgggcagtccyggggcagcactgggcagtgagggtggcaggtcagcatggaggttccggccttcccctgtcaggtggtgggaggaccgtgtagcatccttagaggtttttcaggttccgggcttccctcatcagctgatgggaggactctgtagtctccttgatgtgactggagagattcctattgcttaggatctttgaaaattgaagatacctagaaatagaaccaaccttagaactaacgttaggatcaaaacgataaccactgacatacggaggttacacagcatctgtcaagccttccaactggagttggtataaacccagtttctttagatgctgctcattctcagaacctatgaggtctggtttttgcaattctgtatcaattcttaaytccactaaccttgggaatggttaatttcctgaaatastgtttgccctcgctctttgtttaggatatcggccgggtagcaggaccaccaatactcaatccaatagcaaatgagatttacttgaattttgaaagcagtactccttgcttagcggacaagcatttcaactacacctcgctcatcgcgtttcactgtaagagaggtgtgagcatggtaagtgtgggcctgtgacgatctagatgctcaactgcgggttagtgagccaaggctagacaaccagaaagtgcgtgtcagrtccaaggatactcttattcaaaatgtctgccttgggtaagatggtacgctagtagtgtgtctgaataatttaaaccactgattgagggctgagtgagctcccccgcagttaacagcatatagaaacttgctgtaatttaaaaacatagaacacaagtatagaaatgacattcagctttgactgctgatgcataaaagtgtcwtaacttttgtttttactttaacaattactgattttattctaactgggaagtcagaaagacatttgggcagctatagtcactcaggacatagcccagaagttaacaagtaacaaaagacccctggaatcagaatagctacaacaaagtggcaccttttacttataatgaggtattgacttccattttatgtgcattaaaaaaagaataccagcttccattataatgagttyggtattggttatagtctttgaggacgttttcttttgatccctgctctgtgagataaattggtagattatggcccctattccacagggactcagagtagctctgcaggggcagagccaggtcccagctactgcacaggggaacagctctttgctccagggacacagcaccacagcctgtcgtctgtgcytctgaaatctctgaagctctgaaaacttggggctcctttgacatgaatggactgaggctatttatggtgtggatttgtcccacctaatgtggatattgatacatctagctgcagaaatattaatatgtttgatcacaggatctgggggtgtgagaattgyctcttaaaatcctaataaagatgttggattccaaggctcatctgacccctaggagttcaggtgatggattagratctgttgggtgtcttgtaattctgataaagacatccttctgatgtttgggcctggagcaggtttgtaaagggactgttagacatrggtgtgctgacagtgacagaaagtgacctggcagccgcctgaccagtgagagagacagtatttgagaaggaggaggaaacagtcctgctgtttggggctactccacaggggcccagagcacctcaaagcccttggatgtgttcatgaatcttagagtgtagtgacagtcctagttagtaaggaaaggcagagctgtattcagtccayccattgcatctgtttataagcgtattggcatatttttataggggtgtctgggtgtgcctctgtagatgcacacagcatggggcaacgtggattttgccttgcggggggcttctgcattaagttcttcgttctttaaaggacagtcttcacttctaagacccacctcatcatgagtgatgctttgttatctacaccaccagctaaagagtgtggaactatgccttgctttkactctgctgccaacgtgacaaatcgaattagctaatgtgattttagttaattctcagcagctgcacattgagggtgattagtgtttacttgattttagaaatgaagcatcttatgctgaatgtgtgttctagcgttccagaaagatttttagaagatttttcttccccagcagttttcattttcaatggaagtacttttaccactgaatcatagggaaaaagatgcttaacattaattacaaatggaattcctgagagctrcctcatctttttttgttgctgttgaatgagggagggaataaataaagtgattctacaatacttggcctatggaatatctggccatgtggcatcttgccccttgaataaatgtctcccgtgtctagagacagtagattggagcacttgtgaggcagggtctcagtttcacagacctctctcatgacatataagccctccccctttcttcctttgaaccygtagcacagaacattgaggctttctctctaagtagaagacaagacctggattcagccagggagctcacaggatgtgtagggggcaagggcagggtgatgtctgtgccttgaagatggcattgggtctttcagctgctgttgtctagcatcccttccctctgagaggccgctgtgggttatgcacagcccctgtagggacgtggtgtgtcactgctatctatccctatgccatggggtttttaagacccgtgctcttcctggcaacagggaacgcctaagctgttaaggaccagcgagtgcgactttgtgttcgaatgggagactcctgtcgtctgtcctgatgaagtgaggatggatggctgtaccctgacagatgagcagctcctctacagcttcaacttgtccagcctttccacgagcacctttaaggtaatgcgttcaccctgggcgttgctggtgcaggtgtaccaggtgccaggtgctgtgaggctgctgggagtgttttggataatgtggtacctgtgagctgagagggtgtatgtggccactgggcagcatcttggtgctctcgtagggcatgccaggtctcaggaaggttcytggattgcgtggccaactcagcgcagctgacacttgcgttgtacctcatggctctgcacttaacgctttttgatgataagtaacctcatgaggcgggtagtgggaccctttgtatcagacagagggcaggtggggcagcccggagacatgaatgtaaggtatccatggggrcagggccagctcctgggtggctgaaatctacagggatttaattcctccaacctggttgaagatgatcaaggcmgttgtttgctgattgtggcagctttgggaagagggaggtaggaggtgccctggaattgagaggcactygggcatgtgcctccatgccatgccagagccctggcgtgtgctgattctttgggctgctggtcttactgatgtggtgtcgtggtcactggtgcctgggggcccctgactccctaagcctagatatctagatgttaccatgccagtgcctggactggggtacggaaccccagcacctgctgtggcacggcggctggtgagtgatgagcctggagttttgggcccaggtgtcaacaccctggctcctgtgatggagccctctgcctgggtacaggtcctcccgacaggtgtgcagtaggtgtgagccttctgggcgctgggtgggccaggagagtcaggtccatgcttcagcgtgcagcgtcrgctctgctcattcactcacttggcccgcacaatgtcttattacacaggtgagggaggtggggtgaccccactgctgggtcccttctcactgggctctgactggagacgacagccagagcagtggctggctggcaggggtggccgaggcccccagsagggagcaggaggagcaagcaagctgggcctaggggttgggggaggccccccagggaaagcctagggccaaggcgattgcgtggctctgatgcacacagaggagtctttgctcttcctcatgaacctgcctccagcatcagctgcartagtggttctctcttcactttgagacctgggtgctgccactctgctgacggccacgcatggtttttgtccaggtgactcgcgactcgcrcacctacagcgttggggtgtgcacctttgcagtcgggccagaacaaggaggctgtaaggacggaggagtctgtctgctctcagrcaccaagggggcatcctttggacggctgcaatcaatgaaactggattacaggcaccaggatgaagcggtcgttttaagttacgtgaatggtgatcgttgycctccaggtaaatatttgcaatgaggtaaataaacttcaagctcatagtaaactagaaattagacatagcagcagaaagaagctgcggagtggagctccacggtcctatgagtgctgtaaccttgggcgtgaatgtgagctgttsctctgtacacccccggtgtgaatgctggtgtgtgaatcacgctgtgttctctcagttgcctggtgagttttggcaggtgaatgccggttgtcacgtaggtgctttaggatgggcagcttccttagggactgctgctgcattctgaggtgattgtgcctggcgaggcacagctgccacactgataatgttcttcttctttccagaaaccgatgacggcgtcccctgtgtcttccccttcatrttcaatgggaagagctacgaggagtgcatcatagagagcagggcgaagctgtggtgtagcacaactgcggactacgacagagaccacgagtggggcttctgcagacactgtgagtaggacggctccgcgtccccacatggcctggggccttgatactgtcaaggctcgattcacactgagacctttgtggwtgccccagtcagtggcaggaattctcttgcataaaatattttcttactcgggctgtttcccacagagaaacgtttgaattgctctgtgggattgctgggtaaccgtatctacagaccgtggtagagctgccgtgagatgctgtgctgggtggctggctaggcccactcactagctggagggccttgtgtccacataccaggttttagccctggtggttcagattatgcctcaggaaaatgaatgtctgctatgggtcttcaggattctgaagctagtgaggattccggtaaaccaggcgactcatttattgactttcygccatgtggcagcccaggtggggatggaggtttcttggtgagccacactcagtgccttgcccctgcggtgctcaggaagtttcatgagaggagccaactgctgtgacttgtgtctacggaccgtgagatgagggaaatgcatgaaaaattactaatttttggccaggcgcggtggctcacgcctgtaatcccagcactttgggaggctgaggcgggtggatcacgaggtcaggagattgagaccatcctggctagcatggtgaaaccccgtctctactaaaaatacaaaaaaaaaaaaaaattagctgggcgtggtggcgggcgcctgtagtcccagctactggggaggctgaggcaggaggatggtgtgtacccgggaggcggagcttgcagtgagccgagatcatgccacttcactccagcctgggtgacagagtgagactyggtctcaaaaaaaaaaaaaagaaaaattactaattttcataaatgtccagtatcgggggaaccagcccccgatttttcaacgtaggttcttttctatttccctaagtgttggccggtctgagaaataaggggaaagagtacaaaagagagaaattttaaagctggtgtccgggggagacattacatgttggcaggttctgtgatgcccccgagccgcaaaaccagcaagtttttattagcaattttcaaaggggagggagtgtacgaatagggtgtgggtcatggagatcacatgcttcaaggatgacwagaggtcacaaggcagaaggtcagggcaggatcacaaggtcagcgcgaaactagaatcactaaataacttccatgtcccactgtgcacrcattgtgagggttcaagagcagagaaccggtttaactagaattcgccaggctggaatttccaaatcctagcaagcctgggggcgctgcaggaggccagggcgtgtttcatcccttatctgcaactgcataaggcagacacccctagagtggccatttaagaggcgcccctgccttccycccgggaatgcattcttttcccagggctgttaattmttaaaattccttactggggaaagaattcagcgatatttctcttacccgttttcggtaataagagaaatatggctctgtcctcaccggcccacagtcagccagactttaaggttatctcacttgttccttgaaaatcactgttatcctgttcttaaggtgcccagatttcatattgttcaaacacacatgctttacgaacaatttgtgcagttaatgcaatcatcacagggtcctgaggcgacatacatcctcagcttacgaagatgatgggattaagagattaaagtaaagacaggcataggaaattataatattgattggggaagtgataaatgtccatgaaatcttcacaatgtatattcttctgtcacggcttcagcaggtccctccgttcatggtccctgacttcccgcaatagtccagggaccaaaatgggatgtattaaggaaccaaacgtgttaaatttacgaaggattgctatagctttgttttgaggcttattttgacaaaacgttattccctattttctgaatcacactcctgttttcaagtacttgtaggtattacattattatcttaaattttttttttttttgagatggagttttgctcttgttgcccaggctagagtgcagtggtgcagtcttggctcactgcaagctccaccttctggtttcaagtgatactcctgcctcagcctcccaagtagctgggattacaggggcccgccacctcacccagctaatttttttgtatttttggtagagatgggatttcaccatgttggtcaggctggtctccaactgctgacctcatgatccgcccacctcggcctcccagagtgctgggattacaggcrwgagccaccgcgcccagctatcttattttttttygtgatcattagtagattggtcaaatattgaatacccgtgtgaggaatcacctagggctgtggggttattaagaagtacgatgaaaggctgtgtgccaaggagctgggtctatttggagtcaggatacacatgagtgaatcaacatgagatgtggccagggcagcacgtggtgtgttgccagatggcggatggagtctgcaggtgctcctgaggcagcatggggaaggcgtgcaggaacgtgccctggtgcaggccttggtctgacattctcccgcctctgctcccctgaaggggtggcctgcccctccacacttgtgggtatttctagtcgggtgggatgagagactgagaaaagaaataagacacagagacaaagtatagagaaacaacagtgggcccaggggaccggcactcagcacaccaaggacctgcaccggcatcggcctctgagttccctcagtttttattgattattattttcattattttagcaaaaaaggaatgtagtaggagagcagggtgatgataaggagaaggtcaacaaaaaacatgtgagcaaaagaatctatatcataattaagtttaagggatggtactatgcctggacatgcacataggccaaatttatgtttctccccacccaaacatctcagcggagtaaagaataacaaggcagcattactgcaaacgtgtctcgcctcccgccacagggcagcttttctcctatctcagagttgaacaaatgtacaatcgggttttataccgagacattcagttcccaggggcaagcaggagaaagtggccttcctccatctcacctgcaagaggctttcctcttttactaatccacctcagcacagaccctttacgggtgtcaggctgggggacagtcaggtctttctcatcccacgaggccatatttcagactatcacatggggagaaaccttggacaataccsagctttccagggcagaggtccctgcggccttccgcagtgcattgtgcccctggtttattgagactagagaatggcaatgacttttaccgagtatactgcttataaacattttgttaacaaggcacgtccttcacagccctagatcccttaaaccttaattttatacaayacatatttttgtgagctccaagttgggtcaaagtggctggggcagagtggctggggcaaagctacaaattaacaacatctcagcaaagcaattgtttaaagtacagggctttttcaaaatggagtctcttatgtcttccctttctgcatagacacagtgacagtctgatctctctctcttttccctacactcccyagcaaacagctaccggacatccagcatcatatttaagtgtgatgaagatgaggacattgggaggccacaagtcttcagtgaagtgcgtgggtgtgatgtgacatttgagtggaaaacaaaagttgtctgccctccaaagaagttggagtgcaaattcgtccagaaacacaaaacctacgacctgcggctgctctcctctctcaccgggtcctggtccctsgtccacaacggagtctcgtgagtgccttcccagtccacccgcggcgccacacyctcagcatgtgaacttcagactgcttgacratggttggctcttttgggttctcaagatgsgaatrctatrcccatgtgaggctgatggtggttgagttgtgactgttcctggaagcagcccgcagtgtcaatcctggcacagagggtggttctgaggtcagagtgggggcaggagctttggtgactggaaacggagcctctggagctggaagaacctgggcggactgagttaggctgggtttgatttgcgtttgtgtgtagctcaggttgtgggaggcrtgtgggttttctcgggtctttggcaggagctccttaggctttgctggctggggtcagcccatggtcctgaccactctgcgtggggagcgcccgcttggccaggtgctcctgcaagacatcaccgaggagcaggggcatggactcacagggtttaagtggttctaagtgaggtgggaaacttgccgagattctagccactgcctctcccagccccggagcccttctttctactgtaccacgctgtgtccagggtggccgcaggtgtggacattccactccgcgtgtgtctggttggtgagctcccttcttcagtgaagacttcttttgccctttttttttttaattggaaaagctattttagtgctacattcagtgatggaatggagcccttagttatcagaacctttctctgaaagtaaagtgaagagccctcctgtgtcagggcagagacgtcacttgcatgccttttacctgcccctttgtgtcgttttctaggtactatataaatctgtgccagaaaatatataaagggcccctgggctgctctgaaagggccagcatttgcagaaggaccacaactggtgacgtccaggtcctgggactcgttcacacgcagaagctgggtgtcataggtaaggcctgtgggtcctggtccttggttcaaggagcagcatctgaaccgggaaggtgagggtgttctcaggatggcaaggagagtgagcatgtgctttggtggaaacctccagatatgattgcctgtcactgtctcacaggcattttggctctcctggcacattaaaataagtgctgctttgtattatatgagactgcaggtcctagtctgtgtgtttagaggggttgggctatctcggggaagtgcgtctatccaggaggaagtctcagaatgttcagagttcctctgaagttcacrttctagctgtagatcaagtgcctaaattggcataaacacacgtgtttgyttaggaaagccaaacagttgcatgaggacttggtacaggtagttcagaggtacatctttgtaaaatgtcttaacaatttttcacgggaaattgatcttgtacttggttgctgagtgaaagttgttttctttcattatttaaaggaggaaaatagaggtttcttagtaagagcaattaggatttgttggagggaccagtaaaggaaaatattcacctttgcctcttaggctggagtggggtttcycgagttgtcctgattcagccacagggctacttcagattagcttgagatgttgagatggagaaagagaattccgagaaaactactgccacccttgataaaaatcacacacagactctgcaggttggtaggtggagggagagctgccatacaggaagtggcgcccagaccgccagcctgagacccgccctccctgggaggttcttactgctttagaggtcagttattgctgccactcccacactgccccagaagggggaaggagggaaggtcgtggagggttgctttttcccctgtaatcttgcagtatatatggatattcgactagtctttccccaacttcagccaactgaaatgactaaaacacttaaggcttcctaaaagtttgaggcaggaggagcaaaagagagtagtgaacacagggggtgacatggaactagatcatctgacttcttagcggtgacctgcaggccacctccatttggagagcaccattttgcaagtccagcctcgcctggcgggaagagctcatgctttctcctgggrctggcatttggcatcctgagcacctgctgaccggaacgagaaataatctggtgtctgacaccaaatgagctcttaatctttggcgccaacaagacagcatctaaggacaaccacggtgcccccattgtccgcttagggaatggacccctgttggggtgggaggtagactttttgttttcrgaaccaacatgtctcaagcagctgtgcttaatatatgtttaatccccatccactccatggggcagcgttgtcatccgtttcacaggctgggcccctgagccgaggaggttgagcctcctgcccaatcagtaagggctgtctacactattaaagttttttcttgtttgatcccatatgccagaagttttaaaaattttccgtaaaacagtggaattcttttttccaaaattttacacagaagcccaatatttaaaacaaattcagctggagcagctttgagtttggggcaggcctgagagcctagagtcccacctcccacctcaccatccagcagccctcagtacctcagcctgtgtcctgtggaaaacactcgggaagtgagcactgtgcccatgttgcctccaccgcrtgcccctgcctggaaggatctgtgtgtgtgtggtcagggtggaaggcacctgcttcccctggacaccctgcgccatgccctggagacatcatctgtccatgcagccaggctgggcccagaccgttcccagaacagccccctgcgcagccacaagcagcctcttggtggtggcttgagagttggaacctggcggccatgctgccccagtgatacctgcagcttaaarcatgtactcacttttctctcagaccctgcgggttcgagggctcaggtttttcttttaaygggtcacttttaaaagcagacagtgctcgactgaaagctagaagaccctagaaaaccacagttggtttctgtttctggcttttcactttttccattctgtgctctgttattactgggaggctcacatgagggtacctgtcaggaaagcacctaatatgatagagagagtttrcacaattggagcgataatgaaggctgccattacccggggtcccactgttcacatgagtttgttgggcactttctatacatgcccgaaacctgcccactttggacagtgccctgttctgcaggtaaggccctcaaggctcagaagctcagcaacccagggccacaaagtacgggagtaggagggtttgggtttgaccccaggtcttaggctgtgacaattgtgcagtgggccaggtgaccacccctgagtgtgggaatgcaagaacaggtcgataaayctttaggragcccaaaatttattttcttctggcctttaaaccagatttttactcctaacattgaagctttgtttgtttgttttttgtttttgtttttgagatggagttttgctcttgttgcccaggctggagtgcaatggcgccatctcgatcttggctcactgcaacttctgcctcycgggttcaagcaattctcctgcctcagcctcctgagtagctgggattacaggcacctgccaccgtgcccgaataatttttgtatttttagtagagacggggtttcaccatgttggtcaggctggtctctaactcctgacctcaagtgatctgccctctttggtttcccaaagtgttggaattgacaggtgtgagccactgcgcctgcctgaggctttttataatgcactagaaataatgtcagttcaatcatttgtgtgtttcaggtgacaaagttgttgtcacgtactccaaaggttatccgtgtggtggaaataagaccgcatcctccgtgatagaattgacctgtacaaagacggtgggcagacctgcattcaagaggtcaggagactgggggctcagagcgggactgtgcagtgagcatactggagggaattcctccttggggttttcatgggcaggttttggctgagtcttaggagctcagggccagagccgctgattgtgctgtattgggcggggctgctccaggcagggaagacctccagatacagtgctgagacactgttacaagaccagtgcaacttctctgggctagcttgtctcttgaactaggtttagcactggctgagcagtacttaactgacctctacctttgaatgtcatagtagaaacaaaggggcgtggatttgtcccacccgaggtgttcaagcagcctggctgggaccctcgagcagctgggacctgcatctggacctgggatgtgcttggattatattcaagttttcccggccacattgcatctggtgccagggagagcttggccaacagagggtgcatgtgagctgctgtttgtgaacagaactgattccttccagacgctgagtttggaaaaggggtgactcagaaattgccaaaggatttatgaatgtatgagtctgagaagcttaaacaaaaatctaaaaatctaggagcaaattttccaggttttgaaygttgcacggtttacaaattttaaaaaatttatattgaatgcttgcctgctttgtcacattactgatgtgtgcaccacagtcatcttccctgtccattgtggtgatgaaaagaagygagtaaaataaccaccctcgctccgagctgccgtcagtgttgagtcgggaaattctgcctaggcctgcgcagcccggggagtgggggcctcgggacccaactgaagtctcgcagcaccttgactgaaagccagtgagctgcttcaagggctccgcagtgttcattgttttgcagtcttcccttatgtctggctggggaagtgactgtagcctgtgcttccctcctcctaggtttgatatcgacagctgcacttactacttcagctgggactcccgggctgcctgcgccgtgaagcctcaggaggtgcagatggtgaatgggaccatcaccaaccctataaatggcaagagcttcagcctcggagatatttattttaagtaagtaaaaygttttccttctgagctgtgaaatgtgttcaaaattaaaccagcaatgccgctctttccctatyggggagcactgcaggataaataggtctgtgttttagttactgttgctggagtcatcgtcatcttttgcttaaactgaggaaaagcgttactcaatcattaagttttaacaccaaagatggtgaattctcatgagtgtaaaaataaatcccccgtccttctccctctcttcatgataatctcaggggttgaagccgaagccttctgacatgtttgagcaggaatcttctgggcttaccagtgtttagaaaataagtttctcagcagtgttactggggctgctcttgggggtggtggccgaggtgcacagacagggcgagggccgtgtggtgctggatacggcacctgaggaaggtggattagcactcagaggccagaactggttggggagaaagcctcttgagagggaaactggtgtcctcagaattgctgtggggtcacagacgtgctgcyctagcgtgtccgtscttcctttccctaggaaaggaagcatcctggggccctgcagtgattctgaggactgagggtttatgtcatgaatgccttcttgaaggacttccatgtcactgtgatcttttctgtctcttcaggctgttcagagcctctggggacatgaggaccaatggggacaactacctgtatgagatccaactttcctccatcacaagctccagaaacccggcgtgctctggagccaacatatgccaggtgaagcccaacgatcagcacttcagtcggaaagttggaacctctgacaagaccaagtactaccttcaaggtaatccgtggcttcccacaaagttccacatttaacttcctccaaggaaggggattaaaattttcaactaactcccttcagttgaaatctcggaccacttttaaaacaaaaacywtggtctaattcttkactttgttatgaatttcttgacagtggattgagcgatacgtgtcagaactaagcatttcactgtaggcaaattgtgtcttagttatcaartaaatgtacaaaaaaactaaaacctggtctgatccagtggttctgaggttgggtggaggctgagctgtgcacagtcagaattgcctttgatttggttttaaccatgacacttccttattttggaatgccaaataatattagagaagggtaagagattttatatttgtaagaaggatgaaaggaaactggcctaaatgttaggatgtaggttaaaatcaaccaggacgcacatagggcagagtccagggtgtgaaggaaggttttaaactggcactaataagggtgttgccctttgttccctcacataatcgtgaaaggctgcttttgttttgaacagctagtcttaactatatacctttcataatttgatttttgaaccgtgtgtggatgtaataactctttaaaaaaaaatgaagtgtgtttaaagaaaaccccagcctgctctgatgtcaaagagctgccgatcatgtcctctgggaggggagagtagtgatagctgagaaggagcaggtgctctgtgccctggtgctgagcacattgccgagaaggagcaggtgctccgtgccctggtgctgagctcatcgccgagaaggagcaggtgctccgtgccctggtgctgagcgcatcgccgagaaggagcgggtgctctgtgccctggtgctgagcgcatcgctgagaaggagcgggtgctctgtgccctggtgctgagcgcatcgctgagaaggagcgggtgctctgtgccctggtgcggctgagaaggagcgggtgctccgtgccctggtgctgagcacatcgccgagaaggagcaggtgctccgtgccctggtgctgagcacatcgccgagaaggagcaggtgctccgtgccctggtgctgagcgcatcgccgagaaggagcaggtgctccgtgccctggtgctgagcgcatcgccgagaaggagcaggtgctccgtgccctggtgctgagcgcatcgccgagaaggagcaggtgctccgtgccctggtgctgagcgcatcgccgagaaggagcaggtgctcygtgccctggtgctgagcgcatcgccgagaaggagcaggtgctccgtgccctggtgctgagtgcatctccacgacggcagcacctgatggagggaagctgggtcagcatcgctgctcctggtcacagattgtagacagcgccctggtgcatctgctcatagcacctgtggcccctgaatagaactgggaaagtgaatgttctgctttctgggtgagttgatgatgggaaagttgatcagcctcattcacttgcataactccacagcacggagctagcactctgtgtttctctgttctctgccttcctcacacttcggtgaatccttcagtcattcagaatcagatgttgcatgtcacargttgtgccttctcttgctgtcctctttcccagtgctcggtaaatcttgattaaaggaaggaaggaaggattgtttcagaagccttcagggrccctatcatgcagagaaggaaagtctaggctctctctgacacagcttgaagatgtctgagaggctcccatgtaccagggtagccttgcaagctgctgctcctacacatgcctcagccatcaggttattcactagttcccaaagtcaccctgtaacctrgtgggtttacatatgctgctcttggtgctggaatgccttggcccaccttcctcatccttccaaacctacttctagtgcccctcctgggaaggcccaccttctcatagcagggtgacaccgctggtgtgtctgcaggattccaaacctacctccagtgcccctcctgggaaggcccaccttctcatagcagggtgacaccgctggtgtgtctgcaggattccaaacctacctccagtgcccctcctgggaaggcccaccttctcatagcagggtgacaccgctggtstgtctgcaggattccaaacctacctccagtgcccctcctgggaaggcccaccttctcatagcaggtgatactgctggtgtgtctgcaggagtcttcacgctccatcgcgcagcactggccacttgtctsgttacacataagacctccacgttcacaagtggtatgtctagcagacctttgaggatccccagctttcagagtgcttgtgcatgcgcatttagtcattcttggtaaataaaatccctttcagaccttttcactttcttcattcaccagccccaggaagtagctttagttttaagacatcttttcatctttcatgaagaaatgaagtttctatctcttcctgaggcttgccawtccttcgggagggcagagctgtctctcatcaggacgtggagctgctgggcggtttgcttccccacatcagccctgtggaacagtccattcagcagcccctgcttcagctactcccaagcgagaatgtggggccctcccggagcggagccrcaccgcctgtctctgggccccatctgtgtgtggacatgtccgtctcctaccctgcactctcgcctctgcattcctggcacccagcagcaccagccacaaagattttcagccagtgacaaaggttgggagcagcagagttcatgcaaggagtccacacaagggttcctcacttctgacagcaacagcacactgaaggggttcccaagccaacttcagatttaccctttcaccataactcacagagctccctggaagcagttacacttatagttatgatttactgcagcaaaaagatacaggttaaaatcaaccaagatgcacacagggcagagtccaggagggaattgaatgcagagttcccaccagctctcccgtggaatcagatgtgttgtgttcccagcacccacgtgtggcagtgcacatggagtatcatcagccggaggtgcttccccragccttggtgtccagagtttttcccggggctctgacatgggcaggattggtccattgatcactcaggtactgcatggccagcccctgctccgtatcctgtcattagccaaggagcaaggccagccctctttttgggcaaggttaaattcttgccttccctcttgttgccgttgcttctgttcctggaggagctcctggcacagtgatggggtctcaggcctccaccttactgcacgatgaagagtttgaggagatcaagaaggagactggcttttcccacagtcaaatcacacgyctgtacagccggttcagcarcctggacaaaggagagaacaggacgatttccaggggattccagaacttgccatcaacccagtgggggactggatcatcaatgccttccttccagagggagaggaccaggtaaacttccgtggattcctgcaaactctggctcatttccaaaccattgaggataatgaaaagagcaaagttgtgaatggacctgaaccactcaacagccgaagcaacaaactgcagtttgcttttcgactatatgatttggataaagataacaagatctctcgtgatgagctgttaagggtgctgtgcatgatggtccaaataaatatctcagataagcagctgggcagtatcgcagacaggaccattcaggaggctgatcagcatggggacagtgccatatctttatcacagactttgctaaggttttggagaaggtggatgtagaacagaaaatgagcatctgatttcttcactaaaggacagacagcaaactattccttgcagtctagtatttaagtactggaacttgacagtcctcctgtccaccagccctacctccaccccatcattccccttctcccaaagtactactgctgttgcataacaaccccaaatatgttctgtcaacacaaacctgcttttggtctataaacagggcgttacagaatggtacacccagtctatttcttctcagtatccattcgccagttcttcatttataaatatcgtcttcctctgttctgctgctgaatgccacacatccatccagtctgagaaagtaagatagggaatcctgccgaggaacaagccagcaaagctctttcactggatgtagactgcacctgctgccttccctctggcgagtctgccagcatgcttctccatcctttttatatgtcctttgcttcccacttctgtgtacattcaacatactgttcacgtagtcatgcagtctttctgctttttgtgaagcctcagaatctcctctgttctacttggcaccccaagctatgcctggtattgtatttctgacttggctcgatagttcggtggtctggcagtttttatctaccttcattattaaaaggccctctggagctgggcgtggtggctcacgcctgtaatcccagcactgtgggaggctgaggtgggcagatcacgaggtcaggagatcgagaccatcctggctaacacggtgaaaccccgtctttactaaaaatacaaaaaattagccgggcgtggtggcgggtgcctgtagtcccagctactcgggaggctgaggcaggagaatggcgtgaacctgggaggcagagcttgcagtgagccaagatcgtgccactacactccagcctgggcgacagagcgagactccatctcaaaaaaaaaaaaaaaaaaaggccctctgggatgttgcctctccaggagctttttggtaaccaacacttctctcgggagtatgagatcatcctctgcactcttctctgtcatcaaagggctgctgggtggagatattcttgaaaggtggccttggtgagaggtgtggagtcaagtcttttaggttgcttgcccacgtcactctacctctggcctctgattctcaactttgtacctatggggcgtctcttgttagtgcagtgttgactattcaaaaagtagcaatatgcctgcagatttgcttagtcttgggacacggttaccaccagaacggctgctcagacaatatgcttggggactttctcatggctttttgaacaaggaggctgcgcaccctgtgaagcctcctgcattcacacctctgctgcatggtttatgcctcagtgttatgtgcactggaatgcttttcactatacgtttccaagttagaaagattagtgttatggaagtgcctaatgtatcctagtccaaaatatttaaagattgttctctgtgtcttgaagttttgcacaaaattctttatgaattttacacttggcaaatgttaatgctagaagccatagtccgcttcttatacaagtccaaagcgttgactgttgtatcattagctccctggttacactggtttcccagctccttgtgtagaccactgctaatcccttagaaacaagaggtctggcactagtagcacaacctaaggtggcattccaagtctttaagcaagtcacagcaacttttctgccaaagtcagcttagtttagacttcagtgaatcaggctgttgccatcctaatgtatgtctctgtgagtctgttcattcacatatctgccgttggctgactttcttgactcgctgcttgcttgcttgtttccttgctttggaaagctattgaagatgtgtacataattctttaggaaggggattgctaaaaaatacactgcaaagcgatggaaaacagtggagaacaggggagtagccaggctggatggctcaaatataaatgaatgaggaattctttatgaagtgtcagttggactttgtgattgagtgatgtaatacaggaattatatagaaagggaagaatatctgatactgatctgttagatacttcagaggctccttgatttgcatatttaaagttcctaaaattgtagcttttcccttcttttggctgtacagcagactgttttaatccacggttgtgccttattgttccattaaaattgtgtcttcagtccatcaataaatactcgtggttaaaacaaaacaaaaattctttactgcatgctgactaagggcagggctctatccatgtgcatcgagtggcctcgtaagctgtgaacagagtgcctgtgggaygtgggatgaagtctcttctgcctgattttaagtctttgcaaactttttagaccgtaaggagctaagctcagtctgctcgtgaaaaatgatggtgacatgccatgtgtgcccttcccgtttgacagayggcgatctygatgtcgtgtttgcctcttcctctaagtgcggaaaggataagaccaagtctgtttcttccaccatcttcttccactgtgaccctctggtggaggacgggatccccgagttcagtcacgagactgccgactgccagtacctcttctcttggtacacctcagccgtgtgtcctctggggtgagtatgacatccggaagcttagcacttgtaccccacatcttcccttaagaataagtgtatgtgtgttttttccccaatgttttcttgtgaaatattcagaacatgcaccaaaaaatagagaaaatgatagaagcggaccccacatagtcagtgccccgctccgttgcttgtcagcatcctgccrctgatttttggtccatggctgcgtcacctcccaccacccccagyagcagtgccattgtttcctttgtgtgtaccatgccccgaatagggtccagtcagggcaccccagctctgtccctctacccygttcccattkctgcctccctctccttagctcctgggaggcaagtactggtggtgcctcctctgtgtaatcctggaacatcttttgtgtcgtaatacaaatgattgtttggtaaagtttcactttgatttgagtgcagtatttttactttgatttgagtgcagtatttttacgtttgtttgaatgaatgaaaagcttactctccagattttgagaatcagcatgagaacagagggagcagtttctgctctgaaggaaggtggcacctccattggttgtcttgtgtcccacagccgttttatactttgccacgaataacatgttgtcagttgctttcctcttggatttattttcttcttaygttacccccacccatcattgkatttatatttatttttaytttttatttttttgggatggactcttgctctgtcactcaggctggagtgcagtggtgcggtcttggctcgttgcaacctctgcctcctggttcagacgattctcctgcctcagcctcccaagtagctgggattgcaggcatgtgtcattatgccctgcyaatttttgtatttttggtagagatggggtttcaccatgttgaccaggctggtcttgaactcctcacctcagataatctgcctgccttggcctcccaaagtgctggcattacaagcgtgagctgccatgcccggcctggcccaccattttacataagcttttcattctctgtcctgagactttaagattgggggaacatgaattcttgccatgtaattgtttccttcatgtcctgaaaaagggaccgtagagtcagcagacgacagtggtgggggtcatgggggaatgaagatcacacattttacatcttaaatcagcactccccctgcccacccttaacagtggacatgagctcagcaaaaaccagctttgtcctgtgctgttcaggcctgtgtacttagggatcctcagctgcacagtcagggaaagaggcttttggttgaaatttcacttgtggtattttcagcttttgaatgtttatggtgttccggtgacgtcattacaaaatgaaaggattgaaactggaagttcttcctgaaagaagcaaaatgtgaatttttataaaagataaaacccagaagtgaactttccctgcattctctgtcatggagaggctacagctgccatgagatgaatcctgcctcctgacatggcagctggtcttctgtgtgggtttgagggaccaggccaggctaggatcccgtccatgttgaatgtttagagttcgacttctgtgagtaggaaaagcacygtttatagggctttggtgtttgactctaaaaccagagaggaagattctccaggaaacctcggtttcatgatgttcagaacatcaggattgggagctgtttaaatcccttaacacactgacaaggtaataaggactttaaaaaaaagaaacagaagttgaaaccaagagcaaaaactcagatggtggattttgagggatgcagktaccacccgggggtgacgtggaatagtgcctgagatttttttttccccaaatgttatcagtgttgtacattgtagaatcatgtaaatatggccagacgcggtggctcacgcttgtaatcccaacattttgggaggctaaggtgggcggatcacttgaggtcaggagttctagaccagcctgggcaacatggtgaaaccccgtctctactaaaaatacaaaaattagccaggtgtggtggtgcacacctgtaatcgcagctactcagaaggctgaggcaggagaattgcttgaacctggaaggtggaggttgcagtgagccgagatggcgtcactgtactgcagcctgggtgacagagcgagactagatctcaggaaaaaaaatcatgtaactataacaaacaggtagcaatgttcgccctaatagattaccatttttagttcttttagctatttcttctggaatttacctcagtattttaaattaacatcctatatctcatctgttgacttcctgcaatagtagatgaagatagagctgtcttacaccttcctcctactttacaaaaatggttctttcacaatatttgattaaagtcaaaaaatttacacaaagctaaaagacaggcatctacagatggaaggggcaggctatgtgcccagcacagttattgatgacaagacccacccacttatgaaataccaggagagcagatacaaagaaaagactgtaaaagctttaggggaggctaatttgttgtattagaaaataattcaagaaaggttaaaatactttaaatcctcactttatatcatcgataggttcttggaaactgcaactttatgtgaaatgatgtataatgaaaccagttttttttcctcagctttatgttatgttatgttatgttatgttatgttatgttatgttatgttadttttttgagacagagtctcgctctcgcccaggctggagtgcagtggcgcgatctcggctcactgcaagctctgcctcccaggttcacgccattctcctgcctcagcctcccaagtaactgggactacaggggcccgctaccatgcccggctaatttttttgtatttttagtagagacggggtttcaccgtgttagccaggttgatctcgatctcctgatcttgtgatccgcctgcctcagcctcccaaagtgctgggattacaggcgtgagccaccgtgcccggcctcatcaactttataatgagacagttttgaaggaaatgatgtcattcraggacctcccatagtcgcttcayggaaggttgcagtttgaaggaaactgtcagcgaccctatgaggacacactgtactggacaacagtggtgtctaagctgagaggggtggcagagttcccagcttttaaaatttcttacagtgatagcatcatatgaaagtaaaaccattttcttgaaagaaatgaaggaaggaagaaaaggtagagttcctaattgtttggaagacatactgttagacttcctgtcttagtatgcatgccagtattttaagaataaccactaaaataatataaatatagtatgtaacttccaaaacagcggagaagaaaaggagaagtaaaaatacttaaatccccaaagaagacaagcaaggagaaaaataaaacaaaaatcagataagtagaaatttcagcccagtatggtagaaataaatctaaatatatctataatcataagtatagcttgactaaacttgtcagctaaaaaacaagttgtcaaactggatttcaaaaacaactctgtttacagggaacatgcctaaaacaaggatacagaaaagaccaaagtcaaaggagaagaaaagatataccagaaaataatctgaaagaaagctgcagtagttatgttaatataagataaaataggatattaaagaaaaatattagggataaagaataaagagggtcattataattttaaaagggctaatttcctaggaagatacaagaatcctaaacttccatctacctaataaaaaagccttgatatgtaaagcagaaattgacaaaaccacacacaagaaacaagcctagtgattgctgggttgagtagacaaagagtaaagctttttttggaagattgagacagcacagtgaaaagcaagatttaatagacatgcgcagaacactgttccctgcgttgggagaacactgtttgcccaagcttacatcaaacacttagaaaactttagcaaaaattaaccacaaagcaggcaagtcagcaatttccyttttttttttttttttttttttttttttggagacagagacttgctcttttgcccaggctggagtrcagtggtgcgatcttggctcactgcaacctctgcttcccagattcaagtgattctcatgcctcagcctcctgagtagctgggattatgggcgtgtgccactacctcctggctaatttttgtatttttagtagagatggggtttcaccatgttggccaggctggtctcaaactcctgacctcaggtgatccacctgcctcagcctcctagagtgctgggattacaggcatgagccactgtgctcggcctaagtcagcagatttctgactgatgcaattaactacatacatgatgcaattaagttaggaaccaagaacaaacaactgaaaaatagaaatacgtttgaagactaaaactcacttctgaataatctatggtccaaagaagaaatcaaaggtagaaagtaaaatacgcttagaactgagtgatgatgtgtctcttggatgcatttcgagtggtcctgagtggctggagctgcttctgggtgagtgggtttctggcttggagggagaggtctgcatagctctcagacctgtctgtggagtgtggtggtgcttctttctgagcagaggtcaacccttgcaggcccacctagaactggacgccaggctgtccctgtggtttcttgtcttgctgatgttttagattgtttggcttaagctgaactttgagagcggcagcccttgcggctgggccgcgggttggcctgttgccctcaacctcagttctttgagcagccggcatcttcagcagcacaagatgcgccccgctggggttgcctcttatcaccagcagcacaggaggaatttctgtttatgtgatcctgttcctgtgtgtgtggccccaagtgacagagggccagagagattagaagtgtcaagtcgttacactcttgagtgtcatcttgctccctaagcgcaaagggaagtctccgtggttgtttctcattttctattattgtcccaactctgcttgagtgttcgatgtcatggaaacgcactgctttttcccacaagtgtgcatgtggrtcttgggtgggaatggtgaactccgctggtgaggcagctggtgtgctcaagagccttctcctgggatggagcaggcttggagagaggagacccdtcgggggctgtgctgggctctgctgctccctgggccccaccctggtctgtggccgcccctgggccccgtcctggcctgtttctaaggccccctgggcccctktcrtgtggagatgstgtctcatggtgggctgcgctcactgcttccagaagaaattctgagaggaaagagctstgaccctggagagaagtgtggtgcttcgggacagcctctgccccagcctagtcctgccgtggattgggccacctagagggggcygcgtccctcctgcctgtctcctctgtgtttgggtgaatgatagttcatggagctgraagyagtgccttcttgtctgctttctgacaaccctgccacaaactcatcatcaggaactttttgcagccctcttccatgtggagtgggacttgtggcctkgttttctgkgcaggagtaagaatcacatggtgttgggaaagtcagagctgctcttgccttggggactcaggtctcaggttgtggctgtggcagcaggaccaccctgtgacacggctccttttctgtgacgtccttgcagggtgggctttgacagcgagaatcccggggacgacgggcagatgcacaaggggctgtcagaacggagccaggcagtcggcgcggtgctcagcctgctgctggtggcgctcacctgctgcctgctggccctgttgctctacaagaaggagaggaggtaagygggtggcagggcgaggtggggcgggtggatgcatgcctcccatagctaatcttggggtcagttttgtggggttttatttatttgtttttaagccctacagcagcgaaggctcgaggttcttagtccaaaactctctggaagcagtccccagcgttgtggtttttaaatgcctgcatttctgtctgaccaaggccraggccctcgcacatcacccgtgcctgcggcttctaggaccgtggtcctttgtgtccaaagatgagtagaacattaaacggcacctttcatgggtgccttttcccactgagcagctgacccctctgccctcctcacatcataaatgcaggagtttattaagcgcctgctatgtaccaggtatgatgccatccttttgcgccactttgctgggtgaaaggactctccatgtgacggtcaagcagattttcacgtcaggcgtcagtgttagtggctctgacctgggggcaggagctggccagctcaggcgttccctgctgccactgtcatttgccagctgagccacaggccaatgagagaggtggtcagaaagtaccaaccatggaggttgcagtgagccaagatctcaccactgcactctagcctgggcaacasagtgagactctgtccaaaaaaaaaaaaaaagtaccgattgtggccctctacacccaaaatgcagaatggggcagaagaaggtctgggccgggaagggcatgtgatgtctgtctctgcgagccaccattgggcaggcttagtggcgacggactggtgtggtcctgttagtcatgtgaaaaagtccttgccctaatgttaagttgctctagagggccctctgctgttggattccaaagcccatsttctttccactcaatcacaacaaatacattagggtatatataacctgtcacrgctactcatttgtcattcagaatgtgggagaaatgcagccrccaccagccccctggtggtgcagatgggggtggggctggcgggggtggggctcctgcccatgccctctctacactggagtaattattgtctccttttttttwatagggaaacagtgataagtaagctgaccacttgctgtaggagaagttccaacgtgtcctacaaatactcaaaggtaattttctgtggcgagtctcttgaagrcctgcctccccggccccctgtgctgcgctgtccatgtmgttctcatcaggggtgccaaggaaagcagtcacaggctgactggaatccagaaaggaaagcaacacccgttgcctcagccacttacgccagcacatttttttgttatttttttccctcaagtttctctcrtggttacaactgatttccttgaagtatttaataattaggttgtttccactgtttttggctgttctttaaaaaaaaaacaaaacacacayacacacagtagtgaagatagttgtgcatgtagcatttggatgatttctttcagrtaaatttgcagaaragaggcattatctggatcaaaggacataatgtttgtggtctcgatgggtaatgatgaattgctctctaaaactaggcttttgactsgagtccctcctttgacattcctcccctgccatgcagtgggcacctttcagtctatgagtagcccggaagagccccttctcccccagctgcgctgggggatcactggtctgcttttcggtccaggccatcccgaacgccttctgcttggtcccacccttggctgtgagactcctgccaaatgaccccactgccaccctcccaamccctcctgccttggtgcagtctcattaggaacaggaaggtgttgccagccctcgtcttcctttccctgggaactggagatgcagtgactgtgaggacagtgggccagttcttccccagctcgtgccagcagagagcatccctgatgtggtggatggtggagcagaatggggtctcttagggggctcacgtggtctctgctgttgatccctggcaggtgaataaggaagaagagacagatgagaatgaaacagagtggctgatggaagagatccagctgcctcctccacggcagggaaaggaagggcaggagaacggccatattaccaccaagtcagtgaaagccctcagctccctgcatggggatgaccaggacagtgaggatgaggttctgaccatcccagaggtgaaagttcactcgggcaggggagctggggcagagagctcccacccagtgagaaacgcacagagcaatgcccttcaggagcgtgaggacgatagggtggggctggtcaggggtgagaaggygaggaaagggaagtccagctctgcacagcagaagacagtgagctccaccaagctggtgtccttccatgacgacagcgacgaggacctcttacacatctgactccgcagtgcctgcaggggagcacggagccgcgggacagccaagcacctccaaccaaataagacttccactcgatgatgcttctataattttgcctttaacagaaactttcaaaagggaagagtttttgtgatgggggagagggtgaaggaggtcaggccccactccttcctgattgtttacagtcattggaataaggcatggctcagatcggccacagggyggtaccttgtgcccagggttttgccccaagtcctcatttaaaagcataaggccggacgcatctcaaaacagagggctgcattcgaagaaacccttgctgctttagtccygatagggtrtttgaccccgatatattttagcattttaattctctccccctatttattgactttgacaattactcaggtttgagaaaaaggaaaaaaaaacagccaccgtttcttcctgccagcaggggtgtgatgtaccagtttgtccatcttgagatggtgaggctgtcagtgtatggggcagcttccrgcgggatgttgaactggtcattaatgtgtcccctgagttggagctcattctgtctcttttctcttttgctttctgtttcttaagggcacacacacgtgcgtgcgagcacacacacacatacgtgcacagggtccccgagtgcctaggttttgragagtttgcctgttctatgcctttagtcaggaatggctgcacctttttgcatgatatcttcaagcctgggcgtacagagcacatttgtcagtatttttgccggctggtgaattcaaacaacctgcccaaagattgatttgtgtgtttgtgtgtgtgtgtgtgtgtgtgtgtgtgtgtgtgagtggagttgaggtgtcagagaaaatgaattttttccagatttggggtataggtctcatctcttcaggttctcatgataccacctttactgtgcttatttttttaagaaaaaagtgttgatcaaccattcgacctataagaagccttaatttgcacagtgtgtgacttacagaaactgcatgaaaaatcatgggccagagcctyggccmtagcattgcacttggcctcatgctggagggaggctgggcgggtacagcgcggaggaggagggaggccaggygggcatggcrtggaggaggagggaggccgggcggtcacagcatggaggaggagggaggcgctgctggtgttcttattctggcggcagcgcctttcctgccatgtttagtgaatgacttttctcgcattgtagaattgtatatagactctggtgttctattgctgagaagcaaaccgccctgcagcatccctcagcctgtaccggtttggctggcttgtttgatttcaacatgagtgtattttttaaaattgattttkctcttcatttttttttcaatcaactttactgtaatataaagtattcaacaatttcaataaaagataaattattaattgggtgttaccattttttccttgatagtgagacgttcccgagcgagttacccatctgcctgcctgtcttttctttctgttaagtgactgaatttgggttttaactctggtgttctcgttgaccctttatgaggcagcactttcatttttctccagagtctcctggtcrtaggtgttaactttgggtcsaatytgccttcccttggctctttctagatccgatttctttaccttctccaggccaacctcggggtgtggtcctgttcatcaaaacaatgaacatggagtttagagtccagtgagtcaataaagcttttttttgtgcaacctgatctaacatggagatgttttctcttgagtaaactcactgagttttccatcttaaattactcagcagtgactgagagctacctgcatggaagcaggaagttactccagtgttataaacaaacttcttagactcaacatcctatyctccatccctttttttttcctgtagagtccaaaaacctcaacsgtctcatttttaaattatccaattggagttacctttttaaaaaagttattcttaaggactttccaatacctctcctgaggaagacatgtcaggtcttctaaaagtttacattatgaccaaagaaagatgctgstccycaggcattctacccagggggctgttctccaggccattcccacctcctgctaagaccatggggagccctctctgtaaggaggggcatatgcagggacctgcccatccccttggtaagctggatggcaaaaaggcatgttgtctgcaccactggctgcctgctaatgtcgctgtcagtggggaaggagaagtgacaacacgtttgagtgcatttgctttgactcttagaaacccaagcctctgaaaaaagagtaactacttgccagctgttgttacagatgatatttttaggaaaacatcccgtgacagcaaatcagaattggactctttttcagagaaatgattttattgatggagtacaacctgggtatttagcttcctttcaacaaaattttttgtgcccctttcttgagactgtccatgaatgacagagacatagaataagaactggggtgctaaagatggaataggcaaaccccacaccaaggaaatccacagtgaagtggaaatctggttcttatgaacattttaagagcatctgaagcctgtacttcaccaaccctaaaataatacgtaacacgagatgattcctcaggaaggaacatatagacatacagacaggagacaacatatagacattagaacttacaggacaaagaactctttttccctgaatcatttgagatgaagtttcttcccatcaccaggcattcctacaaacaaggaccttcacacgactaagatgccacctggtgattaaagaacactttgggctggtccgatccattgtacaagttaaagcactgatgggtacacaggtcttacccctgttggcgatcgggtcacaaggagccagtgtgtgtgtcaccaggaggttgtatggacgagactggatttctggaaatatcctttactgactctgaagaatcccatggctcagggaggtacactcatgtcctttcttacttctccggttccactctgttgactagtagttggcctcttgagccatacttgctgtcagttctggacattgttctgtgagaatggggtcaacgggcagtcgtggtgcaggtgagcttgtgtgcaaggcggcaagatagccacattgagttggggacagtatggcctgggggtgttggataggtaaggcagaagcaagcccagaacttggagcctgttgtgmctgtcacagtaaggagtttgaagtcctgaaagcagttgagagctgtaggagggccagattgggcttttgagcaagatagtctagatgaaagtaaagagatggagacgcttcagcaaccagatgggaggttgggcatgggagctgtggctgtgctgagctgagaagcctcagactgcctgcgaggctctctctgggaggaagtcaggtctttctttccttcgtttccttcctttcattcctttcctttccttcctttttcctctttctttcttyyttttctctctctctctttttctttctctctttctttcgagatggagtctcrctctgttgccaggctggagtgcagtggcatgatctcggctcactgcaatctctgcctcccggrttcaagggattctcctgcctcagcctccctagtagctgggattaaaggcacgcactgccacgcccggctaatttttgtatttttaatagcgacagggtttcaccgtgttggccaggatggtctcgatctcctgacctcatgatccacctgcctcggcctccgaaagtgctgggattacaggcgtgagccaccgtgcccagccaggtctttttcttaaagagggacagactgaaggtaggctgtgaatggtcagttatttgtatttctttaccttttatgctatcttgtagtttgaccagtttgcaaaacaaattgaataaaaagtaattgataatgttgttttgatgctcagtgtttgagggaaacacaatctagtgaatggggttattggttgtcacacctgggagagtgaaaatgaggggctcacaacccaggtgaggtcatctggtgccactcagccccatcccagagaaagcagccttgggatgctggcctcggtgacaaccaagaagtgatggtgggttgctagagacagggtggagcacagagccctggaaggaagcaggaagtcaggttcaagaaaggacttgtgacctcacccttggcttcagggttttatttttctttcttttaaaacattttgagacaacatgtagacattcaaacttacagaacaaagaactattttttccctgaatcatttgagactaagttccctcctatcaccagacatttctacaaatgaggaccttcacaggactaaggtgccaccatcagaaccacaatatgtggggacggtactgccagctaagcctyagtgctgtttcggtgttgacagctgtcacaatgatgcccttttcagtagaggagcctgtgatggtcacgtgttgcaggtgatcattgtgccatttggtttacttctgtctggaaagtttctcctttctgtaacctccatgaccttgacacatgaggtcactcttctcacccgccccacctctgggagggtgcctgatttgccctgccccacccagcggctttaggactcagctcttcaggaacaattagggagagggcccttgggtctaactgcaaaatcatacttgaactagaaaatcccgttggcataggtatggattgtcatatagaaacatttttcgcagtgtgccccgtggaacacttgttctgtatgttgttaacagatgttttgcaaaaaatgaaaaggacctgagctctaataagtttgggaaatgctgaattgaagtgaaacagcttttcttggtgtgagacctttcagagtctttaaaggagagttgctgaccacacgtgaaatcacaatagaaaatggccagcaggcctccaggtaggcagcaattcctagacatttgcctgtgttccctgggggagctggtggcctgtgaccatccactgggaaattcccttctgtggcgaggttctgttgttttccagaggctcccacggagcatgctgggtgggtggtctgtatgagaccacaccgttgatgagcagtgaggcccaaacaggtatatcaaaaaatgctcagcatcgctgatcatcagggaaatgcacatcataaacacagtgagacgttgcctcacacctgccagaatggctrctgtcagacgaaagacaacaagtgtgggtgaggatgtggagaaaagcgaacacttgtccacctttggtgagaatgtaaattggtatagccattatggaaaacaggaagttcctgaaaaaattaagaacagctaccaggaatcccacatctgggtgtatatccaaaagaaatgaagtcagtaccttgaagagatctctgcagcccctgttcattgcagcattattcacaatagccaagatagggaaaaagcctcagtgtctactgacaaataaagatggatcaagaaaatgcatgtatgtatacacacacacagtggaataccaagtcttgcrgaagaaggaaatcctgtcatttgtgacaacatggatgagctgagagaacattatgctaagtgaaataagccagacacagaaagaaaaataccagatgatctcacttatatgtggaatctaaaaaggttggactcagaagcagagagtggaatggtggttaccaaaggccagagggtgcaggaagtgagcagatgttggtgaaagggtgcagaggttcagctatgcaacatgaatgaattctggagatccactgtgcagcatggtgactatgatactgctttgtgtatttaaaattttcaragagtagatcttgtgttctttcccctctccaaataaaaggaaattatttgaggtgatggatatgtttaactagcttgactggggcaatgattttgtaatgataagtatctcaaaacatcatgttgtacaacataagtatacaattgacccttgaacaatacaggtttgaactctgtgggtccacttacatgcggttttttttttctgtaaaagttacacccgatgcgtcagccccttcttctacctcttccacctctggcacccttggcacagcaagaccaaccccccacttcctcctcctcctcctcagcctactcagggtaaagacaaggatgaagacctttatgatgatccacttccacttaatatataataaatatattttctcctcatgattttcttaaaactttttctgtattttattgtaagaatacagtatataatacatacaacatcgaaaatatgtgttaattgactctgttattggtaaggcttctggtcaacagtaggcaatactagttgttaagttttaggggagttaaagttctatgtgggttttcgattgtgtgtggggtcygtgctcctaatccctgggttattcaaggttattctacataatttttctgtccgttacacctcagtaaagctggataaaagcgaaaaccaaaagactacgaaggctaggagaaaatcagtacatgccactccagcccccattctccccagaagcagtccccacttcttcccctcagctttgtcccctgtcagtttaaaatcatgaggttcataaatttgaaaaggaaagctttatttcttgtaaagggtctcagcctgcaaaatcgccatcctggcaggctgggaagtgtatccagcagagaccaaaggcaggtacttggagacggggaaggatgaggcaggaatttatgctgaatgggttggccaagcatacatattcaacaggtgatggggggagctatgaatattcatgacagggggacatgcacatgcattgtaaacattcctgttacatacgccccatgatcactttggggtggagacttaacatttaaatgcatttcaattaggacttatgtgtcaaaaggtgaagcagggacatgaacgccctcagtgcatgcctgggcaaactagacaaccagtccatgcttggtggtcttttaccaggagaaagtccctgaaatcaggctcttgttaaagctgtagttacagctggtggagaagggggtcagttagtctgcatctggccataggtggtgagctgaaattgttgccgtattgctgatctccaggcccctgcttatttagctgccagagaaaaagaaaacaaaacaaaactttgtggcagttagaacctagtttattttttaagtgcctgacttaactcttgcctggcatggccataggtcatgtttataatttggcatcttacttccacaaagagtctgttctgtcgtgttatgatctgtaattttaacaccaccaacagactt

SEQ ID NO: 13273 - DNA, 95832 bp, Homo sapiens
tatatatgataccaaaatcaggttccataggagaaaatattgataaattggattttataaaaataattttaaaaacttgttttttaaaagacaacattaagaaaaagaaattggataaaatatttgcaaatcataaatatgataaaagacttgtgtccaaaatatataaaaaagtttataactcaataatcagatgagaaacaaatctgataaaaatgggcaagagatttgagtaggcatttcatcaaagaagacatatagatgacagataagcacatgaaaaggtgttcaacataattcgtcattagggaaatgcaaataaaagccactttgaggtaccaccaaacacctattcaaatggctattataaaagactgagaataggaagtattgcaaagtatgtggactccttacccactgatatactgtgaatagtaagtgtaggaggggcatatggactccttacatgttgctggcaggaatgtacaatggtacagccacattgggaaacagtttctctgtttctcaaaaatttaaatatacgctttgcatatgacttaacaatkaaactcccagttatctacccaagggaaatgaaaatgcagattcacacaaagacatgtacatgaatgttcatagaagcattatttataatagctcaagctggaaataatacgaatgtccagcaactggtgaaaagataaaatatgatatatccatacaataaattactactatgtataaaaagggactactgatatttgcatcagcatggatgaacttcaaaacattatgctaagtgaaagaagacagacacaaaagacaacttagtataataccatttaaatgaattttctagaaaaggcaaagctacagacagaaagcagagaagtctttggttgggactggaatgggagtttttgattatacatgtgcagaaacaaactttttgaagtgatgaaattgttccaaaactggatcatattaatagttgcacaactgtataaattattaaaaatcactgaactgtatgcatataatgggtagatatgataataggtaaattgtactttaatcaaacttaaaattcaggttacctggcaaccctacattttgtttgaaatagaagtgtaagagataatgaaggagtggcagataccgtggttaacaaaaagtgaaggactagaaaccaacttcctgtagcaggtaatcagcgacaatctggggccagtggtgtgggggtaaaaagaatttatgaagatacttgtaggtaaagaaagtcatatttattagagcacgtatgaaaatgtgttgcaagggaacaatgggcaggccagcaagagaggagctgactgcaaggagacgaaggcttgctggggatgttctagaatggtgcttgtgctgtgtgctgaagagggctttgtgcagtactgataacacygaggttgcagtgaattagcttgcatttttttttaatcacccgagggtctgatgatagctgagtgcaggaagattgtgagttatttgtgcaagagggctacatgttctggaccacaaagcaaggcagacttacagcttatctgctttatatttttgctttccctcggtcccgccatcctgactccttttccctaattagaaccscacactctctttggatggtacatgcgttttccattttcccaggttctattactctcctttggatcttacacttctgaattctctctattcgttttgttacctaactgatccctgtaggcatctctccttcatcccagagcagcaagaatcctttccttaccctctttgtagatgcaggcccaataacaggtctcaaaccttcccagagattatatataaaccatgcataatataggagaaaattaaatctttttattctctcccttaggggtagtgagtggttgatttacaaatgcaaatgatagatttaaatgtttgtgtaaagttgaaatgtcaaacattttgttggcatttagagatattatctgaaagagcattttacaaataaggaaactaaggctcagaggcttctggtaatctgttcaaggtcacatagttatccaagcttcttgctccaggggacatatttttgtgctttcaaaaaaagaaagaaaaatcaggatgtcatacacattcttaaaaataaattaatgccacagaaaaatgttttccctaggcctcacaaagattaaagaggcttgtgggttttttttctgtttagatttggctagatgtctttcttgttttactggcgaattagaagaaagctggaaaagctctgaaacagctgctaaaataattaccctacagcatatttcattttttaatcactaagaaaagttgtttcaaagtaatatttcaaagtaataattaaacattgataaattgtttttgtttggtgttttggccttatctacaaccaaagcttcaagcaccaagacagaaatgtctaaatatttatgttacaataaaacttaatagaaaacttacacaaaatcttaaattatcatctttactgctattccagattagagtatgcaatcactaaaacagagtgatttaggattaaggatgaaacattcattgttcacctttgcattaacccaaaaattgtgttgtggttttatatctcatgaccttattgtactttggaatgtgatggtgaagctgtccctcagatcatttagaataaagaagactgaggcaatatttcactataggctttgcaatgtctatagctaaacctgaaaatggcatatctgactcatttttttttttttttttttgagacagagtctttctctgttgcccatgctggagtgcagtggcatgatcttggctcactgcaacctccgcctcccaggttcaagcaattctcctgcctcagcctccagagtagctgggactacaggcatgtgccaccatgccctgctaatttttgtatttttagtggagactggttttcatcatgttggccaggttggtctcagacacctgacctcaagtgaaccacccgygtcagcctcccaaaatgctgagattacaggcgtgagccaccgtgcccggccttggctcatttttattcttccgattttagacttccaattgggtttttataattacccatattaagtcccrcctggcacagatgaggcatgagcattaggcagaggccacatcctggtgacgtgtgtgccaggtctgtcctgcagatgtgctacattttgtttggcttttaaacgtgctacattttgtttgtttgaagaaactgtttctctgaattttgtagacaacattttgcaaccggagaattcacacaaacatttaaatttcctgcttctcttgaaaaatctgaccatctgcccacactgggcacacaatcctgttgaatagatgctgcaacctttaacatggcacatggtttgccttttgcagtgtgtatagggctgcctcagtcaaatatggttcatggcatattgtgctttcaaaaaaaagaaagaaaaaccaggatgtcatacaaaatcttaaaaataaattaatgccacagaaaaatgctttccctaggccttaagatgtttgtgaccctggagactgcacactgtgttttccaaatgttaagtctttaaagtggttcgttgccttgagatgcagacaatacacttcttccatttgttttgtcaggtttaaaggcactttggataatgtctctgttgagttgcttttagaggttttgacactcatttgaccagtctcagtggagcaaatctttgtccttgaatctgatttttggaaagagtcaaaggaaaatttggagccaagtttggggcagaaaaatatgtgtgattatgaaacagtgaaaacctgtttctcttgggtggtttgtgagctgactcaaaggtaactttttaaaaaagttcaataatgctttgagggaaggcttttacttcttccagatgtcaactgtcctttctactaagctctcataatattgaagtagctttgttgtctatggtgacatccgaggttcttggtctcacggccacaaagatcaaatatgtggacacacacaaagggtgaggtttggagcagaatttttaataggcaaaaggargagaatagctctgctacagagaggggtcccaaaaaatgggttgcaatacgtggtgaaatgcaggggtttttatagatgagctagtggggaggcggtgtctgatctacataaggagggaaaacccggtttcgtgcatatggcatgaaaacccggttaggaccaggtgtgtcatctgcatagggcttaagtgtctggcagccccggccccaatcttctactatataggcaggtagctactccgtgttgcttatttccttcttactgtgcatgtggtaaaaaagaggggaggtggaacccccatggtggacatgcctggccccagtagccccttctgtctgtgccgctgccggcatctcccgtgcaagcttccagtttccttacctatgtttgcagcccaatcttccaggttgctctttgttagaaaggaagtgatttcttgggctgctttttgttagaaggtaagttctgccgagggctcttttgctcatactatctgcctaaataatttctatctcctgtatcaatatcctatgtgtgactctattctgcatatatgacttaggttttaattattttgtttacgagttggtcctacccccccacccccgcttccaccacacttaaggaaagatacattttaattcattttttatatggtatgcatagttggaggccaaaagattgagttgaaggattcattacttgatgaataaatggatgggtggatggatgagtcagtataaatgaagagcatcccaagttgactattttaaagggataacatgcattttatatttgttaaacattcattctcatttgtaaacacttgtatatattcatgtattcaaaatgtattgaaaattaattgttttccttggtacctgaagtcagtcctgggtattgcaaagtagttcgaagtcactggtttccctctgtctcacttcactacacactggtgattttgctaagtgatgagccagaaaatgtacaagttccagaatcaaaggtaaaacaaaacccaccaagaatcagctcactgttagcgtcctagttgaaaaataaggcttatcaaagtatttcagattgcattaacacttttgatatagctaggtatcagtgtcaacctcaggagagggcaacgccaactcctgaaaccttcaatacagaaagtctagaaaaataagcaaatatacatacaaacaatagcgagaagactccagaaaccacataaaaccgtgggaatcgaaatatcccttacgtgtgttcagtayatgtgaacccacgtattttaagtggacgatttctctctcagagtaccgtaggtagtgggggacggggcgcagagggggagaaacagaaagtcgccttcctccatggttcatttgcatttccatccagaaactcacaggtcgaccccaagactccactctctcccgcctttgagaagccggaccggcatcggcggctgcatccttctcctcctccccgctctattttggggccccatgatctcatgccctctgcagaccacacgctgcaattccagcccagcccgcgccgcgaggccacgcagggcgattcctgcaagtgtcgggagggtggccggggcgcggggaggggacggcttggggggaagtttaagacacgcccacgtaagggacccaaaataaccgacacacagagtgcccgaaatcagacaggaagccaaataatccggggcgttgagtcgctttgccctgactgcgagagccgggtgtagggcggggagccaaggatctgaccgcraggggcgggcgcgkcggggaggggcggrgcggggcgggcggcgcggggcctattaaaggcgcggcsgggcagcsgggccggagcggccggggccacgatggagcgcgacggctgcgcggggggcgggagccgcggcggcgagggcgggcgcgctccccgggagggcccggcggggaacggccgcgatcggggccgcagccacgctgccgaggcgcccggggacccgcaggcggccgcgtccttgctggcccctatggacgtgggggaggagccgctggagaaggcggcgcgcgcccgcactgccaaggaccccaacacctataaagtactctcgctggtaggtccgcggccaggccccggcgcccgggagggctgggagtacggggagggcggcgccgagctcctgcgctctcagcgcagtcagcaccgggcaccggagagaggcatggtccgggagtgcttcttcgcccgcgcgctctcctccgcagcctttgcaagtgccctacacagccgcccytgccaggtaccttgccagggcaggatggttcactctcacttgaattatggatgcctgtgaaagcaggctgttcaaaacggtcatccttagaaatactcgaccccctgccccaggagagtacgggtttttagaggagaaaaatgtcaaacgcgaaagttgttggtcttaagaaggtgcatcaatgtgttgcttcttttagggggctctgggcgcagtatacatgacttcacttgggttaactgattgcagttgaagagttagcggagctctttaagttttattaggaactctacggaacactttttccctttcgctccgttttggaatttccttgcaggtgctcagaaattccatggatgttcacattatgtgactgaagaaacctttatgattctttgcccactcttctaaccagaggctacacggtttgtgttgctaacaaaagctacctattactcctctgctattttgctatgacatttgcaggacccacagtcaacttcatgaaatgtgggggttggtttttattctgaattcatggtgggaagtgctgattgagagaaggcctggattcctggctgttattatttgctgaggccttgcgtaactgtccctaaacctcaatttctaatgtgtgaaaatgggacaacatcaactcccttgtgcattgcatgggattattgtgaaaatcaagctgaagaatgtaggtagggaagtaaattgaaaacagcaaggaaatagaatcatttttattgtattatatggaaatcacagatttctatgtatagtgtaccctaaaatatatccccttacatatgattgaataatgctttgtagaaaaatttctaatttttcaagtctcctttcattttgtatgcatttccattttcactatatttgggacatcatggagatgctataatactttgaggaatcaatcttcctagacttaagagatggtgccgtatgcttagtacttaaaaagaagccttagtttcacagaataagtaccccaagccacatgatgtttgcatctcaagataaaattttgcatcttgtaacactgttttgagtctataataacacaatattgatgagaacttagtctcttgagtcaccttttaaaaattttgttaatggaagaccttagcttttacaacctgatcacttaaattgtttagtattaataccttgaggtgtttcacacacgatgaggtagtcgataattgtatatggaatcagtgtgtaactcttgtgtaaaaccatttctacatgcctrtaaacctttacaggttttccaattgcaaaattcaggttttaaatttttcttgctcatttacttatacatccacaacagatatcagcaaaggtctagttttggaataagctgtccagtctttgagacctgcagtcaactggtcaaacagcattctgtgtgatgatgctactctgggcatttgacatggaagtgtcctaggacttacttccacaagtaggactattatggaccttttttatccattaattggggtcttttgcatctattgaattggaaagaattyttacttcatatcttttgatggaacactgtgagacattaacatacaaatgttaccaaatagacctggtgcggtgactcatacctattatctcakcactttgggaagttgaggcggttccattgcttgagcccaggagtttgagaccagcctgggcaacatgatgaaacccatctctacaaaagatacaaaaattagctgggtatggtagcatgcgtctatgtcccagctacttgggaggmtgacatgggaggttcagctgagccagggaaagttaaggctgcagtgaactgtgattgtgccactgcacttcagcttgggtgacacggtgagaccctttattgttgaaattgctatttagctactgaactgaaagtgcaaactcgtattcttctttcccttccctacttcaatacctttttcccccaaccccgccccccccccaarracttccccaaataatgggcttccaaatggaaaaggccccaaaagcatcctgacaattgtsgtcaaagagctctgggatatgtcttctagaaaggagctgcaattatagaattccttttgttttcagattaaacctcagcacacttttcataaagctgcagaaacagattgaactaattgcaacctggggttgggattaggagaggcccagcactatgatcctcagctacactgttttaatttagcaggataaatagaagagttgcgttgccttgcctttcagaggcaatcatgttgcagtggcaatgtaatttttacattactctgcagttttctcagataaactaaaatgatgtagatgtgtgagagtggatgaaggagtgaggattctgtcctaccctggcttctccccattgtggtggttgatcttaggagagggccaccaagctgtgctttagaggcttttggccctgggccctggaatgcttgtgcctaggtactgagccaaactgaggaaaacagcaagagggaaaaacaagtattattctctacatgtgtcagtaggtatgttaaatattagatgcctttccttggttgtaaatgaagttttgaactgaagtgtagacttccaccgagatgtgttgacttggagatgtatttaaatatccttcttgtttcttggtgtgattttacagtsatgtaattctcaactacattgcaatacatttctccagttagctcctcaaaagcattttttttgtgttgtttgtgaccttctgctatayttatgaatacatatatctgtgtatctgtgtatgtgtaaagggcttgcgtatgggtggtggtcactgaagactactttcatgtttcagtgaaagagttctttaaaaaaacatatatctatatctatatmtmtatmtmtatatctatatctatatctatatctatatctatatctatatctatatctatatatatgtagagagtccgtttggctcaagtttgaggactgcaacccaggagcatagattcaagttgccctgagtagatgctcctattagcagcagttacaaatgggtttttaaaggaaaaaggaagaggcagttcctaagttgtttatcaagcattcatgttacamtaacgagctattggttggctatacattgttctttgtatcacacattccaggaacatgaagatagtgggtgaggcagctgtcaggaacaaaatgcttttaaagaattgcccctgggaatgggtgcagtgatgtgactgaagtcccatgctcatgtccctctgggcctgataaattttgcatagttcgcatatctcagactgctctgagcaatttttctttctcatttcctccttttaataaaaatctttctcttcttaaaatactgatgatcaacgttttggatgtaagtttgtcccacattgctgggaaggctcatttccggatagtcttgtcccatgtcagagggaatgagatgggcagaagtactatcacttaaraacttagtgaggttccaaggctgaattggtaggcaacaattcagggattggattgaaaaataaggggacagagcagcgggatttcaggtcattcacttacactggagttgaggtatgttgggtcatttctaagcatctagctattatgatgagttttttgttatagaattttgtggtagactttagacatctagaaatacaaagcataatcaatttaagaatcaaaaggatgacacaaataaggacaattatcaacaaaacaacttgaaatacaaatatgaaaagtgttcctattcctgaaggtaaccaaatgaatattttaatccacttcttgtcctggtctaaagaacaaagtgttgaagatctccactgaggaagatgtccacttaggcagggtagcctgatattggcccttctaacgtggctaggagtcctttatttgatggtattttctattaaacaaaatcttccaggttggagaccatgatctttgatgtttttgtctcctaagagcttgctgttaaaakaatccttaattaatttagaattttcagtgagaaacttataaggccttgacaatagtgaagagtatcaccttgttaatggaaaaaccaaactctgtaaaatattttaaagagctttatcctgagccaagatgagtgactgtggctcggggaaacactttctcaaggagtcctgagaatgtgcacctgaggcagttggattactgtgtgtttttatatatttcagggaggcaggagttactggcaaagacataaatcagtacatgaaaggtatacattgattccatatgaaaaggtgggatatcttaaagcaagggcttacaggttatttattcagcatattcagagattttttttttgagacagtcttgctctgttgcccaggctagagtgcaatagcacaatctcggcccactgcaacctcccgctcctgggttcaagcgattcttctgtctcagcctcccaagtagctgggattacaggcacacaccaccactcctggctaatttttttgtattttagtagagacagggtttcactttgttgcccaggctggtcttgaactcctgagctcaggaatttcacccacctcagcctcccaaagtgctatgattataggcgtgagccactttgcccggtgattcggagattctttaatttgcaattgattaaaggagtaaggctctgtctaaaacttggaatcaacagaaagggctgttgtggctgtgtgtgatggctcatgcctgtaatcccagcactttgggaggctgaggcaggtgggatcatttgaggtcaggagttcaagaccagaatgaccaacatggtgaaaccccttcaaaaaaagggtgaaacctctttttttgtaaaaatacaaaaaaaattagcagggcatggtagtacatgcctgtagtgccaaccacttgggaggctgaggcaggagaatcgcttgaacctgggaggcggaggttgcagtgagccgagattgcaccattacactccagcctaggtgacagagcaagactctgtctcaaaaaaaaaaaagggatgttgtaagttaagcatgatgctatgtagcaaaattgatgggtgtgcagacatgacttaaccctcyccttgcatacccttaaggtcttgtttataacttggtgtcttattgccacagagacgttttcgcggtcttatttctattgtaacattaatgctggtcaattgttacgcctcaactccaaaagggagggagtagaattaagtgcgtttgacctctcttcctattttgactgagagctcagtttttgaggtttctctggggtytccttggcagagagtgggtccactcagttggtcgagggctttggattttatttttagtttacaacttttcaggagagctggttcgtagtctccttcatccaggtgcatggatctttccattcttatttcaaaaggagaaagctgatgttttccaagcagggtagaatgtaagttaagcaaatggaagagccttaggccagggaaggttaaagctttctgtaagctttgccaattaacttttcatgattccatttatttattcttccactctggaagactgagtgtggtttgcacaatggaaatgccgatccatccaatctcaatgagcttcaaccacacaagataagatttctggcggagcatagaggctaatgcctgaaatcccagaactttgggaggctgatgtgggaggattgcttgagctcaagagttcacgacctacctgggcaacagagtgagacctcatctccacaacatgtggtaggacttccaaaaatggagaatgcaatgagttcatgctggtaccaagcactgattttagagaaaaacaccaggtggtggtgggaagtcactgtgaatcctgctgacctaaagaaaaaaaaaaccaaggcaaaattaatgtaattatagagctttatttgggccaagtttgaggaatacaacccaggagcatagattcaagttgccctgagtatatgctgtgaaagacttctttataagaggcagaagctggcattatttgagatttgggtgtaaaaattataattcaattagcttccttttccttcccttatgatccattatcttaactctagaatatggaaggaagaatgttcaagctaagtctctgctcttaatcagacttggagttgacattgctcctttggtttataaaatttgttatctgtccagccatagttgaacattttaatttcagaataaccagagcatcttaagaggccagagaagtgttctctgtgtcccttatggtatttgtttcacatgttctaataaaatacataaaggattcctaggaacccaagactgttgtttttactattaggcagaggatartacctgacactcaatgtcagcttttaattgcttgaatgaatgtactgcattttttgttagactgagccacactttgatttggaaaaggggaagatgggaagactaaatacacaagcagggacccatagggtctgtgatggtcaggaatccacatagagatgacacttgggtataaattcaggggtaagattaaaactgggatataattttatttgggtatagggagatggaggagatagtgaaggaacagaagtacccaactaaggtgaaggtgcctaagaagaaggcagacggggcctctgtgataacgtggattcagaatcagaaatctagtcagtgaacattctctcaggtacagacactccaagtgtggcagtcggcatgtatgaaggagagcctccttcacttacaccaaggcctctttggttttgataactttgctgccacaccctgaattcagtctttgtgattcttcgctcttcttcagcattgctttctgtcccttcttttcttctgccttgaatcttgttctggtatttctttttcaccatttgtagctcagctgtttccactccatgttgtctctttctcagggatacgtagctactgtttcaaaagcactttgctaatttctatttcacttgtttagttaactttggacactcagttttgtcatctcctgcccccatcatatcctaatcatgactctgaagaaaatccttggtggtcacattgagagaccttatgtgttctgtataataaagaactgggggccattaacctttctagagcatttacagaaatttttatctatcagccttttttttttttttgaaacggagtttcactttgtagtgcaggctgaagtgcagtggagtgaacttggctcactgcaacctctgtctgcctcccgggttcaagtgattatcctgccttagcctcctgagtagctgggattacaggcgcacaccaccacacctggctaattttttttttttttttttttkgtatttttagtagagacagggttttgccatgttggccaggctggtctcgaactcctgacctcaagtgatctgcccgcctcggcctcccaaagtgctgggattacaggcgtgagccaccacgcccggctgtatcagcttttcatcttcatccagctgactctttttatcttaagtagcaatgttaaaggtaaatgaaaatagtttcatattcaattttgctctcaagtttgatgactaccattgtaaaatatttgtgtgacatttaagatacagcaaatgtatttcatctatattgtggcctttttgtacaagccagagaactttatcatgatttataacttctttttttttcttactatggggagaggcatttaagttccagacaacttaggaacaaataagcatttggaatacaacttgtaattagagatctgcttttggttaaaataagcatgcctccatcaaccataaaataccccccaaacaagwaaaaataaacaagaaaccttttagcaaatgagctcagggccgaacatagattactcttctaagcataaatcttgtgcaacaaaacctgatactcagaattctgacccagctcgaaaatcccttgtcatcggataaaaactaagttatgcatttaccaaggaaagacaatgtaggaacacatttaaggtttttcaaaagagtgaccagaatgttcagttaaatattaacgggaagactattttctgagtattctagttatctgagatttagttgcaagaattaagatatctgtagtgtctttgaaaaattatttttacctttttttacttttagtttttagaagaggtgttggtagaagtgtaggtggtagaagtttagatggttataatcatttttgtagcacttggcagctttaaaaagcatttcccatatatttttgattgatcctcaatactcaacaactgtgaaataggaaagtatgatgacagtcaattctgctttacagataaggaatctgaggctcagtcagggattcagtcaggtttccatgcagacattattgtgcataaaaaccacctgggaagtgttaaagacagagattcctaggctccaatctcagtgattatgatttaatagatttggaatggacccaaagaatcctcactttttaacaagcacctcaagttattcagatgtaggtggttgatttactctacttctagcaacaatgggctaaatttataggcaaaagccacaccattagtacataatagactatgatggtaactggaaggacttttatctacagatttttatyacggactaatagctaatgccatcccattcatttgctaaatgttatatcctattcatcaagcttggcctgctgttgggtttccaactctcctttgcctgcttcagtataacaatgtgtaattagaacctaagaaatttctggtgtggtgatgctaaagcttgcctctatattgagatatatatgtgtctttggtagttcagtgatgagattttcctgggtggaagccaaaattagtgcactttattagtgtgaagtcaacaatcagctgtttctgggagcttccaaagtaggtatacttttgggaaawtgtgcttttcttcttagtttgagtttccttmttggcttattttgaaatgtagtagaatagaaaaatagagagttttgatagaaagtgattttgggatgtgtggtggctcatgcctctaaaggagaccgaggcaggagaatcacttgaggccataatttaagatcagcctgggcaatataatgaaaccccatgtctatctctctctctctctcaatctctctctgtctctctttctttctctctctccatacacacacacacacacacacacacacacacacgtgtgtatgtacatatctccatattttatatatatgtataatatgcataagaaaatcattttggaggaagtaaattgtcacagcgaattgtcacaagtgtttctcatttatggattgaccattttctcaccgtatttcaggactttgcacagacttagctggcaaacatcctataacaggtgtgatttgagagtcttaaaaaaaaatcactatcttggttttcaggtgaatatttttgagaaactagcttgttcctaaagrtgtgtttcccgatccccctcctgcttagaaagctttttttgacgttagcaagcatctgggggatcttgatgctctcttatggttagagagagagaattgaaaagaaactcagtagattaagacattatttgccctttcactgtgttgacttttacaccgtggtattaaaggagtgatggcaccttagcagacgtcattgcaatgacaccaattgtacaagtagtcatgcacttgcaataaaaaaaaagccatttcactaaaaagaacaccttagatgttttattgcttagatgaagcaataaaaatgtccttgatgaggctggtcgcggtggctcacatttgtaatccttgcactttgggaggccgaggcgggtggatcacgaggtcaggagatcgagaccatcctggctaacacggtgaaatgccgtctctactaaaaatacagaaaaaattagccgggcatggtggtgggcgcctgtagtcccagctmcttgggaggctgaggcaggagaatggcatggacccaggaggcggaggttgcagtgagccgagatcgtgccactgcactccagcctgggtgacacagcgagactctgtctcaaaaaaaaaaaaatgtccttgatgaagcagatttaataatctgaaacctagattacctgtctttttgatattctatgtgacacaattggaagtatgcatgtagcatatctgctgcatactgaagtactgttttctagaggaaaagcagctgtgcggttgtttaagttgcaagctgaactaattttttttcaaagaacaccatttttatttgaaagaactgacaagctttttatttagacttatttatttgacatattttctcaaaaatgagtgatgttagcttgtcccttcaaggaaaacctatgaagctatcagctgtctatgataaaatctgagcttccaagcaaaaattagaattttgaaaaacttgtatttgccatttgagtgtaacagcttcctgatccttacacaaaaytgatgaagatagcgaggaatgtggttttttttcatgttgtttaatgacatgcgttaacatttggaagaatgatagaacttagtgaaccaatattttccaaaggatgagtggatgatgttacaaaattatgcattggtataatttccattcaaagtgcaagatagactaatggattttaatgtaacagtatgtaaagttcagtaataccttttccatttttatgccataatttacttctttcaaaagacaaatataagataaaaattaattcaagagcacagatatatrcattctatcgaaatgaatacaatgtgatttataaatgagaacaaattaccaatgaacagtatttcagaagttgaaaaggtgacactaaatgttaaatacacagccttttagttatattcttcagattcagtttttttgtgaatttaatataaagatgagttcattttgcaacctaaaaatacttacttattgaaactatattaatactttaataaactatacaaaaaagataatgagacaaacgtgcatttgtggaactgcatgtcagtcagccagttccctgcagagggaattcccagcattacctcattcatctgtgagaacacagagcagtccctatttagacacacacatttgtctactgctccagcatggccagcccccyacttcttgatggtttctttctgctatgaatatgcatgtccagttgtctgcttcatagagcagacatttaccttcctcatccaccagccattggaggaggactggggccacgcaaatgattgattcgaccaattctytggggagagtttcccagtggccctcttccatcatcatatctggaatcagatgagtttccatagcttcttttttttttttttcgcatcttgctgaagcagagttttgaaaagcaaaaccacaaactcagctgttccccataagaaatctgttatcaaagataatctccatggagactgactccagctgtccagcrcttgtccatttgcgatgtaaaccatcttgccccccttccctgcttcggagcgactggtcatagtttaagagattactacttttagaattttggtgtggttttaaagaagaatgtccataatcatctgaaaaggcatcttagggttgttagtaacttttagaagtataatgggatcctgataagaaaaatttcgtgaatatatttacaaatatttaggaaataggtgtacatccagtaatattttcagtaatatttttcagaactaggggatgtgagggcgatctggctgtgacttctatcaccccattgatcgccagggctgatttggctatctggctggctaggcgggtgtccccttcctccctcactactccacgtgtgtccctcccgaagatgtgcgctcggttgaagaagatgaccatctcccatagatgagaaccagtctttggtcaagggtatatgaataggtgcactcccctgctagaacctccaaacaaactctcaagaactagggagaggagagtgaaaattaacctagttacaatgattgtatccttacattcttttataaatttcaaaatacttctacatctcctacctcattagtccaaaccacagctctgctgttatccatccccatgttagagatgaaaaaatcatggctcagagaaagtttggagactttccaagatcacaaaatcaataattctgttaatctcatctctgtagtttattggtgaatagttttggagtcagacaaaatcaggtttaaatcctgctacggttactagctgtttgaatacagacaaaaaagtttcctaaatagtaccacaactgtagcatagagacaaaatcatattagagtgtgttaggagaagtaaattatataatgtgtacaaaatggtgcataatatgccctgaataagtggktttttcttgttattgktgataagcttcaatgtgactgagaattttttattttaccttactcagaaggcactttacatccttaactacccaaagtgtggtctgcagactgacatatcagcattatcctcttagaatttgtaagaaatgcagaatcttgggccccaccccagacctactaaaccaagatctgcattttcatagatcctcagaggtttgtctgaacaattaagtttgaatatcagcactccataaggctatgagacagcacagaaggcaccacatctggaatttctgtagctgagaattctaattaaccctcgctgtgccactgacttcatacatgatgttgtgattagaaacctaaaacaaaatgaaaaaactcaatgggcctccatgacctcaactgtggttgcattaggttgaattggtgctaccgctggttgcatttggcccctttccttccatgaacctcagtggcacatggatacaagtagccccattgctcttgcacatacagaacatggcayagtctcctccctttgcatataccatctctgtctttcaggaacctgcctgtgctctcgtgtgttgcttataatttaattgccttcttttactctgcactggcttgtcctttaattgctctttattgcccttagcgttgccaatcttctgtctttgctgttacctgataacattcagatgtttttccaattcagccatccatctatcaaaatatcatgtagatggtgctttccatcrcacgatcaatggaactatccaattccaagtttccactgcagtcccctctcaacaatcaacagtatacttgacacaaaaccaaaacaaaggaatcttataccaacgctttttcaggtgatgtaaaatcaggttaaatgtccttggcccagagtttattccataatacttcatcatccaaacacactagcttcctataaactgccacccagcaccatttcgattataatctctgggatactaggaaacaggtgaatgaaatattcatgtgggaacagtgtggtttaggagcattatgagtagactctgttggtcttatctacttttggattagtcggggaaataagcaggaaacaactctacttggacacgatttatttgaataccttactaatcagcacaaaggaggtaaatgtgaagaatattgacatatataagtatttatacatttgttatctcttagaaactttcaaagaaaaagaatattgagtattatggaatgattcaagcaaaggtcttcagagacagggttcatgtaaagggtctaaacgggaatcacatgaatcatttgctatgtgacctttgaacaattactttctttctttgactttcagtttccttaaccgtaatatgaggagttggattagatgggttccttctarttccaaaatatttgttttgagagcttacaatattttccccattgctataaaaatactatctattgcaaaaaattcagaaaatataaaaaagtataaagaagaaaatgaaaattgcttttgggttttttcccctccaggacttttctatgtgtacatatcacttttwaaaaaaaaaaaacaaagatgagatcactttgtgcatattattctgttgccttttttcatttatattccattatgaaagtttaccattgatagacagctttctaatgtacttttcataagtaggattttgagacttttattttagtatcctcaattcartaggtaatctttgaaactatttctatgcatactttagacattctcagtccccaagaatttcyagctttttggtacatgtttgttttctgttttattcattcctcagctccatctctattgcttatgtctctttttcatggttaaattactagtttttctaaaataatagcttctctgcattatgtttctgctcagaatttttctgggactgccacagcacacaatgagaaaatatatactcctaagccgagactagtttttatttcccacacgcgggataacagtagacgttaatcaatgtagggctcaccatgaatagtttcatccattcrtagcagtgctgagtctgtgacatatgtgttcagtcatttatgagttaatatttgtcaaccacttagagtagaccsttgctggtagtaagtgctatgtgtgtttgttaaatacatacrtatctatttgtgtttactatttgtccggccctatgctaaagacttatctcctttaatgggtacagttctgtgaggtaggagggagcaaatctgttggcttgggagtgtctggcctagctcccatacctcagtgggactcagtatcctatatgatgtatagtacatgcaatattatgtgcatactttgtattaaggagattgtagggctcagatatgtttcagtcaactgctgctgtgatggcactttgcccatttagagagtcaaaaaaggactgaagatgcatatctctcttcagcattccacacctctgaagcacgccttctatgacattcagctcagccttgtacagttctccaaatacactttgtacagattatatctgttttctaccccaccgtgattttttaacctctccttttctcacccaacatcaggcacccaccaagacccaactcaatgtgtcctctcaaatgaaacattctttagatgctctttggccccatctccctgtcccagaaccactcaattgctactggatcctgttgaggccatagagcttagtgagtaaggccagaccctggagccagagtgctggagtgtaaatcgcatctctgccaataattgcttttgggtctttgggcaggtcccttaacttctctgtgtcatagcttccttgcctattaaatggggataatagtagtagtacctcacaggtttgttttgagggttaggtggattcatatttataaactaatgagaagagtgcctgatactagatggtagatcggggttcaatattgttattgctatggtttgtaacttatttaacaaatatgtagagtttttactgtgtgggcagtctggtgcaagaggctgggggctaaatggtcaaagggaaagtttacttactgtctgttttttaggttttatctgaagggaccagatatttatcgaagaattatacaagattatctcaagttgcagctgaaataagtgcagcccagaagctgtgtacatagcgagggggaattagccttgtccaggaggtctgagaaggcatttcttaggaagtgacaggcgagcagaagaggattatgagaaaaggcagcagcaggggaaaggccctgggagaggagacaacacggcccatcccagagcttggaggaggccaggatggctggtgtgcagcgctgagtggagtgtaatggggatgaggtgggaaatgttgccagagccatctccaggcaggatttgttgttgttgttgttgttgttgttgtttgagacrgagtctctctctgtcatccaggctgtagtgcartggcgccatctcggctcactgcaacctctgcctcccaggttcaagcgattctcctgcctcagcctcccgagtagctgggattataggtgctcgtcaccatgcccagctaactttttgtatttttagtagagacggggtttcactgtgttggccaggctggtctcaaactccagacctcatgattcacccacctcggcctcccaaagtgctgggattacaagtatgagccaccgtgcccagccggtttttgttttaagagcaattggaggccgggtgcagtggctcacgcctgtaatcccagcactttgggaggctgaggccggcagatcacttgagccaagagttcaagaccagcytgggcaacatggtgaaaccccatgtctaccaaaaatacaaaaattagcctgttgtmgtgrcayacacctgtaatcccagctactcgggaggctgaggcaccagaattgcttgaacccgggaggtggaggttgcagtgagctgagatggcgccactgcactccagcctgggtgacagagcgagactgtgtctcaaaaaaaaaacaaacaaacaaaagcaattgaaagcaattggaaatcactgaaatatttttctgtttggtttcttttttatttttgttcttagtgacaagttctgatttacttttggaaaaatcattttataatagctttagtggcacaaacaaatcaacgggaccctgaaaactataatrgctttagtgacactaacaaatcaaagggagcctgaaaatagaagagcacactgtctttttgttgttgttgttgttaattgaccacttcgtaactttttttattcctgctagattttgagtccgtagatgtgttcactccargatgataaccactagctacatgtggctatttaaattaaaatttcatctaattaaactttaatgaagcaaaaagtttatttcctcaatcactcttgccacatccgtagtgctatgcaatggcgcacggctagtcactttcatattgacagtacagatctgtggaacatttttagcatcttaaaaacttcacttggatagcatgtaaaaattgtgatattatagtttttaaaaaataccttgatagttctccaattaacaatgatgaaaatgtacatagtacttgttcaagaaacatttactagaagacaaattaaaagagttaagatatcaacgttcttataaatattattttaagattccttatccaaatgattattgaatatgattaagttgatttaagcctaaatatatacatgaagaggtgacacatttctaaaattgtgttccctttctaattataagctcatatattaattactaatttttttcataatagtcacccatttttcatctttattaacttagaaaattttacttcttatttaaagccctggagcatactttcaaaaatgattttgaaacatgagtctcttcattaggtcaacatttgtctaagcacgtctgtaaatattctgttacaggaagaggaagagtattgagcaaattctcttcaacaatcagacagctctgctttagggactgatatccttccagttcaggaggaagtgtttccaggtaatttccaatgaactccagatgagtaaggtttgacagctgacccacatgaggggacaaattcatcaagctacttttccccaaaggtaaacattgcagctttttgcactgaaacagcccatctggtagcatctcactgttgttgttggytacagcacagtactgcaaattactcagatactggatttcttctggaatgaaggtcaagtggttatagcttagattcaaataatgtagtttgctgcatagsaaaagctgctagggcagattctcaatattaataggaccccaaaagagctgctctaggttagataatgccccagtttrtccaggaatgtaagtaatgttattgtgccataastttaagcaggaaagattctgaagatgctgacagccaatgatctcttccacagttttaaggttattttcctttaggtctaactcatgcaaattattcaggctgaaaatggagtatggaatgcattccaggtcacagctgatcagttctaggcttttcttattgaccatcattttcaagttgttcagcacagccagtttgcttccctcattatcaagggacaattcttcagtgaaggcaagaggtctgcaatgacttgtgggatctgggagaggctactctgcaagtagagggtccttggatattttaagtcctgaaagccgtctaactgcacagtactgaactgttgagggagaacacagcctccctgtrtggggcagaaaagtttctcacataggggaaagataaggttccttcagattcttcaggtgaaatacccagcatgggatttttcccatttcaggatgcttcaggcagaggattttaaaattctgctccaaaaagccagtgcaggatggtctactaccagagatgaatggtccacatctttgaggttgaccagctgtgagacggcagacggcagcttcacctccagggtctgctccaggcttagcacctccatttcggtgaactcaaagacatttgtctggaagactgttgagcataaaaagatgcagttctatcttgtcttggacattttccacaagctaatgtttttcagtttctcaactgtccattcrttactgaggttgatctgtttcagtttgttctcactgacctctgataggaatatggagaagcgtctggaataaaaaggatcatactgattagccagatgaaggatgaaggcaaagtcattcttgacatcagggatgtcactatagttgcttttttctcttaacacctcaaaggaatattgcttcatggatctcctcagcatccaccacagcctgtaggaggaggtcagactgtagagtacatccaaaatggtataaaatgaagccagaaacttcaagatttctgcgaaggaatagacacactggtaggcttatatcctgtaaaagcctacatgtcaactgaacagtcaatttaaagagtgatgtaggttaaaaaatatggaacataagttatgatgagcacaaaatgactttgactattatctgcttcagatacacactataaatgatgtccttctgctctacgtgcatgcggaatcttctcactttttcaaagatggctgtggcctcttgcccctccttcttgtccaggccactggaagttgggctttctataccagctgactccaaagcccgctgcaggtggggcaatgactgctttctggaatctatgtcagttgaacaccctgaggacgaaagcaaaatcttggactcggagagtttcagaggcctcactgactgctcggccactgtttctgacagggtgcaggtggtccgtggagaatcgaagcacttataaaggatggccacaaaatgctcaagcttggagctggtacctggggtagtgaagccataagttgctgcaggctgcaaagaacagtgtgtgcaagagcaccaggtaggggaagaacgttgcaaaccaatggagctgtttctcgtaacagacagcgttgatgtaggagtmctgctgtcagtggaggtcgttctggattccragtgggatcggaaastgatgtcccgggattagaggatgtgtttatgctggctttcaggatgttccaaggcatggtgcaatgattgtcaaattccactttgtaagaagacagcacagaaccctgctctgtgtcagctggagagctccagccagcatgtccacatgatcagcatgatgtaataccagaagacatcctaccatgattttaagatgtgataagatgactgggtgtctgctagtaaacattttagctcggttagtgtaatcatgactttcccttgtaggaggacagaaatataatgaaaaaatattaaataaatcagaaatgcttcaatcaggtgatctataccttttgaagtttcttagacataccatctctgtgtttgtcttcattcctatgaatgctggccaactggaaccctgcaattagtctcaaattgaaaaatttcctgtctttggccacagggtcaatgatggatgaggctaatgagtgtggtattgaaaacacgggggtttcagtacctgtgggccatccaggtagagaggtccagcaggcagctggaaaacaaaccggagccctgtgtgactccagtcccgggccccaggcccacacattcccctccattaccaattttaaaattctgtctttaagttgtcactgtgattgtgattgaataaaatactaggcctttacagaaattaagtggtggtttatatctcccatttcctgtccacaggaagaattactagaaatcctctgtttagttgtctttttgtttgtttctactgagcccatctttcaaggataaacacaaggtgcccgaatgagtatgttccaaaaattatttcagaaaaaaacagcaaataaattacagaaacttaactgcacattatgttctttccaccctttgtttttcatctctgacccactatctgcataggcaagattcttgcctaggcaggaaaaactatgttttttggataagattcatgaggcttttccttgcagtccatctgttgggtcctctgcctgagggcagaaagagctgttctgcaccattaataaaactgctttcctccctttcctatcttatgagctgaactaaactttacaattcttttctaaagtaatttaatactacttttatttaacgrcatatctttcttgatagttgctgcaaaagagaccaactattttcaggattgggggacaatttttcttttctttttttaaaccaactgaagaaagatctaattaaaatatgtttttgcatcaaagggatttgagaattagaaaacaagataaccctcaaaatggagagttctttgcctatattaaatttagtttagattgtgccttgggatgtctgtctgtctatctatccatccatccatgtatttatctgtcttggtctgattatttactgtttgagtccaattagaaaaacaaagctcatactcagtaacttaatcaaaataatttaatataggaaacaaataccaaaagtgttagaagagctaacggtcaaacagggaatggtaggacccttaggcaaccctgagaagagtaacagaaggaagccgctaccacctggagagcaggaagggcaaaagaaaaaggtgatgaaaccagagcttgggagctagggcttcgctgtagcagctgggaccctgggcagatgcagccactgcaggggtcccacccggagcagggaggacaaggtagatacattctgatttctcctttcctcccaccctccartgttctctttcctgttggcctctcctggtctgatgcttggagtctgggagtctgggaartgtagtagtcaaagttacttctctgagttggcggatcaaaagaaaaggcagtaacacaacttgggtttcttgggaaacagactattagatggaaatgagcatgcctgggatttcattagagtatgttcttgagatcagcacctgtggaaggcaagacaaggaattggggtcatacagaggatgactgtgagctgcagtgctcattgggtgtgatgctctttggaggctgtgcacctgtggaaggcaacgcaagaaagtagggctgtgcagagggtgaaggtgagctgcaatgctcagtggatgtgatgytcattggaggctatgcccactctacggaccttcttaaactagtgggagaccctctagagtggtccaggagggggcaagctgccccaggaaggaggagagactttgggcaaagcggctgtctttagctgagacactccctataggtgaccactcccagcagctggaggagcagtggtgcctttatctctgaaggggagtccaggcacctgaccacagtgcccatcacaggcagggaaaggatgtgaaagcactgtctgcacattgttgatttaaaaaaatcatacattgatgaaatgtaaaaagtgaaagttcagtttgcctttttaacttaattctgtttatgatttacatatttccatgtcccagcctgttgatctacctaaattaaaatatgtatattttaaaagatttattgataagataagaaaatgtttacaaaatagtattacatgcaaaaagatgaaacaaaaattgtatatagaatcatttctcagttatatatgtatatgggtttgagtgtgtaaatgcatttaaamcaataataaaaaaaatagggccaggstgggtggctcacgcctgtaatcccagcattctggaaggccgaggtgggtggattgcttgagctcaggagttcaagaccagccgtggcaacatgatgaaaccactgtctctaccaaaaatacggaaaattagctgggcatagtggcatgtacctgtagtcccagctactcgagaggctgagatgggaggatcacttgagcctgggaggtggaggttgcagtgagccaagatcatgccactgcactccagcctgggcaacagtgtgacagcccatytytcaaaaaaaaaaaaaaaaaaaaaaaraaargaaaatagatmaaaaaattttaaaaatgaaatggaatttttttggtagaataatatggattcatgcctgtttctsttttctcttttttctttttcctttcaataaacatactgtttgagaatagttctagatttacagaaaagctgtgaagcttgtgcagagttccatatactccatgcccaattcctctgtcattaacatcttacattagtaaggtccatttgttacagctcatgaatcaacagtgatacatgattattaactaaagtccatactttattcagaattacttgtttttyccctaatgtcttttttkktttttttgttccagtaccccatccaggaataccacattacactgagttgtcaggcctccttaggcttttcttggcgaagcgtctcagactttccttgtttttgatgaccttgacagttttaaagagtatgagtcatgtattttgtggaatgtccttcaactgggatttgtctaatgtttttctcatgattatacttgactgacgtatttttgggaagcacatgacagatggtaaagtgccattcttaactcatcatttcaagagtatctgctattaatgctattaataggtcttgtcattgatgatgttaaccttgactacccrgctgaggtagtctttttcaggtttctttgctgtaaagatactcttttttgtccctttccatactgtacctttggtagagagttacattccacctccttgatggtggagtatctgcataaattatttggaattcttctgaattggraatttgttctcccccttatatttatttattcagtctttttcagtatggagtcattaatgkctattttatactttgaattataamccagtactctgtttttcatgtttttgcttaacttgttccagccatggccacttgkcagttaatttctgtgaccctttgacgtgtgtgtgtttgtaagtgtttagcacttccttactttctggccctacaggatgttccaggcttttaggttcycttgacttgyttttttttttccttacagatttcttaatattatataaccataaaactagtgtgtataatcaaaagtcagtttctccaccctgcaaattaggagtggacttacataaacctttgtgcctgaactctgtgcatttcccagaggtgggcatcacaccacccatgcctccattgcactatatgtgtggattagttttcagacatctccctttctccaatgaagtgataaataaccaggttattccctcagaatgaagctggccagatgtgcactttaccttgggaatgatttaggcataagatctgggagaaggagaaaggcaagcatgcttcctcaggtgggcagggagccatcttggtttgtgtgaccaacttgataaattcatctctgttcagcacctggtcatcagctctgtaaactcaaaaatctctcatagtttttggtgtgtcaggagtccacgaaaggcttgactggacctgtgtgaatcagggtctttcatgcagctgcagttagatggtgacttagagttggaacagcaagggctggggcatttaggggctggccaggcatctttctgtctcttcwtgcagtcttagggcctccccatgtggtctctgtgcacggaatggttgggattcctcatagcatggtggcctccgtgtaagggtaactgcttacatggaggctgaaggctttaagagcaagtattccagtgatgggtctacataagtttaaaataattggatagtattttatgttgtttggatttaccaaattatatttgctccatgatttataaacagaaatttaggttatttgcaagtttttgcaattccaaacactgctacaataaatatctctgtgtgcatatctttgtgtgcttatgtgattatttctagcagataatagaaatggaattgcaagagtggtaaatatgcacactttgaatttaggtagattcattgaaatgaccttttagaaaggaacttacacttctgtgaaggcagtgtgaaagaatctatttctccttatgtgcttgtcagagcttgtgattatcagtctttttaatgtttgttcattttgttgggtaggaaagggactcattgatttgtagttctttgattttttttaatgaaaatgaatgtttyatatttttattagctattttctttaaatagttggtttattacttttggtatttttaaaaattggattttttttctacttgatttttataccctattatctattgtcatgtaccaaaaatgtcttatccttgttcccccatcccaatgtggtggatttttgtttttttggctttacaggaatttccaatttttatgaactcaaatgtatcaacttttccattatcatttttggattttgtgtcatacttgtaaagcaaaattgtaaaaatatttgctcatcttttcttctggtgattttattttatacctttaaacatttgctccatttgccattgtattttgttatcaggaaagagagagaaattttgtttactaagcacttcaagatcttttttctcaatagattgcttttcttaagatgctgaagtaaatcagtacaatagataaagaccacaaaaacagcattttgygacrgtgacagtcctactgaagacaggagacagttaaaaccatcagaccaagaacagaggagtgsatatttaataattctrtgattacttctgggggttaactatctgtgaatctaaatagaagttccagtggctggaggctgtatctgaggagggaccctttagccttttaaagagtgattctgctgtgcagttgaggtgttttctgtcactctccttattgatgaaakgcttgtgtctcaagatacaatgacggtctacaagtcatggagtgaaggtgaacatgaaagctcaatgaaaccattactttatactatgagatggatgttttattctttgacctttaacttcagagagaaatgacctgtgaaagcacttggtgagatcttagtaaagaagtgatttgcccactgaggcagaagttataggtgctggttaarttttatctttttctttgaaaatgtttggtacttattgaaacaaaaatgaatgagcatgacagaagaggagaataattgccctagaaatatcagctgtctggagggcttgcagaaacccaggaaagatttcaaatataaagggcctgctgcaggtgagtttctggccccttttctgctttgcctggggaagtaaggctcctgggctggtgttacaggagcatctcaagacaagcttctcattctaatagcctgtgttcaaccaagaatcttatgcatgtacatatttgaggtaatagtcttttttttttttttttttctgagatggagtctcactctgtcgcccacgctggagtgcagtggcgtgatctcagcccattgcaacctccgcctcctgggttcaagcagttctcctgccttaggcccctgagttgctaggattacaggcgtgtgccactacgcccagctaattttttttttgtatttttagtagagacggggtttcaccattttagtagagacggggtttcaccatgttggccaggctggtctcgaactcctgacttcgtgatctgccctccttggcctcccaaagagctgggattacaggcgtgagccaccgcgcccagctgaggtaatagtctttaagagaagagggtacaggatgtagggtcaggggttattcaaataaaggtatgattagtttccagagagaagtaaatttgtagacattttacatttattagggaccatagaaaatatttagtccaactctttttgtttattgataaagggacataaataatgtaactttctcaagatcacaaagctccaaaagtaatacatgtcttaattcagatatgaaaccattgagagttactggtctctttgtgattatggtcacgatttcaccaaacttatatttttaattgaatatggctggaattttartgtgtaatttacttacagtttaagtggtaaaatatgaatcattcctgctttcttaagccagtcttttaatttgatgtttcattttaacctttccttctaaaaaaattattttgtcaattgtcattaccagctcccatgagttactgataggagttttctttgagtctgttcttcaaatgcttatttatcaggataattaattaaaaagaggaatgatgtaatgattatttgcttaaatatcaggcgtactaaaatatctttttctggattactaattttagtttggagaagaatctgatagttttattttcccaagatactagtccaaccaaatctatactatgtttatctaaaataattgtttatttttatttttattatttttttcttcaacttctattttaaattcagtggtacatgtgcagaatgtgcaggtttgtttcataggtgaacatgtgccatggtggtttcccgtacagatcatcccatcacccaggtattaagcccagcatccattagctattcttcctgatgctttccctccctgcacccctgacaggcccagtgtgtgttgttcccccctcatgtgtccatgtgttctcatcatttaaagtaattgttttgagctgcaattttctattaccagtgactcctaacattatattagatttaggggattgtgttctctttcatgtacatcatatcatacttgaaaattaaaaaaatatacttgtgattatcttaatttttcatttaaagaaaggttaaaggcccagatcccctaagtgacatatgggsaccacttaaggatttccatttcgtgtcgtaatygtaaaacttctcaaccttctctgactttatttctcttgtcttctgttcttttaaaagaaagatgtgacagaaagcacaaaagatccccaaaaagagtgtgtggttttcttttttttttttgagatggagttttgttcttgctgcccaggctggagtgcaatggagtgatctcagtttactgcaacctctgcctcctgggttcaagcgattctcctgcctcagcctccctagtagctgggattacaggcacccactgccatgcctggctaattttttgtatttttagtagagacagggtttcaccatgttggtcaggctggtcttgaactcctgacctcaggtgatctgcccgcctcagcctcccaaagtgctgggattacatgtgtgagtcaccacacccagccgagtgtgtgtgtgtgtgtgtgtgttttaatgaatactgttctctttattcacagttagcatccacttagacaaaatcttattgttctctttattcacaattagaatccacttagataaaatctattaaactcagcctgctactgattttccccacttaccaaataatagaagaacttggcgtttttttaaatgcacgagattcatgacactgacacaaattagaagcaagtactgtttgacatgatggcatacgtccagcaatttcattaatcattattgtaaaaaaatgggttgatggtggattcttggaaagtcaaacaaaattgctgtgataagtctttgaagcatgtttttgtggactcctgtcttaacattactcattttaaagccaatattcttccttttatgtttatggaaagtgcggtactggcatccatagggcagagattgtttttatccatagaagcaggaatccctttttagggaaagtgcttgtgaccttagcttgcttagagctcatgcagagaggtcctagacgtgctttagcagctgggcttgagcaggtagtgacaagtactaccttatgtgtggatctgtgcagaggcaaaggaaaccagtagggttcccctctgttatgttgccattagcctactgattgcttcttgtcaatctttacaagcagtggtttggtaataaatgaccttgtccaccaagaacaagagtgagttttctagcttatttggggttcctgttgtcattgtgtgtgtgtgtgtgtgtgtgtgtgtgtgtgtgtgtgtgtgtgkagtttgataaattacttaaaagtttataaaggccagacacgatggctcatgcctgtaatcccagcactttgggaggccaaggcgggcagatcacctgaggtcaggagttwgagaccatcctggccaacatggtgaaaccccgtctctactaaaaatacaaaacttagccgggtgtggtggcgcatgcctgtagtcccagccactcgggaggctgaagcaggagaatcgtttgaacctgggaggcggaggttgcagtgagctctcatcactgtactccagcctgggtgacagtgtgagactctgtctcaaaaaaaaaaaaaaaaaaaaaaacccaaccagccaaccaaacaaacaaaccaaagtttataaaataactcttccattacttctttactacttccccttccttctatcattgtcattttcaacctatgccagctgtaagttgataggtattcctataatgatttctgtgaatcttgaaacctgttaatgagataataaatattactattcccataattgccaagctgacataattatgaggatgtagggcattctgctctaagacaattatcatagtagatgttcccaggcatcacataggcaggcattaatatttaatctttagtgtcttctaccatgtctcttttgctcttaaatcattgagttaattttattcattttatttttcatttctagaaattttatttttttaytttctagatcttttttaaaataatatactgttttctgttactattatctatcttgccttatttcttattttgaacagtatttgaataaatgacaattcaagaactcatgaaagacaccaatytttagatwcaggtagcttattgaatcttaagtagaatagataaaataaatatatgttgacaacagaataacattgtagaacacaaagttgaaaataaaaaagtttaaagctattagagaaaataagacagattcacttcaaaaggatgatagtctgatgactggattctcagtggtgatgattaaagcataaggtagtgtaatgatatcatcactgtgccaaaagaaaataattgccaaactggaatttgcatatccagtagaaatatctttcaaaaacaagaataaaccaaagacatgtgcagactaacgaatactgagagagtctgctatcaggaagaatctaaaagatgtactttaggctgatgattccagatgaaagctgagaagaaaaaatgcataaagaaagtggtaaatatttggtaagtttaaatgaacttataaaacaatgatgtctaaaggggtttacaagttagatagtaatattaaaagaaaagtctgaaaagctataatctaagcatccatattaacagtaagaaaaaaaaaaacccgaaacccagaacattaagcctagatatggaaggaaagaaaaataagagtaagaccagaaattaataaaataacaataagcatacaaaagaaaagataagattactcctggttagcctgattaagtaaaaaacagacaaaaaagggtggcagtacaaatcatatcaagaatgaaaaagaacacaaatagagatgctgcaggcattgaaagtataacaaagggttattataaacaactttataaccatatgtttgaaaaggtaggtgaaatgaaaaattacaagaaaaaatacaacttatcaaaattactcaagaacaattagaaaatctaagtaattctctagcccatgaagagattgaaccacaaattaataaacttcttacacagatttttctaggcccagatatgttctccactgagttcttctaaacctccaaggagaaacgaactctaatcttaccatccttacagcctagtttatgaagttagcatggcctttcacttgaagatctttttactgtygttgtcctggaattttgcagtgatgtgaatcggtatgagccttcttctatgatttattattttggatacttgatattaggactctttgatgtgaagttttgtatatgtctttttgaatcccattgaatatacttaataagatgtctttttatttctattttttttttctattcccctctcccctttaccrttctgtgttgatcttagacttttgtcttaggcttacctccartgactggtgaatcatggtggttcatttatatttaaggatgagagattaggtagatttcatggagctttgagtattcaggcagaatttgtttattgaagtttgcttaaggtaaataggcagagaaggagcttactgttatgctgagracccctaaaatgccagaatgaggaagagtttactctgggtcactaatacccacattagtcctgtggttgtcctgtgtactgattccaaaagtacatgggtccattggagaaactttggaaaataaatataaacactaagaagatgacaaaataacttgtaagcccatccatcaagtgtagatttatgtataaccaaaaattgggaccatattacccattctgttttatcatctgttctttatacccaataatgtgtcatttttccatgtcaattaaatattcttctaaatcatggctgtataacagttatatacagccatatatacagttatatacagttatatacagttatatacagaaggctgtataacagttatataaatggtctatatttctttagctattttcctactcttggacattatgtgtatgtctattttttcttatacatagtactgtaatgtatatatttacatctaaatatttgtacatactttcttaaccttagtataaactcccagaagtgcaaataatatagatgttttatggcatttgttttaggatttttcacagctacttgtacccaaaatgcttgaatcagtctagggctgcaatatattaaaagtgcagatagatatgaatctgtagaaatctctaatatattaatacaaattggtgtttacatggattcccttttcagtagcatgggctggaaggccactgtatacctataactaaaatgtctagtgccatcatttcctgcaaaataatttgttgtatttcttctcagattccttgctcctgcatggtcttcagctactgttgaaaacagattactgtagaactaaaacaaaaaaaggaaaaatgttaatgcactggtttatggcatttaagaaaataggaactaggctgtcgtacagttgacaaacattggtaaagttgtactatccctttggaagaatccgtagtgggcccagtcctttcagtgattggatacttctagtaggaactaccatttattcagtaaccctatgccctcgtcaccaatctaggcatgttttgtacattccgccgaaggctcctgccaactttgtgaggtgggtattatcaccacgtcatagatttaaaaatgaggcttagtgaggatttgaaacattccctactttcacagctgctggttgtctagaagtcagaagaatgcaagccgcctgagaccactgcagttgttttgtgcacaggtgtctctcccgcactaggtcagtgcttgagatgtagtaggatctcaagaaatatttgttcaatgctgaataatgaattgaaaggtggaatttgaaycaaagtcattttgaacttgaagctctttctaccaggcaggtgtcaatttctttagttttagtgtttcactgagagattgtgagatttgtccctatgtgatgtgcttgttcagtgctggatgtcccttttcctgattttcatgtgactagttatgtaaagggcttcacatcaagtttcactgcagtttcagaggatcttcttcagataaatctagcgtaactaaaatgatactgagtgcataagagaccaagcatgcatgaacaactgcttgagtggacttaggaactttttttagaagagattctaacttctgctttgagcttttgtaatgctccaaagttcttcaggaatgtgttgtctttgaatctccctttgaatatcttgtagaagtttcttggcactggatttactcaataggatcgaatccccatcctccagcaaacgaaatcccgtgaagactcccagcacsaggctggtctgaatcctcacagttctttttcagaaagcatgcaactttggtcaaagatcagaggactgataggcaatgtagtcagctgattcatttcaaatggcactttcataccgtctgacacattggaataccacatccagcaatctaccatttcctaaacaaaattttgtgtgtatatttgttgtaggtatcttttatgtaatgcagacacaatgtcacttaacaaactgactctgtcagcttagatgaggaaaattaggggatttatggtttctccccatttatgtttaattaaatcacagcttgctgatgttcagcttaacgattatttgttgaatgtttactttgtgcaaggcaccatgctagatgtggaaaacacagggttgaataaataaatccatgcctctcgggaactcacagtctagtcagagacagacaaatcttatggagcatggtaagagctgcagtaactaggggtgagggaagacctagagaaacatggtgctagcatctcctcggtgaggagggtctagcaagtccaagdcctcatttcccaccggactcataacatagccttccacaatgatcccaagggatcgttctgggattattaaatccagtcctgtcactttcatatttcagcgcctgaacacactccactgaccgcccgcaggctgcctcaggacccatttgttccctcccttttccctccagccccttcccttcccactcctacctgcctcctttacactctgcctgcctaggttcaaatcttgctgtggatgcttatcaacccccggtccttggcaagttactaacctctgtagctcaccttccttaaactgtgttaatcgtaatctgtcttgtgatgttatagtttggattaaatgatttaatataaaactcttagaaaagtgcccggcacgtaggaattactagagaagtgacagccatgattgttgttgttattttctccttcccaggctggtgttgtctttcctacctctgtggctttgcatgaagcaccatggcgtatatatggtcaccactatgtcatttcttaggttgcttctaactatgtcatatctttatcatcagcctatggcatcattccagagttgttgttgcctttattagatttataaactctgacattaggacttcacygcaaattattttttttttttgtatttccccacagaatctaaatacattgcatcttgcagatactcaaacctttgtttactgacagagggagaggtccctttttctccaaatctctctttgtaaagccttttgaaacccttttcttcttttctgctctccactgtgttgttagtatgttagcattttttacatgtttctactgaagtccattgcaatcattcgttctaatgcttcccccggccaacttcctttgtttctctgtaagggtaggagttgttttatttgtatctctggtctttagtacagggactgcacattgtggacactcgtatttcaatgaatgcctgatacagaaagaataatacacatgatattaatgccattgtatttgagggaattggtgagggaaaaaaattttttttttagtatttcttttgactcactaaatgtctaagaactaatgatttagttaactaaagaagcaggaaactccaaatattccaaaaactttgcttttactttctgtctcccagtttcttgttttctaagataagatgtatttctatggtttcttagaaaatattaaaatttgaaaaatacctaaattgttatggagattaaaatggatggtagattatgatattgatgagttaaactgctttgacaggaaaattcaaactaaattaggtttcacagctctgaaaattattgaaggggaatttcctactaaaaatcattctgattaggtgttttgtaacaaagtagtagatattctaaatttcatcttttatggatgtgactgtcaatgagaaatgatcatttctattgtcatacttttgtttcagttctatgctatgcctcatcttataaaaggtaaatcaagaacttctttttaataatgaagaggtgatttttaaaagtcagcatgtgtcttcagctacttaacaagaggataaagagctatatataaaccatgtgtattttaaaccaatggttaccatttaaatgcttgcttaccacctagtctttccatagtagttttcctgtccatctagttcttctactcatawactcatatccaatttgtcctgcccctttcagccattccacccatgccttaattctcttatccccttttgtattctgttttccccacctttccctctcccagggcatgtcgtcttttttttttttttyccccattttcccacttccactcttagaatttcaggccattcaagtttgttatattccatgatttcagattaagctgggctcccagagctggagggtctttttactcttccctcgttgacagtctttgttgtcgccactggtttgttgccatctttcacatgggatgccctaagccctctctattccttccacrctcccacccagatgcttcttacttggccaagaagattgaagaggttcctcatcagctgtttctagcttcctgttgctataccttagtttgttttgtgtgtgtatgtggtgtttttgtgtgtgtgtgtatatcttcctctcagccttctgacatgcctatctctgagcctaaccctctgagagtattttattgtataagtaaaatatgacttgttcaaccagcttccttaaaatgagcttaggttgttcctagtttttttgttcatttgttttatgaatacagttttgaaataaacaccttggacaactattttggccacttgtgagagtacagttagtactagctttgcatgattctctgacatgcacaaatttcagttaccacagtttaattaaataaaaccagctcccaacaacatagttcaaatttcatttaccaagatatattaactgtgagtaattgcgtaaagtacaaactttgctgctagctcatcagtccacaaatcactgtgcaaatagcaagtgcaagttatggtcagtgaccaattgcatcatttctttcaaaatctgccagtgattagcccataggcatcttttagtcagttcatgcacagacagcaaaagcatgtagttgtgttgttgctgctttgcctctcagaggtaaacctatatgacgttttcaaaaagtggataattgaaaaagtgaatgaactgatgaagaatgaaagtaaagtaaagaaaagaaaggaggtaataatgctggaagtgaaattgaagtcaaagtaaatggagttatggaagaaacagctaaccgtgggaatgctaacactgccatggtgcaatagactccagatatgaagccagaggagtctagtgaagctgaattttttgacataaatgaggagagtggttgtgagaaaaagaatgaagatatcccagagggagtgacactgccacaaaacttcctcttggagacatttcataatgttgaaggtgcaaagcttatgtgaaaacattggaaactgatctaaacttagaaaggaatatggaatatgacaattctccaaggcacagaaaatattctcactctgtattgtgagttatgtgatagatgagaagaaggtaagtactgtttggactattctagataagtttacagataaatacaatttcaattcttcatggtttttttttttttttttttttttttttttccttgaracaragtttcactgtgtcscccaggctggagtgcagtggtgcgatcttggctcactgcaacctytgcctcagcctcccragtagctgggattacaggagcctaccactgcacctggctaatttttgtatttttggtararacggggtttcaccatcttggccaggctggtctttaactcctgacctcgtgatccacctgccttggcctcccagcgtgctgggattataggcatgagccaccgtgcctggccaattcttcatgtttttaatgttttaaattataatacactaaatatagatgttttactatgttttattttcttatacatttataattgacagtaaaacagtttttgttgttgttttggcttgtttttttttttttttytaattttttttgagcatcttgctctgtcgcccaggctggagtgcagtggtgcgatctgtgctcactgcaacctccgcctcccgggttcaagcgattctcctgtctaagcgcccccgagcagcagggattataggcgtgcatcaccatgctgggctaattttttgtatttttagtagagatggggtttcaccatgttgaccaggctggtctcaaactcctggcctgaagtgatccccccacctcagcctctcaaagtgcctggccgtttgtgatgtttttgatagatatttttagagattatctttccatatagttgtgtcagtttacaccaccatcagaagtttaggagaatccattactattctcttctgataccttgttctgcttatttgcccttgttgacttgctcaagctcttcctctgatacctccttattttaaggaatatacacacacacacaaagaaaaacacatgtttttgcatccttaaagaaggctaaccttttgctttctttgcaaaaactcttcctttcttttatccattttattttgaagtaagtaagacctgctgcctcactttccttaccattcacttcctcttaagtctttgcagtcacttgacagtaggcacctcgagagcagaggtcatgtctgttttattactgaatgtccagtacatagtcmgtactcaatactcttcatctgaaggaatgaattcttataaaagcctccaccaaccatctacttggtcctattcacccattcctcctgtctctattatctcttcaccttagctttccggaaatactacaccatctttccatacctccacccattgkccattcccgtttgcattttcttggtttcagctaagataggctgttcattatttatctgccaccttccatgtgcctgccttcstggaacccttctttatgctgccctttctcctagaagtttgctgtgttctgtcctctctttccttcctccagttccacctggcaacatcacgccatcatttcccccccattcagagccatgccaaaagcttgctctaggaaactctttckgatctccctctccctaaccaccccaacctttctccttctttaaacaactgtagaactttgcaggcggtttgtagggcctaccaaatatgggccactgatgtgctgtttttaacttctcctacccaagtagaaaccccttgagctatctcttattttttccttcagtgtataacagtctttgcgcatcattggtactcaattaatattttattgaggtgccctgtaatctgacattccagggagctttcaaggaaactttgtcacactaaaaaaaattgaggattgttttgtgggttattcygctcctttgtcttctaactcacagaagttctgtcatggttcttaggggttgtagggtgtgtccacttattttaaaatgtcaaagaccagaagagtggagaatgggaaagtggcaaagtgttagcactggaaagatgtttagagatcacgtagtccaacccttaaattttatagatgaataaactggtatctagaaagcttaagtgacctgcctgaaatcacacaactagtttgtggtaacacttggtccaggaggttgtcagctgaccctcttcagggctcgttcccacaaggtaccacagtacatgtgaggatgttaggtttgggtttgtgtagaactgttaaaagaggcatataatattccacatattgcctttaatggattratacataggaaatccagactctgtaaatagttttctctctctttcccttaataattataatttttatgactaattcatttatactaactaggagagtttctaattacattaacattggatggtatagaatggttggttgacatttgagtaaactttttattaaagtataaaatacagaaatgtatacaaatcacaagtgtatagttggaattttcaaaaagtgaacacatctacgtgactagccccagactggaaaaaagaacagcaccaaaaagtttagaaacatttaaagcaataaaacatttggagaaataaaaggattttaaaactatataaggccaggcctagtggctcttgcctataatccccccactttgggaggctgaggcaggaggatcccttgatgccaggatttcgaggttacagtgaactatgatcatgccactgtaccctagcctgggtaacagagtaagacactatctctaaaaataaaaaataagataaaatattttttaaaaaagaaaccatgtaattttctcttttctccctacaggtattgtcagtatgtgtgttaacaacaatacttggttgtatatttgggttgaaaccaagctgtgccaaagaaggtaattagktgtgtgtgtgtgtgtgtgtgtgtgtgtgtgtgtgtatgtgtgtgcacagccttattaagaatgtgattgaggtaaacattatctcctattcctatgggtactccatagatattgtcaattcaacgctggcttgagcctttttcctgaagttcttgtattatattagtcatataaagttctacttacaaaacatggccgggggttctgatgctgttgtcctggagcccatgctccctgacttcctccagggactcagaggacattctttactgctcttttaccctaaggagttagttgctgaagcaaccctgtaggttactaggtgacagttaccatccctgggcaaccagaaacctgtcagtwtgtgctcttaaggttctaaaattgcagacattggttgtttcaaagccacaatgatatttttttaaacttctagatatatttttctttccatcaattgcagaaatctatccagcattgacaagattataataaataattaaactggatcacagtaaatcgtagtggttattatcttgtctttgaggtagttccccccmcatccyctcgcaataaaatcattgatggtcattctagagaattcagctttgaaaattgaacaggttcttctgtttggctattctgtgattgtaatattaattatttaaaaaatttttagtgattattaagctatcatgtactgttgaaaagtagtaattttatgtatcagtaaactattcagaacacatgtatctaagtttaactgaagtaaacagttacagactttagtgtttacctatgtcatcttttagcatgaagtgattcactcctgagttgacacatacaaattaaaaatgaaaaataacaattttaatccaagcccaacatagtatgcatcatatttttaaaaattattaggtgcatattaatgagctccaagtaatagctattattccaatagacttccctgacccccactccaggtcaggaaagttcgtatttctgacactagaaattattattgttacttcatcttcttaaaattgcctgatttcccagtgtcaaatgagaggtaaattccatggcagtgtctttttgggtcagaacaccattaaagtcaagaactaagattatttcttttttgttgttgttggatgtcccttattttccatgtgttcctttttttctttttttctcattgtcctaattttctagctctccagtgaaacctggcttattcaaggtatctagtaatgaacttcaacagtaaaaaactgtcatgaaaagtactttcctcccatgtctaccatttattcatttagcaaaaatgtgctaatctcaactatatggcatgcacctggctgggttttagggagacagtatgctgggcaaagccagatgtggtcttggtttgccgtctaactgggatattaaccaaataacctagttacgtgtggaattaagtaattgaggggaaggacaaggttttatatgagcttaaaaaaatggaaatcaggcctagctggggagttaggaaagctttttagagggagccagtctggatctaaaggtgaaatgggtgtttcaggtcagggagggaagagctatgccagggagcatgttctgaacaaacccactacttctttacaccaggattgagagtgaggcaggctaggtaatcttttcctttctaaaatattcttaaccacttctaaaaaaaatttttcccacattttgaaattttagggaaccccatgcctgcttaagccaactttttcatagcacaaagtattcagaacaagcctttattctgacttttattttatcacaccatggttatttaagtcttatcagacccagtaacgtttgtaataataatcattaaaaagttatctttctttcctacatcaggagataaaaatcacaaaccaggcacataaggttactttctgtttgtatcactttttgtgtgtatttgtgaaaagatttttgccttactttattaccccatctgtattttctaaagtagtatttgaacctagtgtacacctaacttagttgtattcrttgatgtttactttgaattatataatgattagaaacatctgacttatcgttcaattttttcagttaaaagttgcaaaggtcgctgtttcgagagaacatttgggaactgtcgctgtgatgctgccygtgttgagcttggaaactgctgtttagattaccaggagacgtgcatagaaccaggtaaggatgagcagggaaaaaagtggagttatggtcattaggaaaagatcaaggaaagttctgtgtctttcaggtatgtgatttacctaattcatttgaattttttttagtttagcatacatacacgttttgacattagcttttatattttctttcaacagttccttaagagaaaaaaatttacagaatttctctgttaaacattttatggatagcagaactttgtctatttttaatgtatgctgaaagcctttgtaatctaatttgcattcaaattctaaaagcctgcttgaaatatagaaatattttcattatggttctttgacggcaagagatcttatatgtccacctatatttttcaaaataaaactatcagaatatgaaaattttcttagttagatttggaattctctgcatatgacatggaataatttttaaatgagagagatttatttatttttcattagtatttattttttaaagacagggacttgttctgtcacccaggctggagagccgttgctcgaccatggctcgttgcaaccttgaactcctgggctcaagagatcctcctgcctcagcctcccaagtagctggaactacaggctcacaccattatgcccagctaatttttaaaatgtttgtagagatgaggtctcactacattgcccaggttgatcccaaactcctggcctcaagcaatcctctcaccttgacctgagagtcagacttagattaaattttagcaggtagaagaagccaggtctacatatgaattgcatatggtaaggtgcatctaaatttgaaaatgacaaaattctggacttttagtgaaataataataattggttcctacatattttaccccattagttcagagtggccatggtagtggcagattctgtgagtgactaagagctgtgaaattgttcattgttgctcatggatcatactcaggaagacagcaattctgtgttcactttggacatgttgaatttgagacataaaacacattttgctgatgtttgtttctagaacatatatggacttgcaacaaattcaggtgtggtgagaaaaggttgaccagaagcctctgtgcctgttcagatgactgcmaggacmagggcgactgctgcatcarctacagttctgtgtgtcaaggtcaggtgctcgttgggctctgcagcagcctggtatcttccagcgtcttagcggggctttacataggtgttatcttttatattaggagtcatggctattggccaactatattagctgaaaaaaataattttaaaactttttattaaagaaacttttaaacatacacatggggagagagagtatgtaatgaacrttayacccatcacccagcttcataattatgattatgtrcacacggccaataatattttatctataaccactcattcccctgccaccaccctctcatgttattttgataatagcagcacacttgatgttgtatttgtggaaagatccctcttacagtcctggctgacttttatgtcccggcttccctcctagtaaatggggacactgtctgctgtgcattgagagagtcgatgtgaaattgtttagaaagattcgagggcattttgtaaggtgatactattrtgatgtcttgtccaggtattattattatttttttttcaaatttcttgacagaacytgactctatatgagagagaactaagacaccaaaataccaaggattttgatgagtggatagaaggggagggttgtaaattttggctgaaaatattaagaatttgaaaatggaaaagataccttcaagttctcacaaatacagtagtatgttttagtcttacaattgtgcatccatttttaattcctgatatcaactaactcttattttgaagcacaataattctctttattgattatacacctccagagtcatgtcctgtgttatctatcaatctgttcacatactttgtttttggaatctgtcttaatgtgtctcacaagcatcacaattattattactgttaagtgtgttcattttattttcttgaaaatattttaggtgagaaaagttgggtagaagaaccatgtgagagcattaatgagccacagtgcccagcagggtaagattatattctgaggtattaattttttcttttttagaagtacagcatcatttttttctttccaaattaagatgataaaaataataaaatcactggtttattaaacattacaggttgagtatcctttatccaaaatgtttggtatgagaactgttttggattttggacttttttggattttgcaatatttgagttataccagtttgggcatctcaaatctgaaaatcccaaatgctccagtgagcatttcctttgagcatcatgtcagtgctcaaaagttttggattttgaagcatttgagatgtcagattttcagatttgggatgcccaacctgtatttttagccagatcttgtgtttggcaatggtggaacagagatgattatggagttatccctattctggaagtttatagaaaaaagagaggccatgaatatttagtctttggtattgaagaatgctagataaaaatatttgcattttccttttcaggaaggaaggatctttacttttatttggagtttttagagctgctaaacttgtagaaaatttagcttctttttttttttgtattttggtccatttatacatttttgggataacaacctatttgtgagagatgatacatttttttaaaataattcatatttggtttttttgtccttcagatattttgtacagggtcttccakatatgacaccatcaaaaagagtatgtgtggaatttaaagggtgaagattttataaaggtgttaagtgtatttatctttgttccatttgaggtctaccatctcatacatttgaattactcatcttcagaaatgtatttttacctctttaaaatgatagttttcccagactattaaaatttttaagctgtattttagttcattttgttcatgtatgtaatttttgttatatgtcttcttttttttcttttggaaggaaaagtacttttgatttaaataagcagtagcaacagcagccaaaactaaacctcaaccaaataatttcaacagaagagcctttttttaaggaaaattttcatgtacsctaaactgtcttttaaatccaaggaatactgggaatgttagacttagtgaatttcaaatctttctttttcttctaaatattgcttataatttttcagttgtaatattgaatcttttagtggaaaacataaccctttctttacaagaagattgtaacttaggacacttattattacactggataatttaccagtaygtttaygtgatggcccactaacctgcttttatgatttctgttgattgaataaaactagttttgtatggaccgttaagactatatacactggttctacagagtctctcagtggagctatgttacagatagtagctagtgaaaattgtataaaaatgttctccttgtggggttgcttttgtgtttgtgtgtgagggtaaggtgggaggaggcagagttgaaaaggcaaggtaaggtatttcctgtcaagttttaaatttactgagtaaactttcagtgggaagtctaacagttatccagtgttatasaagttccctaccacctaccatgtatcactagatgctgaaaaatttctgagccatggccgttttggggtagccacatggccattgtccatagctattctcgtttgtcaagtatattagcatcctctgtggkttttggcctcctttttgaaatttccacactacacgttaactgtttgtatatgtatgtatgtgttgttgaaacctcattgatcattcccagctttgaattatttctttgttgtttatatatttaaatatagtatctctcaaacttttgtattaagtatttatatcttttaaatatattaagcctaaaaactaaatacagtatataggcttggtgggtggctcacacctgtaatcctaacactttgggaggccgaggtgggaagattgcttgagcctaggagttcgagaccagcctgggcaacatagtgagacctcatgtctacaaaaaataaataaataaataaattagccaggcatggtggtgcgtgtttgtagtcccagctacttgggagggtgaggcagaaggatcatttgagcccaggaggttgaagctgcagtgagctgtgatagcgccactgcacggcagcctgaggaacagagtgagactctgtctcaaaaataaaataataaaataaattaaataataaaatagtgtgtaatgtatatactatatgaagtactatttactgtattagagtccatatcagaaagtggtggttcaggaagaatatttatggaaatattatatgctgttgttttttattgtttattttcctgcaaattgggaaaacaatattatattttagtagcaattggtgtagcttttggaacagcaggaaccatgaatgatgtttctgtatggtggctcaaaatgatatgaatgcttaatatatactatgtgatgatatatatgtattacgaaatgatagagcttgtatataaatataaatgcatgtaaaacgtactttataagtatgcttgccgactttgttagttagttttcttaagatcacacagaccttagtggaaaatcttcactggacctgtgccaagaagggggtacatcttcattggatatgtcttgtctttgcttctttaaacatttttktttctttttcattacccaggtttgaaacgcctcctaccctcttattttctttggatggattcagggcagaatatttacacacttggggtggacttcttcctgttattagcaaactaagtgagtaacttcagagtttactgctggaatatcaccatttcagtgagattgactaggcaggcagtctttcttggaaaagtactggcagaacctaactgtttcactaaacttttctatggcaaagtagttgaaccttgtgtaaggcgcttatctttaatagtgtgattactctgaagctgcccttcaaaaaaataagttaatatagttatcttcgaattttaacctttggccatttttatatgtatttattctttctcagaattttgaattccttgtgaaaaagtcccttgtttatttattttacaaatattattatttttgagactgagtctcactctgtcgcccaggctggagtgcagtggtgtgatcttggctcactgcaacctctgcctcccaggttcaagtgattctcrtgccacagcctcccaagtagctgggatttcaagcacatgacaccatgcctggctaatttttgtgtttttagtagagacagggttttgccatgttgctcaggctggtctctaactcctgggctcaagcaatccacccaccttggccttccaaagtgctaggattacaggcgtgagccaccatgcctggccttattttacagatattttatttcagaaatagaatttcaaaaactaaaggtatttctgagatattacgagtacagacatagaatatttgtcagttattctgtattatcctttggattgaattggactcttcctttttttttttttttaaatcccaatcaggccttaattaagtgatttttctataaattccccataaaatagtataatggtgttttcttaatattgatgccaaagttttaaatcacgttaacaacctttaagcagctacaatgtaatactggactaaaatagatgtaagtaaatacaattactttagctttttttctggaattctaaaatattgcttaccagatttgagtatgtgaggtgctttaaacattaacatcactctttgtaaattcatatgtacgtcattatgcttgtcttatgaagtgccaaaataattttgggagagttttaaaaatttttagtttttaatttctacatggaagaagatagttttgttttgttttaatgttttgcataaaaagtctttagctttkcatggacaaagctgtgttcttcccagcaggcctgtggcctttgaagtttaaatacagccctttgttggccagtgatgatgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccattttgtaggttacctgttcactctgatggtagtttcttttgctgtgcagaagctctttagtttaattagatcccatttgtcaattttgtcttttgttgccattgcttttggtgttttggacatgaagtccttgcccatgcctrtgtcctgaatggcaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtaggtatgtggcattatttctgagggctctgttctgttccattgatctatatctctgttttggtaccagtaccatgctgttttggttactgtagccttgtagtatagttcgaagtcaggtagtgtgatgcttccagctttgttcttttggcttaggattgacttggcgatgcgggctcttttttggttccatatgaactttaaagtagttttttccaattctgtgaagaaagtcattggtagcttgatggggatggcattgaatctgtaaattaccttgggcaaatcaaaaccactatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggccattcctcagggatctagaactagaaataccatttgacccagccatcccattactgggtatatacccaaaggactataaatcatgctgctataaagacacatgcacacatatgtttattgcggcactattcacaatagcaaagacttggaaccaacccaaatgtccaacaatgatagactggattaagaaaatgtggcacatatacaccatggaatcctatgcagccataaaaaatgatgagttcatgtcctttgtagggacatggatgaaattggaaatcatcattctcagtaaactatcgcaagaacaaaaaaccaaacaccrcatattctcactcataggtgggaattgaacaatgagatcacatggacacaggaaggggaatatcacactctggggactgttgtggggtggggtgaggggggagcgatagcattgggagatatacctaatgctagatgacgagttagtgggtgcagcgcaccagcatgacacatgtatacatatgtaactaacctgcacaatgtgcacatgtaccctaaaacttaaagtataattaaaataaataaataaatacagccctttgttaccattatcaggagagcttgtctccatggtgccaaatgtggcatcgtgagtttagagttaagaggtggaggtacctgtatatgaagtttaaaataaatcattaaaccatgagcccaagccctagctttgaataattagggaatgtagcctgtaattctgaactgatggaaggcagtgagatatatagacacatgccaatttgagggacttttttaggcaaatggagtattgaacgctggaatcattagttatgtgttccctcctcaatagtagaggcaggagaaaaagaatgaggcaccagaactagatcagcagggcatcaggaatagtcggacttctgcactttcttggacttgaagccacaagatgccttttgtctttaaagcagctgagtttgtccagggttagctgcttctagatttatggcctgggaccctgtcttcccagctactccttcatccttgttttaatttatagacttagttcagttttcttattctacctcttatgatttaggtatttgaccactaagtagtatcaaagaacttacaagcatcattttattataacttgttcatcttgaatgaagtgatgttatgggtaattggcttaattattttaatgtttttctgactaagagaaaaatgaagtcatctttaagattggatttgtatccacagtgttgctttataattcatcctgaatttttatctgattaaaatccctcctgggctaattttttttacgtgatttagactgctgtggtaccactgctaaatgaggtaagccaattgtcagatgtatttaataacaatgtttatttttttcccttctagaaaaatgtggaacatatactaaaaacatgagaccggtatatccaacaaaaactttccccaatcactacagcattgtcaccgtaagctctgcatttcaacttctatctgtttgaagaagtgagatgggattgtaacattttttgagggaatagatttaagataaaagaaaaacaacttattttccaataggtagttaagtaaggaaacccaggttctgatcyttgctctgccacaaactagctgtggctttggaaaggtcactttactggctgagtctccattttctcatctgtgaaaagagatgactcaagacctcaagaaacgatttcctggtttcctttcagtgttaatattctctgattcttgtatcctagttttgaggcttactttatttgagccaaaaaaccttcccaaactcctgtgttcacaacttgtctttctaatcatcttgatgatgaatttaagcaagccactttgcctgactccaaataggattacaatcctgtttttgtttcagtgtttccagatttaatttgagtcaaataaaacagtagaactcactaagctttagaattgaagccagaaaattagtatgttagcttatattgatccaagctactctgggacctcgccaaaaaaggaatttgttctgcagaaatgctttactcagcaatttaaaaagacaacagcattgttttcaaaatttcagaggctaccttttttttttttgtttttttgagatggactcttgtgctgttgccagactggagtgtggtggtgcgatctcggctcactgcaacctccacctcccgggttcaagtaattctcctgcctcagcctcccaagtagctgggactacaggtgcacaccaccacgcccggctaatttttgtgtttttagtagagtcggggttttgtagcctgcccggacctaggggcggatggggggaatgtgggaataaaagacaaagacaaaagagtatatttggaagaaggggtcagggggtaccttgcctctagtggacaagggccctgagctttacacagccctccatatttattaggcaaaagagatagcgagtagagggcggtggttgtcggctaattgtcagttggccttttggttcacagcaggcttgcgagactacattcttttaacaataggctagatttctcagtagataacttcaaggagcctggccagggagtgaggccctcagcaaaccttttggtggcagggcagtgtgagtttgcccacatcctgcattcatgaaaaacagtttgctgtttgaccatatagcctccatggaatgctgagttggtcatgtcccacgggccttcagctccctgcagggtttcaccatgttggcaaatggtctccatctcttgacctcgtgatccgcctgcctcagcctcccaaagtgctgagattataagtgtgagccactgggtctggctgaggctgccttttttatatagatctttatccttagtattactgacttattttctcctattacataatttaaatcacaaatactacataaaatcttaagaggttgcgttttgccattacctgatttttttgtttttctttccttaaacttattataattccatgtagcttcagttatcggtttctttttgatgatttttttctgtgaatgtatttaacattaartaaacacaacttgcatataatctgttttatcttttttagggattgtatccagaatctcatggcataatcgacaataaaatgtatgatcccaaaatgaatgcttycttttcacttaaaagtaaagagaaatttaatcctgagtggtacaaaggagaaccagtgagttctttgtttttctactaaaakagttaattattctcatctatttcaatcagagtaaaataaccagattctctagagcttttaataactgatttcatttagtgtgtctgtggccattcttttgtaaatggagatgaatgctgataatcctaaacataacttgtataattgcgtaaaaggagagtagtttatttcagaggtggatttgggttgtgctgggcaatttttcttttctgatcaattcttcttctaccagtagcatatagcagtagtatgggggtaatagctttgatctacacaaaactacgttgtttttgaacgtcttggttttatttgcctgtgctaatttaggagcttctttccaattgtgatctccaatttactttccaagctgtgttctcctttttaatttttaaaattctccaattctccaatttacttttttaaattgccacaatttaaaaaaattttttaaaaattgccacaataattatataaggtctatttaaataatcatgatattcctcttagaaggacaaagagcataatagttagtttgcaggttatgaattcaaattttagctctgacatttaaagctgtgtgactttggacaaatcattctgtttctgcctctgttttatcatatctataatgtagataatattgtttactactttgtaggattattgtgaggattatgtgaattaataatgtagcatgcttgtaggaatactatttagaaccatgattggcaataataagtgcttaataaatgttagttacatacacagatatctcagcaagttaaagacatgtatattcgtgaattttttttcttttaagagacaactgttaattaggggaatagctccaaaagctacaggagttaatctctgactatttaatatgttgttgctgcttaagagtcatattrcatgattattgtcatctaagtgctgaagcttgttgaccttaaaagcattctagcactagagaggaatgcattggtgtggtatgaatacatactttcctaagagatgaatgtttgcatgatttcttaattttccttcattttctgctccagatttgggtcacagctaagtakcaaggcctcaagtctggcacatttttctggccaggatcagatgtggaaattaacggaattttcccagacatctataaaatgtataatgggtatgtgaaatgaattttttctaggatctgtaatatagaacagcttattcttatgtaatctcctttttattgaatcctgagctttagcatttgagtgatatgttggctgaaaaatgagaactgaagaactctttctcaaagagtttagatagatggtaaatggacagtaaaactagacaagtgggccagctgtggtggctcactcctgtaatcccagcactttgggaggctgaggcgaggggtcacctgaggtcaggagtttgagaccagcctgaccaaagtggtaaaaccccgtctctactaaaaatacaaaaattagccaggcgtgatggcgggcgcctgtaatcccagctactcacaaggctgaggcaggagaatcacttgaacctgtgaggcggaggttgcagtgagccgagatcacgtcattgcactccagcctgggcgacaagagcgaaactccctatcaaaaaacaacaaaaacaaaaaaaaacaacaaacaaaaaaagactagacaagtgttttctagagccttttgagaaacaccgataacgtgtttagttcagatcttcgggcagacatgaaaaatgaggtcatggtggaggtagagatctgggagtgggagtactgcacatcttaactctagaaagaaaaagaactgtaactgcccaacaggttcatcttgcacacttcctagacagattgggtttatcaagacaggagaattgcaatggagaaattgtaattcatgcagagccagctgtgtgggagactggagttttattattactcaaatcagtctccccgagcattttgggatccaagtttttaaggataatttggcagacaggagttcgggaagtggggaatgctgatgcgttggattggggatggaattataggggatcaagtgagtttttcttgctatctcctgttcctgggattgcaaaactggttgagccagatgaccaggctgggtggtgtcagctgatacatggattgcagggcatggtctggtaaatatctcaagcgctcatctgagattttacactagtgatgttattcccaggagcaatttggggaggttcagactcttacagctggaggccgcatggcccctaaactataatttctgatcttgtagctaatttgttagtcctacaaaggtagaccagtcctcaggcaagaagttgtttttttttctgtgtgtgtgttttttttttctgggcggtggggaagggctattaccaactttgtttcagagttaaactatcaactaaattccttcccaaggttatttcagcctatgctcagaaatgaacaaggacagcttaaaggttagaagcaagatggaattggttaggtgtgatctctttcactgtcataatttgctgttacaatttttgcaaagatggtttcagaaccaagagaaggaaaagatgagtgtattaaagaggatacagataggaatgatctctgctatttagcatctattgcgtttgcaaatattattaaaaagaagatattaatggtacctctggatttccatttctaaattagtaaatatgctttctaatgtaagaaactgattagaataacctctctgtgatatttgaaatccatgatgcattgagaaaatacaaaaactttttaatggaagaacctctttggccgatttgagcaagattaccgaaataattttatttatttttaaattataaaatttcggtcacaaaatcaatacaacaatgcatttagaagggtgaacagaaaatatcttaaatcccagacacgaaatgcttagcaattttccttgtgatcttatgctagttagtgttctttatggttcccaggagcacagtgcaatgcctcttctccaccttcttatttgccactgtttttattccatggacagtaattaagagtttatgggctgggcgtggtggctcacacctgtaatcccagcactttggaaggctgaggcaggcggatcacgaggtcaggagatcacctggctaacacggtgaaaccctgtctctactaaaatacaaaaaaaaaaaaaaaaattgccaggcgtggtggtgcacgcctgtagtcccagctactcgggaggctgaggcaggggaattgtttgaacccgggaggtggagattgcagtgaactgagaccgcgccactgcactccagcctggtgacagagtgagactctgtctcaaaaaaaacaaagaagagtttgtgtactaagcatgggggattcaaagattaatmgtatatgatctcttggctttttaagatttagtagagtatacaactaattgtacttggggtggggcaagaactctgattagaggtgtgtaaacaaagcctgtgtccagaggaaggcatattcaattctgctcaggaaatactgcgtagagaactgctgtctgctcctcaggggcctgcttcacagctgtgctgagtcatcagtgagtgagtgcttcatgatgtatgctttgcaaagtatattaacatatgagttattcatgtggtatgcagttactgttttcaggtccatgaatattatcctcaagtagaggatagcaagcaaagttttaaatccaattgcaatttttatctgtgtaaaacctaactttcattctttcattgggaaaataaagttttcaaataaaacccttgatttcaaacacaatagatgcgaaatagcatttagtagctcttaatgacattttcaatgaaaaaaactatattttacacccaaacaattgtcagccatcttttatttttgtttgttcttcattttagttcagtaccatttgaagaaaggattttagctgttcttcagtggctacagcttcctaaagatgaaaggtctgtaggcaattaatttctattgtaaatacttcgttttgtagaaatgatatactattttaaaatagactacaacaaaactttgctatttgctatgatgttttatatcgaaataaattctttagtaaatratcataccacattttgaagaatttcaaagctgtaaattatttctcagtagaactgttacaccagtgttataaaatttaatccctatcaattgatgaattattttttccattctgtttttcaatgtgttcgtaaaatattacattttgatactgtttgatttagaccacacttttacactctgtatttagaagaaccagattcttcaggtcattcatatggaccagtcagcagtgaagtaagtacatttttatcagtaattatttcattaaacccagtcatcaaactgaacctcgctttgaaggaggctgctagaccattttataagattctatcatttctggaaaaagcaagtattatacacaatattactaaatataaggatgcactttaaacaaaataagagttgggagaattgtttagcctgtgttttccacagtgctaaattaaactgatgatcaattagcttctatattttcaatttgaaagcctttatccactccatcgccccttaccttggcctaaatactaagtgctttttgagaatgttataaacagctaaacctccagtgtgaaaatacagggtaataagtcaaatagcagaggaagcctcctatgaactctcttccttaggagataggtctttggccacctgagaccatgcttacaacagaggtcccatagaaggatgggagattttatcaaaagtgtagcgatatttgaatacgtgattttgttgaatatttcctaggaaactagaggtacgaaacagctcatggactaacactttcagtgtaacatctcgtttgacctgacaccctttcaggaacttagccagcgcctagctatgtttttaatctgtgtagcactttaaaacagcaaacactgctttcagttttcacgtggccatatcatttttgttaccattttaatggcaaaaaaacacaattacttttgcaccaacctagtattttggaacacaggaagcattagaacagaaaaggatctgaaggctcggcaccatggctaacgcctgtaatcccagcactttgggaggctgaggcaggtggatcacctgaggtcaggaatttgaggccagcctggccaacatggcaaaaccctgtctctactaaaaatacaaaaaaattagccgggcctggtggtgtgtgcctataatcccagctactcaggaggctgaggcaagagaatcgcttgaacccaggakggggaggtttcagtgagccgagatcgcaccactgtactccagcctgggcacagagcgggactctgtctcaaaaaaaaaaaaaagagaaaaagaaaatgatttgagcatatttccttgtacctctaagttgactttccttctgatatatattttgttggtgacctaagatatgaaaggaagtaaaaagtaaggatcttgactattttgggtcatgaaaaaagtgaaaagaggtattgccaggatccctcctgtcagaatccttgtgtagtgatcttgtgccccctgtgattccaaggggtcatagactattaaaaaaaacactctttcttaattttctagggcttcactcccaaattcctatcagttctcccgcccaggtagcccaggttggatagtcggtgagccttaaggactcttcagcacagcgttcagactaaagcctggcctgacatgtctgtcatggtccctgtttttgagggtgctgcttgcctaattcagcaacagcagaggaaggaagggaggcaaaaaagcatccttatttttctcacttgaatttacaacagctgcctaaaccatcttcccttcatttccctttccctgggtctgcgctagatttgcccctcttaaaaagtaggtactgcttggatcactatcaccttggataaaagagagtgaagagagaaggaagttgaccctcacctaggtctgtttttaccctttgtattctttccatcaaaatccatctccagcagctccactgtagttagtaactccattgtgccttcctttcattctgtccttcaacttggcagaaatactcctgcttagagggaggataaggaagatgcatgccagcaatgtggacatgtcataattggtcaaagggaaaagtttcttgtagctgttgtcttgatttgaacaattggctacatgctagtgtgatttttactctttcactaaagtcactgatacccaagacttgtgtctgggtcaatttggctacagaaaaatcccaggatcattttatacttgtttataaggttacatacatttgaaaatcattgctgccttttctaattcactaacagtgtgccaaagcacttgcttttctgagtcatcttcatttaaggttgagcccattacttttcaaatcatatccatcaatttgcaaactctgtgaactccaacattactggcacaccaaaacccactttatcttaatacttaaaaattccagttcatgttgcttggataactttgaatgaaagacgttgtcttgtttcatgttacagtgaaagagcttatctcatattatagtgaaataatactgacaatgaatgaagattaagctgattccacacattacagaaaatacacaaaactgcacaaaaatttttctcaaatggttttgcaaggagagaggataaaataagtgccagaaagcagtttgccaatatcatttgtcattctgtgttcttgtgatattcatatgtaaaatacatgcagtttgtaaggaaataatgggttatattcctatgagttctaatttagaaaattaaatacattgaattataagaagcatttcatgaataatttgaacatttttgaaaattaggaaacatatttatacagtgaccatttgaatgatcagaaagtataagaagaaatgaattgtggaaaatgaagtggtaattaagaacatattggtttctggccaaacactgtagatttgagctattattattttggcttaagttgggtctaatctaagtagtagcattctgacctcaggaatagatcagctaatctcattcccaaaacttaaaattgaacgtgtatagaattaggactcttgcattgttaatgatctgcagttatttactgttctttgtatctctgaccctgacctgtcttagtctaatgtgaatcagctcattgtagttgcatccactggcccttatctatctatctgtctgtctttctttctttctttgtttctttctttttttttttttttaacagagatagctttatgtataaatagccattagtgtggaaggtatcacatgaggttgttgcttcccattcttaggtcatcaaagccttgcagagggttgatggtatggttggtatgctgatggatggtctgaaagagctgaacttgcacagatgcctgaacctcatccttatttcagatcatggtaatctgaatttgcattatttactcttcaggataaagggctgaagaaagtttacttgatggtttcccaattttttctgaatgttgtagttaattcttttttaaaaatgtagtttcttatggacagtctttaggaaaaaaatacattaaatataaaatataagtgaaacacagaattcacagaaacctaagtgcctatcaagcacaatacaccaagaatttgaatagctaaaaaatatatattttcaacattaaatttgtgtaactctacaattttagatttagttggaactgattattatagcttcaatttcctttttttgttgttgtttttgagacagtctcattctgttagccaggctggagtgcagtagcatgatcacagctcactgcagcctcaacttcctgggctcaagtgattctcctacctcagcctcctgagtagctggaactactggcatgtgccaccacacctggctaattaaaaaaaawtttttttggtagacatgggatcttgctatgttgagcaggctggtctcaaactcttgctctcaagctcccactgctgccttccaaagtagtgggattacaggcattagccatcgtgcccagccttcaattttctttagcttgataaatctgactttagaagcatgatatattaattttgataatattttcacttttacttactgtgatctttgtaacacgcttgtgtacagtttggggactataggagcagcgtgcctatggaaaatagaaaataggttctttttgtttttgttcttgttttttgcttcagaaataattatagaaatctgtgtttagaagcagtcctaagaagttacatgcaaagaagtaccagtcttggaatgagagtgaatcatacacatacactcccagttaatatcctaggtggtttggggcaaataactgggctttcacattcggtctaaaaatgtgataagacattcttctttgctcacataatgatattgtaatatataaataagaagaaacattaaccaaaatttgggtgacggaaaagattttgaaaaaagtgaagtgataggtacagctgaaattctgtcttacctatcagatcttcaactaatatgagtgctacacccatgtttaacgaatttaaccttggaagtgaaagaagttctgctctgcatattaaattttttgttaaagttacagcatgttttgggattttttttttctcctaggcatggaacaaggcagttgtaagaaatacatatatctgaataartatttgggggatgttaaaaatattaaagttatctatggacctgcagctcgattgagaccctctgatgtcccagataaatactattcatgtaagtatatctctgtgataactttgaatatggtcatattaagaataccttcctttaggccgggcacagtggctcatgcctgtaatcgcagcactttgggaggccaaagtgggtggatcacctgaggtcaggagttcgagaccagcctggccaacatggtgaaaccctaaaaatacatatacgatactatactatatctatactaaaaatacaaaaattagcctggcttggtggcrgctgcctgtaatcccagctgctctggaggctgaggtacaagaatcgcttgaacccaggaggcggaggttacagtgagctaagatcatgccactgtactccagcctgggcaactgagtgagacttggtctaaaaaaaaaaaaaaaaaaaaaagaataccttcctttaaatcattatatcgctaaactaaagggaatcacagttaatttttttatgattaaatctccaatgcagagcttttgtacacaaatggattttatgggactggatgcgagaacacaacttacctattggttattcatggactaagcataatatttgatgagcttagtgcaattttatgttgaagtgtgtgttttacttgtgtgtcaggataaagattatactagaaaaaatgtttaagagagaaatccaactacatttattcaagtttaattaattaatgacactccattaaaattacttagtttgggattaatattctgttgtgaggaggagtgctggcagaaatgattaattctataggcaattgattcctgtcctyccttaaaccatttcagaaacaataaagaatgtatcttttacatagggaagaatgaatttcacatctcttgaccacatgtggaacataaactgccaaaagatgttttaaaatatttattcttttgccagtcaagtgtatttcataactgtttccacctctgttacctccctctctttttgattaccatccatgataactttcagatgtgtagagcaaattttgtttgtctttttgatatgatatagttagttaactttgaaacagaaagagaataagcttttctgacaattaccggaattgggttaggttggtctatttggtaagatatgtttcaatagatagatactattgactattaatgaagaaaatagatttcactgcaggaaaatggttatgcagatagatttacacagtgtcacaaagcacaggctgcatatgcctaataccaagttttaattcgtatttttttaatttagaaaagtagtacatgactgttataaaacctgttataaaaactatacagatagactggacacgatggtggctcacgcctgttattccagcactttgggaggccgaggcgggcggatcataaggttaagagatcaagaccatcctggccaacgtggtgaaacccgtctctatgaaaaatacaaaaattatctgagcgtggtggcatgtgcctgcaatctcagctactgggaaggctgaggcaggagaattgcttgaacctgggaggcagaggttgcagtgagctgagattgcgccactgcactccagcctggtgacagagagagactccatctaaaaaaaaaaagctctacaggcaatagcagtctccagagatgtttgggatgggatagytaagctgtaccatacccttatcttaggccctcaagtttcccaaattaaagcaaaaactatatatgtatgtcactttacataaatatataaaatatatgtatataaaatgtatactcttatctggataattttctcaaatttatgtaatgtttggctaaaataaaatctaggaagctagacagttattgatttgtagtagaaagtaccctatgtaaatccatgggcatactatgcaaatgcagtttttaaactagtctacttgccttctctttgaagtttcctcatacccctcttatttgaaaattctagaactatcattgaatattgaagtatacaaagtaaaaagaaacagcttcccacctgaagtcctcctacttgacaactcatttcccctctctagaaacaaccgttgttaagcttggattatgtcttcctggataattgagatatttgaataattatttttgttgttgagtatttcctagggaacaagatgtacaaaacagccttacaaaacacatacagtttttatttttacccagtgaaaccataccagatctagatggatagatattttgagggatggatggatgatggatattggttactaactggatggaaagatggttggacaggtggatggatagttaggtggatgaatggatatgtgggttaagagatggrtggataggtagatgttctgtaacttgtctttccctttawcaatatgacactatatcatgggtgtcattacagggtgatccctaaaggtctgtctaattcctttcagtggctacaatgtaatgacttaaatgaactctttaaaacctgccttggtatttaaatgcagagtttggatctgacattctatatttttgtattatgttttaattatagtatacaatcaactattaattcttatgtttgttcccctccagttaactatgaaggcattgcccgaaatctttctgtgagtatctttattttccattatctagttatttttacttttgtataatatayattgagagaaaagtttcagcatctattattgggattgaaggattagaatattttagtaatctgggccaacatggaaatgctgtgtagtttaaagatctttmaggtcgtatcccaataatccaggtttgaaaaatttttaagaatttgtctattggcattataaaatttatatgagaagaagaaataattttaaaactatttacaagaaataatttttaaagtagaaggaaaaaccctgtagctgtaccaccataaacaccattagcgttatgatatatttccttccagtctttttttatgccttaaaaaattaagtttctgtactagtgctgagttatctatactacattttatactcatacattttaagtctgcaagaaaactcttacaattgcacttacaaggatgtttgaaaatagaaccattagtggtaacttgaatataatctagtgacactgagttctggggcttttatgcagtaataattatgatttcctctaaatatttcaagtagtttggaagatttaccttgtacattatataagtggtttatttagctgttttttcatctgacttattgggccagctgatgaaatgtttgtgaaaaaaaatttcatatgaagttagaaagcaatttcaagaaaagttgacactttttatagatattagggaaatatctttccctaataaatatctttccctaaaaaagttgacacttttttagatattagggaaataatagtttttctttgctgtttgcaatttcagtgccgggaaccaaaccagcacttcaaaccttacctgaaacatttcttacctaagcgtttgcactttgctaagagtgatagaattgagcccttgacattctatttggaccctcagtggcaacttgcattgtaagttctgacagtctcccaggtaaacttagtctgatcggttagtgattcagggtaaccattgggccctttctaacaatattgttatgtgaaaactgtataagtatgattctcttcactctaacccaggatttctaatgtcggcctatggatgtttgagttagataattctttgttgtggagagctgtcctgcacattgtgggatatttgacaaggatcctttacttctccccactagatgaaagtagcacttcttctgtaatgtgacaaccaaaaatgtccgtcagcgttgccaaaagtcccatggggaggaaggatcacccagaccatccttggctaagaaccattgttctggcttttcatatacatattgattacttcttacaatctacatttgttactgcttgccattgcatgtctcctgcacattacagtatgtctaattgtgcctccaaagcctagccaacagttggtaaaagcactttataataatgagtaactatcttcattatacacgttgttttttcattcttcttatactaatccatcaataaactttagtttattggtgtgtttggcaaattatttggatggttaatagtgttaatatctcacaacttgttcattaactgttttggtggttgccaagaagctagtcatgatacatacccctgtcaagcaaaacctaagcagtgaaccaaaattcagtaaacagaattatactgtctccactcttattggagagctgggcttttagttttsaaaaaatatatatatatatgaaaggagaaatggtcctatcttcatgagagaactaatatttagtaaatatctaaacaccatgttgcaagcatttctttaggctatatcattgaatttttacaaataaccgacwtgagaaattgaaatcaaagaagacagttaaatctatctaaactcacaagtagttaatcacacagccaatgttcaaaaccacttctgtcttgatgctagtggtttttcttctgtctactatattgcttatagttaatttgtccatgaaataaaagatagaggtgacttcttaatgcttttcaaagccaggtggttttatttaccgttgtgttggtttaacaaaatagttacatactttttaatcaatgaaaataatgttatgattatcaattatgttttatgaaaggactttacatttttaattcatatatgtcaacattaggaatccctcagaaaggaaatattgtggaagtggatttcatggctctgacaatgtattttcaaatatgcaagtgagtaaacctattatacttaattggattaaatctaaagaaaaaatgatatgcaaagttttagacttgaaaacatactgtgattatatgtcttgaatgagaattaatggaacatactttcataaagctatttttctttgaacattaaagaattttgttaaagttttatattcattggctattactaaaaagtcaaaaaacaacagatgtagtaaggatgtggagaaaagggaacacttatacactgtcaaagggaatgtaaattagtacaacctctatggatcactgtatagagatttctcaaagaaataaaaatgaaactacccctaatctagcaatcccactactgggtatctacccaaaggaaaaaaaataatcagtttatcaaagacacctgcactcgtatgtttatcgcagcactattcacagaagtagtcatggaatcaacctaaatatttataaatggatgattggattaaaaatgtgtgagatatatatatatatacacacacacacacacataccatgaaatactactcagccataaaaaggaatgaaatcatgtcctttgcagcaacatggatggaattgggggccattatccttagtgaaataactcaaacaaaaagctaaaaatcacatgttcacttgtaagtggtagctaaacagtaggcaaacacggacatacagagtggaataataaacattggagactccccaaaggtgggagggcaggaggagtgtgagggatgaaataccacttattgggtacaatgtacactattctggtgatgggtaacactaaaagctcagacttcaccactgtgcaatatatccatgtaacataactgtactcatacccctaaattcataaagttaaaaaattaataaaattttatattcatgtttcataaacatatgacatatctcctattatatttctaataattatttttcaaatttttgtgctctgttgagagtattgctttacagttgaagaaaaccagtgctataatagataagaaagtatcagacttatgttctgagaaggataatatcttacatttacccagcactttaacattttcaaaataaacttacaataattatttaatttgatccctgcatcactgtgtaaggtgggcaggatgaggtttatattgcatgtcatagatgaaaaaaaaatgttatcattcattctgttctgattgtcaaaccaagaattgtagtaaaactaagagacctatcctagatgtccttagattatgtgtgtgatagggttaaaactatatttcccacaaagtccactgagcgtggtagttttcctcttatcttatcataaccagtttgtatatgtacaatgtggataacagaatttttgggaccaacttgtagacagctgaaatgcactgataaacttccttttctggccatctaggccctctttgttggctatggacctggattcaagcatggcattgaggctgacacctttgaaaacattgaagtctataacttaatgtgtggtaagtgtgaacaggtgccttttttcccttctgaaaatagacctgaaataggattatcaaaagcaggtcacattgtaggcaactttgtggagatgatggtgaggcaagacagatttttaccttcttcctgactctcagactcactgaagaaatgtggggaacatgtcatcttattacttatctgtttgttccactaggctgcttgctggttaaagtacaccactcacagcagggtggtctgcacacccccactgcccagcactttgctaggccctcggcttagtgatttgattcttgactcagagcagtgatagaagccagaaaaaggagattgagggcagtgaaaggtggacaaaacttttggaacttctggtagccataatggttgaatataggtcagtgtcaaggttgcagaaatgaaggaggacccattagggagattcttggtttactttgtaccttctgaagtagtccttttgtgttgaagcattgtgtgttttaaatattagtttcttattctgataatggtcctaggcatctgcaaaaccttaaatatgtcttaagtataattcttttagtgggagtctatatagtttaaatgagttaatgtatcctaaaatacttaaaacagcagctggcatatagtaagtgcttactacataagtatttgctgttattacatttaagagcatgagtcttagactcagacaaagctggttttgaattctagatcatttagttagtaactttgagacttgggtaaaacactttgattactcatctaccaaatattgatgataacttataaaattgttttggggaataaataagaaaatatgttagtaccatgattggcaaaaatatgcattcaacaggttgtgactgtagttattgtatgctttaaatatcagaaattttgtagtgaaatacagcatacatatcagtatttctattaaaaataacctagtcttaaatactctaaaacccaagagagttttatacttttattttagttaaagagtaaatgactcatgtatttggttttaaaaaagtaaagatcatggcacaagtctactatttgtttgatttgaaacatctaagtaactctaccatcttgaaattatgcagatttactgaatttsacaccggctcctaataacggaactcatggaagtcttaaccaccttctaaagaatcctgtttatacgccaaagcatcccaaagaagtgcaccccstggtacagtgccccttcacaagaaaccccagagataaccttggctgctcatgtaacccttcggtaagtatcgtcaagaagtttggtccagtatgtatggtttgatagcaccctctgcatagcatgtgctgtaaaaatacttaataatyaaattagaatttaggagtgggggtaggtaaacatatgtttwaattctagggggcrcatgtagatcttttgtgatatatcttttctctttctagtttttgcattttccactctatttttaattcyttggagctgtgacttgacttgggtgcaggtgtggtgaagtctagttagttgacttgggtacgggtgtggagaagtctagttcagttcttgagcatcctgaattagggaatctgtgctgttaactctagcagtgaggtgatgagcacatagtaaaccaatcacaatgtacctttttaaaaatacaattcagattgtttaaatgtagggagaaaaaagatttyttggtatgaaatgaatatattacactgtccttttttacttccatgttaatatgtcattattataaaaagataaaaatactagacaagttatgaacaaaattgataacatccatgagggcacctgtaatcccagctacttgggaggctgaggcaggagaattgtttgaacctgggaggcggaggttgcagtgagccaagatcacaccatcgcattccagcctgggcaacagggcaagaccctttytcaaaaaaaaaaaaaaaaaaaaaaaaaaawawatatatatatatatatatatatatatatatagcaatttggagagtagtttatttcatgctttacattttgttttagacttgagttagaatagaagaaagactgttggggtatatagatgagaattataaagcagcaatcatattcttattttttaattactggtgtgatgcttatactaacaattttgtcttttgcaactgtcattcctctccttctgtccttttcatcaaaaatgtaacttctgtccaggcatggtgtaccacacctgtaatcccagtactttgggaggccgaggtgagaggattgcttgagaccaggagttcaagaccagactgggcaacatagtgagaccctgtctgtacaaaaaactaaaaaaattagctgggcatggtgacatatgcctggagtcccatttacttgggagcctgaggtgggaggattgcttgagcccagtaggccaaggctgcactgagtcatgattgcaccactgcacaccagcctgggtgaaagagcaacactcttgccttgaaagagaaaaaaaaatccactaatacaagactatcataaatgatctttgttctatgttggaataatcaatctatagcggttctatgttacaaaatttaaaacatgtctctcagtccttaaaaatagttttataaccttttttagattttgccgattgaggattttcaaacacagttcaatctgactgtggcagaaggtaaggcatgctacacactcaagctcggaatgtgaagcaggcattttctcatcagtgtgaaatgcagagaactggcttgggggtattatttgagaataaccaataaaataaagggagttctggaggaccacctgatgaaacatagaggtttctttgcttgacagtttagactattaggcataaggaaaggagatattttgcagtggatattgtatgtaatgtatttagtggaagctgaatcacaccttgtgaacatgatggaggtgttcaaaaatttttgatgatttctgtaagttgataatagagactgagattcccatttgaaatacctaagtttctatctcacctggttcttaatcatacaaggttatatattgatttattgatctaaagttatttctgcatcacttttgaccaaaaatcaaggatacacagacaactgatgaaatttttcacttatgacttgaatgtttggagtcactataatacactctctcagccttaagttacttggcacacattttttttctactagaataaagaggtaaattctgcattagttctgatgtaagtttgtctctataaaatccctaggtaaatgctggagttaggaaaatctttgatatctccaaggtggcaaagtattgtggtgaatgatggcactttcagaattgagtagatccaagtttgaatatgagcttaggtactatatgttcatggaaatagtattccctgtcagctgctgtttccttatctgtaaaatgggcatataaccttaattcatagggaaatgtaaaaattagttatatgatgtgtaccaagcccttgacatttggaaaaagggcaataaataatatctatattgttattgttttatttagtttagtctcataatttcarttctgaacttctgctttccaagtacacatatcattaaaaaaatttgctttctggagtgtgtcctaaagaataagtaattaaaatagtgcttaagaatttttggtaatataactttgaattaactggaatatttagcaatttcatatagtgtcctcatggtatcttgatattacattgatttcagaatctttataggcaaaaataacagtgaacctcacttgtcttcttaattgtttatgcttctaccctttgtaatcagtttttttaatagttaaaagtaaatcttcaatataattaagtagaggaaaggattagatgagtgtatcacactatatattatcatataatgcacactaactacatttattttcatcctgtgacccaagagaagattattaagcatgaaactttaccctatggaagacctagagttctccagaagraaaacaccatctgtcttctttcccagcaccagtttatgagtggatacagccaagacatcttaatgcccctttggacatcctataccgtggacagaaatgcaagtatttgtcacctctttatgtgtggccatttcaaattaatgattaagcagaacattaaatgcatagtttctcactgttcaccttggctttatactcagttcccgcattagaggaacactgaagagggagtcagaaaaattcagttccagttcaagctctgccactgagcagctgcatgactttgagaactcagaccaaatttcttctgtgaaatgagggtcgtgcagtaaagattctcttttgggctgtgcgcagtggctcatgcctgtaatctcagcactttgggaggccgaggcgggcagatcacgaggtcaggagatcgagaccatcctggctaacacggtgaaactccatctctactaaaaatataaaaaaattagccgggcgtggtggcrggcgcctgtagtcccagctactcaggaggctgaggcaggagaatggtgtgaacccgggaggtggtggagcttgcagtgagccaagatggcgccactgtactctagcctgggtgacagagtgagactccatctcaaaaaaaaaaaagaaagaaagaaagaaaagaattctcttttcctccccgaccccagttttaatattttatgattccaatttataattgcatgaaatcagccttaggatcagtcacagttacccatttctaaatacatggctgtgtgaggacaagtatttccctcagctgtccaaatctaagggggccctcactgtttggcaaagccattaaagctcagtaacatcattgcacgtaccatctataggaagacacgagcccaaaccagggagaggccagaatcctgcccaccaccaacaccagaggagttaggccttgaaaggagtgagggcaaatatcccagaataagagcagccttccccctcacccatggccccctgggtgctctggtagaaggaggaatggtgaaggagatggtgctggaaagagagaagggggaagatgagattttgatcttacgtggaattgaaattttaaactgggctgaaactgaaagtgactggcaaggtacaggatgccctaagggaacgacaaagggatttgagagagcatagtggagggcagcagtttgatttaaaaaataaaatgatttttactaatcagtgagacaaccaaataaaaagatagggatatgtctgtttatatataatttctatgttacaaatatataatacacacatatatttatataaratttcttgaactttgatttttaaaatttttcaatactgtcttcaaacaccaaacacttaaaaaaatttttgactttgtaattgatcagtctacaccatttttcataggcaccccatcctatttattaatatttataccttaattatgggttccttgattccattttcagttttcttatgtaattaaaatgcataactttacagtcattgcgatgcttgaggtttttacattgctgttcggtgactgtcctcctttgctccagcaacttttggcagtgtagttgactatggaagatagactcagatctctaaaaatcaacattttactatataaaagcttaaaattgaccagcgcggtggctcacgcctgtaatcccaacactttggggggctgaggagggcagatcacgaggtcaggagttcgagaccatcctggctaacatggtgaaaccctgtctctactaaaaatacaaaaaattagccrggcgtggtgggtcacacctgtaatcccagcactttgagggggctgcagcggatggakcacctgaggtcaggagctcaagaccagccttgccaacatggtgaaaccccatctctaccaaaaacacaaaaattagccaggcgtggtggcagatgcctgtagtcccagctactcgggaagctgaggcaggagaatcgcttgaacctggggggcagagttgcggtgagccgagattgcgccrctgccctctagtctgggtgacagagtgagactccatcttaaaaaaataataataataaataaataaataaataaataaatatttaaaattgtgtagataaaatcattctaaacattatttcatattagcatagcagaatctgaaaatatttgcataaatatgacaattaatatctttaatattgtaaagcatttttacactttagttagaaaaaaagatgaatatactagtaggaaaatagggaaggacatgagctgacagctagagcttcataattttatgatgtagttcacctttaaatattaataaagcarttttcttctctgtgcctgatatctgagagttcttctcattttcgttcttcaggacagtttctctacggaagacttctccaactgtctgtaccaggactttagaattcctcttagtcctgtccataaaygttcattttataaaaataacaccaaagtgagttacgggttcctctccccaccacgtaagttttttcctctcctgaccttcccttttctcctttttgttttctttcttgtttataaatcctaccatacattatagggtaatatatatattacctattatatatatataaatattacctattttatatattatatatataatatatataaagtatatatattactattatatatatatagctatatatatatagctttgtttatttattggtgaaaaattgtggatttggtctagaactaccaagggaaaaattttaatcatctaaaacttgaattttataaaattttctttttgttgggagggtagttgatgtagtgcagatatggtaagcagaacacttcatggttcctttctgcatttcttttaaacaatttgagaatattgtgaaggtggaatatatatatcaagttggaagaatatatcaaggttcttaggaagataactttgttaggataaataactttsttgtttaaaaagaaaatgcgtttgtcagagaagtaggtaaaggtagaggcttacatatgcttgctttttcactgatccagaatctctagggaatggcttttttgaagctaagtattctattttttgaaatggcaaatttgtatgttgatgagaagccattttggggccagccttaaaaggcaaaaatcagaaagctccaggtgctcaactaccgtcagcatccagttcagttcccagagtatgtgtctgaagtcagaacttggctattgcattataaaaatagaccaggtccaagcctcaaattcatacagagaagccttgtatggtgtttcgagacagacatcctgtgatgttttttctgggtagcaggtgttgttctggagccagatgttctcttttttcttttcactgtgaaaaagtgtaaggaaagaagattgtcaacacaattccttttagttgaaatgagggcaataacgtttgaatatgtttaatttggggctcttgttattaaagtttatgtttcgttgacatgctsatcttgaaaagacttcttaaatattttatttttgtaaaggacttgaccaaacacattacattttcccttgaccctgtacttgggaaagttttacaggtttaagatggtactcagctaatttttaaaaatgctcccctaaccatgagaaactataatttcctatgttatttgtgaagaatgaaaaagttgtcctcttttctctttgtagaactaaataaaaattcaagtggaatatattctgaagctttgcttactacaaatatagtgccaatgtaccagagttttcaaggtaaataatgttaactctatatttgataattttaatgaatttgtgcacatataggcataattcatatgtaataggacttatggtctaaattaaatgaattaataccaaatacattcttaaaggtttaactttgagaatactagtacacaaaaattctacaaattattagaattatcatgtattctaattgtataattgtttgcaaacagttttggtgagaaagtatgtgatgcgcttcctaaagttatccagctaatacagtctgctaacacttatattaactttcattcggcttccttatttaactttttggaagttcttgataattgtctatgttttcaaatgaatagattttacatcatcattaactattgcagcatttgacttttacaggaataaaaatttagttacttaaattgatgtatagaatatcaaaatataagcatataaggagtttttagtctaatttatatctagaatacttgtgaatatttcaaagttaatattcagatattaataggaaatcggaataatatgccttgtttgtgtttgcgatgttgctatgcttaatgatgacatatgatcacaatttcaacatgatgtacttgttcagggatgtctcaaagagagttgggttcaacgtttgtctgtgagtcctttcaaaggccaaagctgaacaatgaatttttggcctcacactaagattagagccaaggctgggtgtggtggctcatgcttgcagtcccagccctttggggagtccaactcagaaggactgcttgaggccaggagttcaagatcagcctgggaaacagtgagatctggtgtctagtctctacaaaaaattttaattagctgggcatggtgatgtgcacctgtagtcctagctattctggagactgaggcaggagcatctcttgaccccaggagtttgaggctgcagtgagctatgattgtgccactgcactccagcctgggtgatatagcacgactctgtctctaaacaaaaaacaaaacaaaacgaagactgaagccaaacttgactttatctttatttactataaatgctaattttgaatcatggtgttaatttatttcacacgtcaacatggtcccttgttcttttgaaactacactggcttctatcttgtttcagttatatggygctactttcatgacmccctactgcgaaagtatgctgaagaaagaaatggtgtcartgtcgtcagtggtcctgtgtttgactttgattatgatggacgttgtgattccttagagaatctgaggcagtaagaacatatttcattactcttaaaaataggaattaccatccagtagaaatgggattaccatccagttgagtcaacagaaccttttttatccagtgtcgtatgtttatgtgtatgacacttctgactacacaggaagcctcttgaaatatctgattaattttgatgttttgctcaatrttcagtaaaatatttttaggtaaaaaagtagtgtttctcacccattcagttcagttgaataatttttgcactcagtttaaatgctgaactcatttaagatctctgtgtggctgattgttaagatatgatcttaatatattgtgagtcagaagatgaagaactctatggtgtggctacagatatcctgagtctaggaatgaatagggttataaagctgcagtgcttggagtctggtggccttgggtgaatgttatggcttttacccaactgtggctggaggggcatgataaaaagcaaccgtctgaaggaaaccatcagtggtgcttttttaaaaaagagagggaaagaacatcttggaaactggttgatctttattgaaacaataattacagcagtttgggaagcaattttgctgttaagtccgtaggaaaaagactgagattccactgagattcagcccctctcagaactttcctactctcccaggctgacttagatatatgtgacttacaaaatacatcagaaagcacatcaatttgcaaagttacagttttttactttcccttgaggcataaagctgccttagaagctgtagcactggagaggatacagaagagaactgcatatgcttcctacccacggcttcacccagagccctctgtttaaatctgttttatagattatgtttctacataaggtcatatttgaaaacaatgattccactgccttaaattttgaaagatgttgaaaaaacaaacacagccttaaaataggagaatgactatgaggtaaagatgtttgggacatctttgataatatacttcagtttaaaaaattaagttattaaggaagaaaatccagttagaacaaacaattcatgacaacatgtcctctctgaaggggctggaatagaaaattcctaaccagttctttctctgcccactatttgtctataatcgcctagaagttaagactatcaataatggtttacactcttggtcataggtgttcaaaaatgacattttcttttctttagtgtttcaatttcaatgtctttaggtagaactaaaagaattctaaaagtcaataaacttctacagaaaataaaaattatttggagtgtgtttatctgcctgtcttctaattattgctctcaatctggcagagtatgttgaggtattgtgattactagcttcttatatttaattatttgtttgaatttgatttttatatgtattmaaagcatgctctactgaaatattcatcaaaaggaagatagttatttctttcttaaaatgaatattggcatgttttacagaaaaagaagagtcatccgtaaccaagaaattttgattccaactcacttctttattgtgctaacaagctgtaaagatacatctcagacgcctttgcactgtgaaaacctagacaccttagctttcattttgcctcacaggactgataacagcgagagctgtgtggtaagtagcttttgtatatttactttgcatgttgaaaatctagacatatgcatatttgtttatgtcacccatctgacattacagtgagagaaagcacaactgagtacacatggacttcgaaattataggatgcttttaaatttgatcttttaagatgacatatctttggggaagactacccttgtctgcttttacttttttcttttttttttttttttttttagagatagggtctttctatgttgcccaggctggtcttgaactcctggcctcttatgatcctcctgtcttggcctcccaaagtgctgagattgcaggtgtgagccaccctgcctggcccctttgtctggtaaagatactaaaaatcagatcagaatcaaactttgtatggcttaaccactaaagtctaggtttatctgargtatggattttctctttttttaaaactggatgtataatttcaaagtgtcagcactgttataaattaaagttgttagacaacatttcaaattttctgtgtatcacttaattataaaaaatcttttcctttcttatcgtattgtcatcccagtgtgtttgggaataattgktttatattatcttatttgctcagaattttaaaaatctacattgtagattgggacatcaagactgcataacattttagcaattattttttttttttttgagacagagtctcactttggctcccaggctggagtgcagtggcatgatctcggctcacygcaagctccgccttytgggttcacaccattytcctgcctcagcctcccgagtagctgggactacaggcgcccgccaccacacccagctaatttttttttttttttttgagacagagtctcactttggcttccaggctggagtgcagtggcatgatctcggctcactgcaagctccgccttctgggytcacgccattctcctgcctcagcctcccgagtagctgggactacaggcgcccgccaccacacccggctaatttttttttttttttttttttagtagagatggggtttcaccgtgttagccaggatggtctcaatctcctgaccttgtgatccacccgccttgtccttccaaartgctgggattacaggcgtgagccaccgtgcctggcctttttttttttttttttttggagtcttgctctgtcacccaggctggaaggcagtggcgtgatctcggctccctgcaacctccgcttcccgggctcaagcgattctcctgcctcagcctcccgaatagctgggattacaggcacctgccacccatgcccagctaatttttgtatttttagtggagatggggtttcgccgtgttggccaggctgttctctacctcctgacctcaggtgatctgctggccttagcctcccaaagtgcgggggttacagtcatgagccactgtgcccggcccattttagcaatttttaagttttctcttatggtgagccaaaatatatttctttcagagtacttcctacatttccttttttttttttttttcattgaagtgacaccaagtaagtctaaacctgaatctgcaaaaagatgtagctttcataccagtcccaatgaatgggtggtaggtacctggagttaggatcttgagacccagtatgagctcagcaggaaagagtgctgtatccactcattcattcactactactttgattcaccattcattcctttgatatttataatcaggtgctctaggtactgaggacacagcagtgaacaaaatagtgagctcttctctgggcccaagagtagaatacaatgatccgtttgccatccctgatggtagtagtctttcyatatatcgttaaaattcatgaagatatgtctctccttaattgtttctatgataaactttcagaattacttgttcctatagaacacatttctcattatttttccctttattctttrgaattaaatacagaatagcaagattttagttggttgcctgatgattatctgactccactgaaagttgtcagttttgtgggcattgttggaaacatgcagctattccctgcttcattatttcgtttgagagattatattgtcattgaatgtatcaattagagtagggttctgcagcaaataacagaaacccctttgcagtggcttaagcaagtcagggattcctcatggaacagcaagtccagctgcacacagtcctgggatggcgctttgggtcaactgcaccattagggacccagaacttttccctctttctgctccaccattcttagcatgtggctttggcccacgtgggcttcttcatgcatctttgtaggtaacacattctcataaaaactagtatttgtgtagtacatttgcacacatcattacgtttgatcctcaaaataacccgatgaggaggatacagataaaggaatcaagacttatatgttaaataactttccttagtttacctgatacgattgtcacagaaccagcctcttttaaaaaaattttcaacttttaagttcaggggyacatgtgcaggatgtgcaggtttgttgcataggtaaatgtgtgccatggtggtttgctgtatggatcatcccrtcacccaggtattaagcccagcatccattagctattctttctgatgctctccytcctyccaccccctgccctccaacaggccccagtgtattttsttcccccacacgtgtttatgtgttctcatccttcagctccctcttataattgagaacatgaggkttcgmttttctgtttctgcattagtttgctaaggataatggcctccagctccatmcaygtccctgcacaggacatgatcttttatggctgcatagtattccatggtatacatgtaccacattttcttaatttagtctatcattgaccatatacaccatagtattccatggtgtrtatgtaccacattttcttgatccagtctatcattgttgggcacttaagttgattccatgtctytcctrttgtgaatagtgctgcactgaacatatgcgtgcgtgtatctgtataatagaatgatttatattcctgtgggtatgtacccagtaatgggattgctgggtccartggtatttctgcctctaggtctttgaggaattgccacactgtcttccacagtggttgcactaatttacactcccaccaacagtgtaaaagcattcctttttctccacaaccttactagctagcgtctgttgttttttgactttttaataatasgcattctgagtgattctttacattattcagatattctttcccatgccatgtaatttctgttttcccccyttttttaaccccacgccattgaagtttcttaaacctatgtaatgcaggaccatctgttccaggtatagtttcttttccccaaacttgaagcatctaattaaacaaacatgcatggtatgtattagaaggaaagctactcaagaggagagatgatgcctaacaaatcatgtggcaygttccacttcagagctgaaatctcgtaaatgattaaactggggagatggagcrcttatagaagtgaactgagtgttctcttggtaacttttcttttatatttcctattctcctagcatgggaagcatgactcctcatgggttgaagaattgttaatgttacacasagcrcggatcacagatgttkagcacatcactggactcagcttctatcaacaaagaaaagagccagtttcagacattttaaagttgaaaacacatttgccaacctttagccaagaagactgatatgttttttatccccaaacaccatgaatctttttgagagaaccttatattttatatagtcctctagctacactattgcattgttcagaaactgtcgaccagagttagaacrgagccctcsgtgatgcggacatctcagggaaacttgcgtactcagcacagyagtggagagtgttcctgttgaatcttgcacatatttgaatgtgtaagcattgtatacattgatcaagttcgggggaataaagacagaccacacctaaaactgcctttctgcttctcttaaaggagaagtagctgtgaacattgtctggataccagatatttgaatctttcttactattggtaataaaccttgatggcattgggcaaacagtagacttatagtaggrttggggtagcccatgttatgtgactatctttatgagaattttaaagtggttctggatatcttttaacwtggagtttcatttcttttcattgtaatcaaaaaaaaaattaacagaagccaaaatacttctgagaccttgtttcaatctttgctgtatatcccctcaaaatccaarttattaatcttatgtgttttctttttaattttttgattggatttctttagatttaatggttcaaatgagttcaactttgagggacgatctttgaatatacttacctattataaaatcttactttgtatttgtatttaaaaaagaaaaatattcctatcctgctcactggtarttaacataggtttaaaatggcttcaaatgtggccctatagacggttaaaattgtaccttatcttggcaaaacttcagagcaccagtcagtgcatgcaaggtgccattttttattgagatgcttagaatgtttctttctgtgcacaagacttaccctaccagcagcagagccattctctgttgagtggttcattttgaagttccacagattgaagagaacatgccaccaatcacctcacatcttcttggtggacatgataaatgacacaatgaacttgatttctttactaccttgactgtagctttttrtccctacctgtgaaccttcaaagactgcattaacttttaggctacatmggtccaattkaggtataatatcagtacaccaaagatttttatatgyccttcgtgtgaccattcttyaacggcctaagggccagctgcaaagacttttggaaaatacaatttacaactcaaaattatttaataatttaggaagttkytttttttttttttttttttcagtcctgcagtttcctgaagctctgtatatgatatttttttyagcctgcttctctctgttgttcagattaggtaattttattcttctgtcycraagctcactgattctttattctgtctaatctgttctgctrttgagcccatttattcctgatttttatattttagttattgtatgttttatttctaaaatttccattcagtttttctttatatcttctatttgctgagaatttctgtctctttgctgagactttctacgttttcatttgtttcaagtgcrtttatacttgcttgttgaagaatttttatgatggctgctgtaaaatccttatcagataattccaacatctgtcacctcattgtttgcatctactgatggtcttttttccattcggaaacattttcctgttycttggtgtgtggaatgattttttattgaaacctggatatttttaggtattatgttatgagactatgggtcttatttaaaccttctgctttagccaactttctcagataccaccacagcaggggaattgggagcactgcttcattattaccaggtgtggctaggagtccaggttccccagtcagcctccctttatactgagtaacagggtcccctcattactactgggcaaggtgagaattcagtttcccattaggtctttattgattcttccctggctggaatgtgcagcggcaccttttgstgcaccctgggaatctccactaatgctatgggacagagtgaccaggaagagcttcattacaccaggtgggaatgaaattcccagtagcctacacagccttctccgacaccactctggagttgtattcttccagcacacaaacatacacaatttaactcaaagcatcttagcagagcttaattaaatggatagatgcctgttccctttgctggataccaagaatacaaaagtcagggagttggggcacctctttacagcttggtgagagtgtaagtctggactccccactcagcatttgctggtatgggtggggccatggtgtttttccatggtgtttggttggagtacagccttttttacccttgcttggctacccttttctggtcctttggcaggagagagcaggactctcttagggcttttttttcccctgcatttattgacatttccaggttgctgactttttcagctccaagttggaaatatatgagctgaaaagaaaatgtagggaactcatcacagtgttgttacttgggccccaatgttcctagcctattttctgtctactattcagagtcttgctgtgttttaatataatatccaggatttttatatgcatttagcagaaggatgtctactctgcctttgtagaagtgtctcactgatttttacatatttttccagcacacaaacatacacaatttaactcaaagcatcttagcagagcttaattaaatggatagatgtctgttccctttgctggacgccaagaatacaaaaaagaacaagtgacaattttctctgtcttagggagaagagacagcagaagtgtaaatgatccctaaagagtgatagatgttatcatgaagccacaggaggggtgccaggctgcacaaaagagacactggatgcttcttggtagtagaggcagtggcttcccagccttggggctaaggcttgtagggtgaattggaacttttcagatgagcaaggcaaagaagggaccttctaacattccttggatggaacatttttgacattttcycatttacagctacttatattttctacaagtgtcactgtgaccaacttatgtacacatactttttcttgcttagttataataatctgttcttaaagaaaatgtcagtctctacattctatgctgactgttaaggaaagagcacccacatctgctcctacttagctttttttctgtggttcttacacagtattcctttttttcttttcttgaaagagactcctcctttcttttcttttcttgaaagagttttaaasagataagatggcaaaagtgactgatctctactcccccagtttgaatggtaaatttgaatggtaaattcccatgaacatatatggaaatgtctttatcctactttctccaataaaggctgttcttagcttttcaaatgcaaagtgaaacctttatttatcttgatttcttttttttttttttttttttttttttttttgaratgctctgtcacccaggctggagtgcagtggcaagatctyggctcactgcaagctccgcctcccaggttcacgccattctcctggctcagcctcccgagtaactgggactacaggcacctgccgtcacgcctggctaattttttgtatttttagtagagaatggagtttcaccgtgttagccaggatggtctcgatctcctgaccttgtgatctgcccgcctcggcctcccaaartgctgggattacaggctygagccactgcctccagcctatcctgatttctactgtcatgcctcacatcagtccttttttttttttttgagacagagtctcgctctgtggcccaggctagactgcagtggcatgatctcggctcactgcaacctccacctccggggttctagcaattctcctgcctcagcctcctgagtagctgggattataggcgcatgccacacctggctttttgtattttagtggagatggggtttcactgtgttgctcaggctggtcttgatctcctgagctcagacaatccccccgccttggcctcccaaagtgctaggattataggcgagagctgctgtgtgcttcttaagtgaggtaagtaacttccatagaaaatttccatcagttcattcatgaaagaacaaagaacctggcaaaacttaaaaaaacgtttccaagaatcagataaaagaggacaaaccttagggagaagaaggcagctgctcatttccagcaggggaagtagctgcatagagtacaaggactggtaggcctgttggctgttcctgtttaaggagacaagatgggcatggaacagggaccaccccctcctctgggagaagctgttacccccttcacttttcctcctctgtcattacccacaatcactctccttctttgcgctatggtaggtgtttacccatcataggaatgggcatttgaactttgaaactgaatgtggtgattacacttcatgctgaagcttttcacatgagtgctttcataagcattaagtaaaattttataatgactgcagtccaaggacattttccctggtttttggccagtctaaatattgtaagagagagagaagaaaagtgtacggaatataattgtctctaagctaagaaatgtggatgttcaaataaaacataygtacagaactctggctgctttcctttgtggctttgtgtgtggaggatgggtaggatcatgggcgatggtgcttctctgcagacatgaaactgagtccgagggttgttgacagttaaccacagctgtaatgctgaaaggcaaaagaatccaaagttcatttcaggttcatagagtaaacacttctgatctgtgacctatatccttgttcttggtattttaattatatttagtcatacttccaggtaaaaacaaatgacaggcatatatattctttagtatttagaatggtctggaaccagacttggaacttctatagattcttttaatgtgaaatttttgtatttatcctctccattatagtgattgaacaaaaaaatgtttwctagaaatcatattcataccagaaaacagatatgtgaaatacattttaatctactagaaatggaagaatccttggaagaggcattatactcatgggatgtcaaaaggaaggaatataaaagaagcctctttcatcctactcaatgctgttgttttaaatttaactttttacttgcctgtaacttctcgattcaagggatagttttaggattttaattaaaatgacattttaaatgatatatcagaaattcagaactcagaatggaatatactttggctttcacatagtagagatacaaaataattgaagaaatatataggaaataaattttttacagtgtctcatacagtgtctcataattttgccccacaatgtttagatatttttcactgttaaaaaatgtatgcatttacttagatggcattatgctggctgtgacataaaggaaataaaacagggatctctgaaccgaaagtttataacttaactaaaaattctaaaggattttaaattagactgaaattttctcagtccaatgaatggatcttgttcaaatttttatagtttaaaaaatcactggctgggcacggtggctcacgcctgtaatcccagcactttgggaggccaaggcgggtggatcacgaggtcaggagatcaagaccatcctggctaatatggtgaaaccccatctctactaaacacacacacacacacacacacacacacacacacacacrcacacacaaaattagccaggcgtggtggcaggtgcctgtagtcccagcygctcgggaggctgaggcaggagaatggcatgaacccgggaggcggagcttgcactgagccgagatggcgccactgcactccagcctgggtgacagagcaagactccatcgcaaaaaaaaaaaaaaaaaaaaaaaaaaaaaaaaattcttatgacacctacaattttggattctctgttatattctatatcttgacacaatgttactgtctggagagttaaccacttgtactaaggtccaaacagaaacaagatggtaaatctatgggtcttttgtctgtgtacttgttcataagctatctctacaggtttactcaacagcacactttaagatattggcactggaatagattttcccagctcagggttgacagtagatttcaaagctgagcttactctgtgtcaggcattaggggtaagttggagaacagggcaggtggaatgcctgcccccttggtgctctcttgtcaatgttttacctttatttcaaggtccagcccaaagccatatccttaggatccattgtttatgtggtcagactttcccaacattggtggtaacagacagtacatgccctcagtctagttcttgttatgtattatggttgcaatacaactacagatgtgtaatgcagttgattattccataacccatacacagtgttggtagatggcaccgtggcctattaagaaattttacccaggacccagactccaaatccaaatacacarcttgctaaaagcagtctttgcaagcttaacacgaaataaaataatttcaaagtggtgtggttataggtataagaggattgttagcttccacttggggtttccagggacctggcgggatcttatcctacagagaacaccaacctcttaaggaaactgggaagcccagagaagctgcgccacctaaacatttcccagcctgtgatcctgtaagaaaagaaaaatagctcagggcagcctgagctgtgtgaggcatgtagaatttattaggcccagagagatgtgagtgtgagactttattcttaccacccacctcccgccatgcctaggggcagttgtttaaagtcatttcattccttattagctgcctcactcattatcctcacatgcctggagtttgtgatgcaaagaacaatgtatagcaagttatgttgtaacaatgtatagcaagcttatgttacgttgatgtaacttcttggtaaacaatttaggaactgcctcttttttcctttaaaaactcacttgtaactgctgctaattggagcacacattcagggcaaacttgaatccatccctctgggttacaattctcaaaactggcccaaataaactctgcttatattaagtttccttcagttttttcttttaggttaacatcagttacatttgcttagactgtatactttgagcatattcctgaaaactgtaaccctgatgagatttatgtgtcccaagtgtgctgtttcacaagtgtaatcacctgatgggttcttcctgcccactgactagacaaaaccaattcac

SEQ ID NO: 13274 - DNA, 415117 bp, Homo sapiens
  misc_feature (1)...(415117): n = A,T,C or G, or insertion/deletion polymorphism (see Tables 1-2)
ctggagtgcagtggcatgatctcagctcactgcaacctccgcctcccgggttcaagcgattctcctgcctcagcctactgagtagctgggattacaggtgtgtgccaccacacccagctaatttttgtatttttagtagagacggggtttcaccatgttgaccaggctggtctcgaacccctgaactcaggtgatctgcccatctctgccacccaaagtgctgggattacaggtctgagacaccgcacccggcctactctctgcctctatgagctcaatatttttaggttccacatgtaagtgagattaggcagtatttatctttctgtgcctggcttatttcacttaacagtgtcctccaggttaatccatgttgtcacaaatgacaggatttctttctttctttctttctttytttyttttttttttgagacagtgtcttgctcttgcccaggctggagtacagtggcttgatcacaactcactgtagcactgtagcttcaaaatctcctgggctcaagtgatcctcttgtcttagcctccagagtagttaggactacaggtgggagccactatgcccagctaatttatttttattttttatttttttgtacagttggggtctccccatgttgcccaggctggtctcaaactcctggcctcaagcaattctcccaccttggcctcccaaagtgttgggattacaggtgtgagccaccacacccagccaggattttcttctttttaaaggctraatagtattctattgtcccatagggactttagaatcaggctgtagaattctctggtgctgaggcctctgcaggcttctgtggagaagatatcccacagagggacctgcacttaggcaggttacaactgtggtctcctgatctttctccggaagccccagaggtacctgtggtctaaggaaaagaacccttggctgagtcataggacctagattctttgccttcgcttcagacagtagagagcagtggttaaagcatgagatttggagacaggcttggatgagaaccccagctccaacactagtttgctttgtggacttcagcaagtcatttaryctcttgaagtctctgtttccttatttgtaaaatgagaataataaaggtaactactgtacagggtttttgggaagacttaatgagataatatacacaaaacgcccaggacattgcctagcacttagtaggagttttgtaaatggtggttgcttgcccttaatatgaaacagtgcctgcaaacacagaaccttagcaagtttcagtgagtggaaaacatcccttcccatctctatcgtccctgctccagttgacagcctcattacctttggctgggactagtacagtagcctcctagcrtaaccatccacacccatctggtacctgtccttgggttacttttgctgttactttgacacctttcttggctgcttataataattaaatttaggtcaaatttcttttccttccttccttccttccttccttccytccttcctctctttcttgatggaattttcactcttgttgcccaggctggagtgcaatggcacaatctcggctcatcacaacatccgcctcccgggttcaartgattctcctgcctcagcctcctgactagctgggattacaggcatgcgccacaacgcctggctaatttttttgtatttttagtagagacagggtttctccatgttggtcaggctgatctcgaactcccgacctcaggtgatccgccagcctcggccttccaaagtgctgggattacaggcgtgagccaccacgcccagccaatttaagccaaattccttagctcaagggcctttgtaaattgctccaacacatttttttttytcccaatcgttatggtgaaaaagaacagaatgtgaatctgaagacaggggtccagtcctgggaccatccgctttctccctacatgactttgagtatatcatctcagttctacatctatacattagagatcattatgctgcctcatgggatgcatccatctttcctgctgaactgtgagcccatggtcaacaggcagggatgaaatgcatcttgctcacactgtatcttcagtaccctgcatggggcctgacaccgggtagatgttcagcacgtatttgttgaatgaatgaatgaatgaatgaatgaatgaacagggttgtgaggactggatttggcatgatccaggtaaagcgccttgcacagtcaccaggagacacgcccatatggtagctgttgctacgcaggttactaagtggaatgactttagacacattacttctctggaaacattcacgtatctgtcctaggagaggatagaagggactcctgcctcgttttgtgcatcattaggtcgtgtgtgcagaaggagctcaataaatgcttcctcggtggataaagcatctcccaaggctccacttggggctagcgctgtctaaagagactgagttccctcattggggcctggttcttttctgctctttaccctgcggggaagatgaggccttctttgggtccctccttcattcagttccagaagcccagcagataggtgggcctataggacccgcaggatctgcaggacgctctccgagagctggagcaagagcgccaagggcggggacggaatgtgggtttaagggaaacgggcgaaagaggggtgggcatggaaaagggtggtttgagaaccaggggccaggcagaaggacagcccggcagcctgagagagcgactggggggcggtgaggagctccaagggggcgggtcggctgagctggcccagggtcagctagcggccgcggggccggggcggagaggtcgcagagcagagggcggagaatttgggggtgtggttggcctgcgggggacaccggaggccactagggaggagttgcakaggggagggaccgagggagggcctgggggcggccagaggacgcggggtcagtgaggagggggcgccgggcgacggactggcaggggcgcgcggggcgggcggaagcgcaggggtggggtgcagggcggggggagcgcgcatcggggggcggggggcggcgtcggcgctgggagtgggggagcgggttgggcggctgcgccggctctgcttcagccgctgccgctagggcgcggggggcggggggctcggcgccgcgagctcggccattgtgggagccgctcccctcggctccgccacgctcccctcgactgcgctccagcctggggcgcgcccggccgccgccgccttcgctgccgccacgggcccgtcttcttcctccttcggctcccagggtaaggcgcggggcgcggggttggatgcaggcgccctgcccgctgcgcgggatgcgcagcggcggctggggagcggtgattgatcgcccccggcggccgcgccccakctcccggcagccggcggccgcggacaggcggcttgacaggcgcgggcacagcggcagtgcgggcctcgcacctgcakcccccgcggccggcgccggggagcggcgaagactcggagctggggtttcccctctgcgggcgctgccagggtggaagggaggcgtgttccccgggaaaatgggacacggagccctgcaggggccgggcgccggaccttagggagcgggcagggctgggcggggaaggtcgcttcccggccccagggctcggccgctggccccagcgccctgtcggtcctcggtcgcgcgtccccgctctttgtcagccacgcttggcgggcgcgcggacccacccgcgccgccccaggctcgcgggcgcgcccctcctccgccgtggggaaacgggtgggggccakgtggggagggtcgcagggggtgagagcacctggtgaggtgcctgtcgccgaccggcctgcggcctagggggtgggctggggcttgggcgggcactcctgtgagtctcggggattgatggaatgacccaggtggccgagggtcgggcgggagcccggaggtcaaacaagtgtttgtgaggggccggagattgacggggtagagcccagaagggacgctttctccgggaggaggccttgggagagccggcctttgtagtgaaatgggcgtcttggagaggaatgggcggttctgggatgaagcaggtggtctgagaggaggggcatttttcctgcccccgagctgagggtagggatggaagcttggcctgagtttcccagaggttgaggctgtcacttcagcacctgccctggcactagaaggtaatgggaggaggggtaagtgctaagataaagggcaaagctgtgccaggacctgggtcctttcctttctgcttcctgtggctagatcccttctagatgttctttgggaagagggctcacacgctgctggcacaaggggtgccctggcagggaggctctgctgcccgaggctgcctacaggcctcctacaccatttttatgtttcttttgttatctctttgaattctgtgcctatggtggggatctgccaatgacccaggaggctgtctctgccccttgctgcctctaggctcagattcgagaatcctggaggagctgtggccacagacccattgtgtccagccatgtaggctacctcgctgtctctacacagccctgtgagccggtattccctataagggaaaatcaacagctcttgccctccctggaccctacagccaaagtcaaagctgggtacccagsttggctttgcggcctgtaggaaggctggtagctgaaggcacataccatttgtgctctgatggagcccttggggtggtgggccatgtgtagcagatggttctgggaagtgagcttgacctgsctgagggaaggctgcccagtctggctggtggagcccagctggccttagagcaattgtatkttcactcaactctctccactagctaaactgaccagaaaaaatggrctttctgtcccatccccccaccccatcctcatgctgtgccacgtattcccacaacagcccttggaataagcaaatgaacatttaatctaatgcctgctgggtgccatgcatggcatcaaccagtactacatttgcatttgacaatgttcttaaaacatcctctgaggtggaatattacccccattttgcagatgaagaaactgagtctcagagaggtgaagtgacttgcccaagatcacagcaattgtaagtggccaaaccagaatatatacccaggtctgtcttacttcaagtctggtacaktttctmatatatctgctggagacagagtgggagaaaccagagaatttctgcctattctagcccatggtttgcttcttgcctgctattgagatcatgctttagctttttgaaaatacttcccatctgttgccccactttatccttatagcattcctgggaggtaagtagaacaggaatataataatagatactgtgtattgagtgcttactgggcagtgggcactattaagcactttacatgcaggattaagcactttacatgcagaacccaaccctatagggctaggttctaactgtygtcayccccattttgtagatgagggtgctgaggctcagagagattaaatggcttctccagggtcacacagctagtaaatggagtagaatttaaacccacagcattctgtcatgggatctgtgagcttaatcctccaaatgtgccaaatagcaataataatagttcctaggaataggagctaacttttacatgatgctttaagatttatagacatcatcacatataatatcccccaaacctcatgaattagttttgggatgtattgtcttcatcccattttccaggtgaagaaactgaggtacagataggcaggactagaacctctgcttcccaagtcccagtgttccttatgggaccccttttgtctgctcacattcacccctttctccttcagatcacttctccctgggctcccaggccctcctgcagcagcccccgcctgggccatgtcttcctcagatgaagagacgctcagtgagcggtcatgtcggagtgagyggtcwtgtcggagtgagcgatcttacaggagcgagcggtcrgggagcctgtctccctgtcccccaggggacaccttgccctggaacctgccactgcatgagcagaaaaagcggaaaagccaggattcggtgctggaccctgcagagcgtgctgtggtcagagtcgctggtaagagaggtcccccagcaggctggacgctgtgggtgtgagggaggaatgggccagggcacakcagctgtgtggggagccgaggggtcctcaccagggyctctgacaaagcagccatcatctgatttgttattattattcttggaaagacgttgaaataacattaacgaaaaactcaaaagaggaaaatctgccaccccttgctcacgtgagacctgttttcatttctgcaccttcttccctgtctttgtccccattcagttatattttctatgcagttgccttcatggcttaggtaccattctgcatctgactcttttcagttaatcttatattaaaaagattttccatattgcactttagactttatggttaccatttctaaaagctgtctatttcatgactttctaaatcctactcttttttcactttttggctatattagacaatgctgctgagaacatggttaagaatgatttgacttctgttatttccttrtaatgaaatcctyggagagtacagttttacttgtatcgccttccaaaagtgttctacatgctgacctttcacacgacgtgaaggctggggctacctcctgtggtgggatgtgcccagctctttgccaagcagcagcacagtgctgtagttatgagtgtaagctttggaatcagagagggtagggtgctggatcgtggccctgccactgaccaacygtgtgactctgggcaagtcccttattctttctcagtgtcactttccttgtcttaagaatgcccactgtgcagggatgccttgaaggttagatgaaataatgtgtggaaagcccttagcacagtttttggctcaataaaggagatgcttccactgaaggcatccacagctgcctccctgaagtgtgctcagcatctcagcagggtgttggtgttacagtacggataggaagatagagcagtgcctgcagctaattcagtgacatcacccgctttcaagccgtcaccaaggcctgtactgctaccttctttgtgtccctcaaataatacagccaccccctccactgtgtcatctctcacctggaccttccaatgagcatttaatagctcttcctctcttagtcttgccaccatcctccacrtgactaatagagtatttttttctaaaatacaaacctcaagaacacatattctattttatgaaatgaagtgctgcctgtacaacacttcattaaaaatacaataaaaaataaaataaaatacaaacctaattctattactcggctgcttaaaaaccacctttggcccctcattgcctgtggaatcaaggcttcagcataaagacccatcaaaattacttacctcttcagcttcacctgccaccacctctacccccaatcaccctgccacagtacactgtaactggacccccagagggatgcatcttgcaggatgaaaccaccacactttaattttcttctctgcaagatgctggtaaaccctcctcctcttttaagtgcygcctcctctgtccttaatgcccccagtggtatccaaagcttcctcctccgctctcacagtcatacttttctctcctccatgttcccttgttcaatgtagcagttaacccacagggtgcccatcactcccttagaagagtgagcaatttgggatgtgtcttatgttttgagcccccgagggctgcacggggccttgtacatgctagagatcaattggtattgaatgactgaatgaatgctgaatgagtgttttgaggatattatgtgatgtgacagactgtgatccagaaacaggcactgagctataacggaaagttagagaaaggcttatgtgggctcaggtaatcaggaaaggactttagagggaatgagctccaagtgaggagacarcagtggggcctggaaggcaggagggagagttggagctctttctagtgggcaacgaggagtccttggaggaagtccttctcaaaacctttgggcctgcagcatcagccagtaacagaattttagagctgtccctagggtgcaggaaggggtttacttgtccccagtcttgaagggccataactcagggccctgatgactcataaacctctttctcctgaagagagagtgggctgtctcattcttccttctttatgccctctgcctccatccttcatcactcatgcatacttagatcgttttgtgatgatttccacttccagtcttctctgaggaggcccacgggatgatttgcttgctgcttcagatttggagtctagaatagaagtggagtggactcaaggaggcttaattttacacaggcaaggctcctaaggaccctgctgggtcaactgagcaaagggatggtgggtgctgcgctgtgctgtgtttctggcatagatgctgatctcctttgcatcctgacactgctgaatgcctcttttgaggagggggctgggccagtgaggctgaaaatggggagactgccatggttaaaaataacttgtgcactgcagttgggcgtgtttctttagcaggagaggagagaggcagcagagacgaggcgggactgcgactttagggtcttgctgaaatcttcatgtgattttagaatgctgtgggggctccaccagagtaatggaaaaggcagccttagctctgcagggactccttcacaggaggtgcaggggggcatgtctgggagaccctggatgctctgaagctctctgaagcagaactttaattgtgggaggaaatgaagtcagtcttacgctggaagccagctgtggcctgtgcaattttctcctccccctggatcttgcttatgaagccaagtgggggtgtctgaatcactctcaccaaatagagatcttccctttccctggcccactccgtgtcctgagctggtcttagggcctcgcccttgcttgagaggcctgatggggcaagcctggtggtcacacatgtcagagtagagagggatgtcggggctgagaaacctgctgatttcagtctacaaagccaaacaggttttagggtgctgaaccttgttcttcttcccatcttcctgttctcatcctttccctacatttgtttctccttcttctttgccagccatattctcaactccctaagcccagccacattcaaatgtaacaagagtcactaatgaaagtgtcttgtttcggtttatcagctttatggtttacacagagatttcaaaataactctgttaggcaggacatatgttagcatccgaggctcagagggtttaggggacttgcctatagttacacaggactggtaaacacagatcttctaactccaagtacattgctatttctttttttttttgagacagagtctcactttgccacccaggctggagtgcagtggcgcaatctcaactcactgcaaccttcacctcccgggttcaagcaattcttctgcctcarcctcccgagtagcagggattacaggcgtgtgccaccatgcccagctaatttttgtatgtttagtagagatggggtttctttttttttttggagatggagtctcgctgtcgcccaggctggagtgcagtggtgcaatctctgctggatctcagctcactgcaggctccgccccctggtttcacgccattctcctgcctcagcctcctgagcagctgggactacaggcgcctgccaccttgcccggctaattttttgtatttttagtagagacggggtttcaccatgttagccaggatggtctccatctcctgacctcgtgatccgcccgcctcagcctcccaaagtcctgggattatagrtgtgagccaccgcgcctggcccgagatggggtttcaccatgttggtcaggctggtcttgaactcctgacctcaggtgatccgcttgccttggcctyccaaaatgctgggattacaggcgtgagccaccgcacccggccctgtacattgttatttctatttccttaggcaatacctggcaaccagcccagtctgaatcttctgtagttgacaatctaaatctccacactcacctgagagacttggtcacttccgggaaaggcctcaggatcctggtctatagaaccaggaaaggggagagacaaagatcttggaaaatttgcctcttcccctctggctctctgtctttagtgaagagcagtagaaatatccttacttaatggtggggagcaacaaggaagtggggcgctagggagcttactgtagcaaggagtacaaccccaaagggtagaaacaaagagaggaagaaatgatgtatcccttgggacctgtggggagtatattgagaacagggtgcaagacagggtgtcacatggctgtacactgcacaacccttgggggtgcgattcacatcacatttgttgtcattgcagacgtgtacatttattattacaagtttcctgcagatggcagtaacatgttttgaagaagggctcatgtttgggctagggcacggtagggtgcaggaagattccaccatctacccatcaatcaggtattcattcatctaacatcacataatcaggaccctccctgtccttggcattgatattcaaagatgactgaagatgtggtcccttctgcatggaactcagtctagtggagaggayagaagggagaaaaggccgggtgtagtggctcacacctgtaatctcagcatttcgggaggccgaggcaggagaatcattagagctaaggagttcaagaccagcctatgagaccctgtctctattttttttttaagtagttagaagggaaaaaataattatatccccgtatgtgttgtgaaaaaggggagtgcagtgactcagagctaaggattggatccctctctggttgttcatttattcattccttcaactaaaaaaggggttaagctatgtgccagtagaaagcatctatgggattcattcctaggagtatcagcaaatgctgctgaaataatcattcccaacatctgctccattgtggccttctagtcagacgacaattgtctctctgcacagcccttgtttcagttggctttatattcacgttcattgttcccaggttcatttccctcaccagctctggaggtctctgtagtcaggagtcccatcttaccctttttgccctgggacagagagccatgagagcactacctggtcagaagctggagcttactcctctgggcccatgtgtctctcctccaagttgggagctctgagaagacatctcacaggcacctctctgcttcattcattcattcaataaaaaaaatggattaagctcctgccatgtgccaggcactgcggagataactgaatctggagttacaagacttaggcaaatgacctcacttcttggatcctcagtttccttatctataaaagggagatggtgataaagggtgtaaaagggaaatgaacgagaatcagaatgtgctggaaaaacacaggttcacatggcccgttactgcacttaacagtgtcattccttgtaacctccctggcagccagatgargcagtggagactcaggaggccagcagtttcccaggccagcaaagaaggagcccaagcctcttatttctgtccccttcttttgttctttaggcctttgtcagggagcagatggaagtggcttattctggccaagccgtgagtgggaagaagggaatgcagggatgggaaatggaaccctaaagacaatctcattgggaatccttactcctcagctgccaaacttccttgccctgaggctcttcgagttttgtatccaggaaggctcctcctccttcccagcttctctacttcttcctggcagtgtcctcagagtctctggccctgtcctggagcttggtttcagtagcagcagagaagagcagaggagagtgccctgaaagtggggcagaatgaattgtagctacacaccaccagctcagctccagctctttgaaagtaaatctgggtcacattagctgtgggctggaacatgaccacgtgggcagaattctgtgcaggcagcagaaaagacagccaatctgtcctttctctgaggtgcagggcccctgtgggaccccagttggtgagggaaggtggtttctggattgcaaggtgtaatgccatcttaatgccatcatgcttttctaatgacatcctaggtgacatagagaaaggtatggaatggcagtttggctcatgcctttctgtttgttatgggagaagcctaggctgaaggtaggaatgcagaggaaggactggttactttggggactgtggaaggccatcatttctcagtctcatgggctcaggggttagatgccaccagagtagctgacactgcagcaggatctagggctgcacttgttctttatttcagcagtcctccccttgaggaaaggtctgtgaacagatccatcatcactaaagtgttatatggagcctggctggcctcctttttctggttgctgtggctagggcctgccatgatttggcccggccactgcttgttgccacatgtcagttacaagcctgccagcctctttctctgtcttggctttcctgtaggagcagaataggtgtcccttgctggaatctctgcctggatctgggatactgctacagggaaggtctgaagcccctataacttgaagggtgatgattatgagctgaagcttctgtcttaagctgtgccccacccctaccccagaagataycaggcttttgccttgtggtcaggggaggattctgcctggggcctcagtggatgtctctgggatgccctcccccactcattcacacatttcttcatgtgctcactcttccattcattcacgcaaagggctggctttgggagtcagctggagccctagtttcattgctcacttgctaattgggtgaccctgggacgttagtcacttcattgagcctcagtttcttacagttaaaatgggggagcaagagcactacctcagagacttgcacagtagattaaataaggtagttgggagtaggatgcttggcccagtacctgctatatattcagcccttgataattttttttttgagacagagtctcgctctgtcaccaggctggagtgcagtggcacgatctcggcttactgcagcctccacctcccaaattcaagcgattctcctgcctcagcctctggagtagctgggactacaggtgtgcgccaccatgcccagctgatttttgtatttttagtagagacccatggtgggtttcaccttgttggccaggatggtctcaatctcttgacctcgtgatccacctgctttggcctcccaaagtgctgggattacagccactgcacccggctgcccttgatacatattagctcttttcatgaatatcattcattcactcatacacttgttcatagattcatgaatgtgctgatttatccccttgcttattcactgattacacacttgcttatttaacaaatatccctagggctactttgctctaggctcagactgcacttcagagcccagctcctgcctatgaagaccgttagaatgcagcatgaactgagctacrttgcaagtccaaagagttttgaggaagttctggaagggaaggcacttctactcctgcccctccctggcttagagcaatgatagyatttcttctggggctgggaaaagaaataggaattagcyaggacaacctgaagagacagggcacttcccggtggtttgcatctattcttgctctcctttctttggctttcgtaggaaggaaagaaggaaaatgaagagagaacagctggtgagaattaggaactaaagaatctagacggtggtttggggagtgaactctggactcagtttaggagcaccttagagctggtgccagctgggttcctccggtgaataatagctggtaaagtcactgtgtagagtcctagatgggtgccaggcattttacatacatcatttaatcctcatagaaccctgggaagtagttgctattctcaacagaaatgttaagtaacttgtctgaggttatacactgagcaaataatggagctgggattcagcattacttaatgtgcatggcrccccctggccctcaacatgtacaatatgccctttgcagttattcaagtgctgagtttctggtcagcctaactccaaagccctggcacttttcaggatatttcaaacatagtaaagtagtgagaatagtacagtgaacccccatcacccagaaacaagaatgatcaattaattcatggccaattttatttcattcatacaccgctgtcagtggaaaaaacacagttcctgttttttcttttttcttttctttcttttttttttgagatggagtctctctctgttgcccaggctagagtgctgtggtgccatytcagctcactgcaacctccgcctcccgggttcaagcaattctctgcctcagccccccgagtaactgggattacaggtgcctgacaccatgcccagctaattttwttgtattttttagtagagacggggtttcaccatcttggccaggctggccttgaactcctgacctcatgatccacccgcctgggcctccgaaagtgctgggattacaggtgtgagccaccgcgcctggcaagttcctgtttttccattctcttactcaacaatcaacacaagaagacttytgtgacgccaagatatgtggggacttctccccgccagcaagttaaacaatagttctgcagtggacaccagcggggtgtcctccagttcaattacaacactgtctacctggaaatagcatcagatctcacagtttgagggttcagtccccaagacattcccctactccacttctttttttttttttttttttttttttttgagatgatgtcttgctcttgttgcccaggctggagtgcaatggctcaatctctgctcattgcaaccaccgcctcctgggttcaagggattctcctgcctcagccttctgagtagctggaataacatgtgcgcgccaccacgcctggctaattttttttttttttttttttttgagacggagtcttgccctgtcaccaggctggagtgcagtggtgcgatctcggctcactgcaacttctgcctgccgggttcaagtgattctcctgcttcagcctcccgagtagctgggactacasgcacacgccatcacacccagctaatttttgtatttttagtagacacggggtttcatcatgttggccaggatggtcttaatctcttgaccttgtgatctgcccaccttggcctcccaaagtgctgggattacaggtgtgagccatcacgcccggccaagggattcttttcttttttttgagacggagtcttgcrcttttgcctaggctggagtgcagtggtgtgaacttggctcactgcaacctctgcctcccgggttctcctgtctcagcctcctgagtagctgggattacaggcgtgcgccaccacacctggctaatttttgtatttgtagtagaaatggggtttcaccgcgttggccaggctggtctcgaactcctgacctcaggtgatccaccgcctcggcctcccaaagtgctgggattacaggcgtgagccacggtgcccagccccaccccactccacttctaatgccaatcacaagactcagattttttttacctgtgcttctgactgactggctataatggggtgctggctgggtgcagtgactcatacctgtaatcccagcattttgagaggccaaggtgggaggctcgcttgaagccaggagttcgagaccagcctggataatatagtgagaccccgtctccacaaaaaataaagcaaaattagccaggcaggagaatcgcttgaacgcrggaggtggaggttgtggtgaactgagctcacgccattgcacttcagcctgggcaacaagagtgaaattttgtctccaaaaaaaaaaaaagaaaagaaaaaagaaagaaatcgggccgcgcatggtggctcacgcctgtaatcccagcactttgggaggcccaggcgggcagatcacctgaggtcaggagttcgataccagcctcaacacggagaaaccctgtctctactaaaaatacaaaattagccgggcgtggtggtgcatgcctgtaatcccagctactcgggaggctgaggcaggagaattgcttgaacctgggaggcggaagttgcggtgagctgagatcgcgccattgcactccagtctgggcaaccagagcgaaactctgtctcaaaaaaaaaaaagaaaaaaagaaattagccaggcgtggtggtatgcgcctgtaataccagctactcaggatgctgaggtgggaggattgcttgagcccgggaggtcaaggctgcagggagctgagattgtgtactgcactctaccctgggctacagagtgagaccggatctcaaaacaaacaaaacaaaaaccacaaaacacacagaggatacaggtgaagagatgcagagggcaagggcgaggtatggaagaaggaatgtggtgcttccatgccctcccttgtatgccacccttcaggaatcttcacgagttgttatcctggaagctccctgaatcttaggcctttcatggagacttccttgggtaggcatgattgacaaccatgcagamatgtgattgggcaaaaagggtatgtctaacactaacagtgtggaaacccagcaaagcctggctgttcagattctgcttgaattttctatgtagtattccttcccccagggtatggggcaagactcctgaaataggggtctcatgattatagtcagaaatgtgggggaaggcggctgggtgcggtggctcacgcctgtaatcccagcactttgggaggccgaggcgggcggatcatgaggtcaacagatcgagaccatcctggccaacatggtgaaaccctgtctytattaaaaatacaaaaaaattagctaggcatggtggtgcgcgcctgtagtcccagytactcagtaggctgaggcaggagaatcatttgaacccaggaggaggaggttgcagtgagctgagatcgcgccactgcactccagcctggtgacagagtgagactctgtctcaaaaaaaaaaaaaaaaaaaaaaagaaatgttggggaaggctgagagtggtggctcacacatataatcccagcactttgggaggccgaggaaggtggatcacttgacaccagaagttcaagaccagcctgagcaacatagtgagaccaccatctccacaaaaaaaaaaattaggtgtggtggtgcatgcctgtagtcctagctacttgggggctgagaaaggaggatcccttgagcccaggaggtcatggctgcagtgagctatgattgtacyactacactccagcgtaggcaacagagtgagatggctgtctcaaaaaaaaaaatggctgggtgcaatggctcatgcctgtaatcccaacactttgggaggccaaggcaggagaatcacttgagtctgggatatcaagacctgcctgggcaacatagtgagaccttgtctctagagaaaatcaaaaaataatccaggcgtagtggcacatacctgtggacccaaccactcaggaggctgaggtgggaggatcatttgagccagggagatggaggctgcagtgacccatgatcgcaccactgcagctgtgatcatcatcatccagcctgggtgacacartgagaccctgtctcaaaaaaaaaaaaaaaaaattgcaggaaagattgagtcttgctttgggaggaaaaagaaacaggtgaaaggagggcaggagggcagaaagattctgttttctaagacttgacttgcttctgaggtctacagtgcctcaacattatagcagaaaactatgacaagggctatagaagttatgagccaggaactgtgaacgaaaaaacccatatattgcaaccccacttctccctccccagttatgtataagaaagttccggtagctgggtgcagtggctcatgcctgtaatcctagctactcggagggctgaggcaggagaatcacttgaaccgggaggcagaggtcgtagtgagtcgagactgcgccactgcactccagccttggtgacagagcaagactctatctcaaaaaaaaaaaaaaaaatcagaaagttcccgtaatcacatacttctaccttcctccgtttttgtttttgagacagagttttgctctgttgcccaggctgcagtgcagtggcacaattgtagctcactgcaacttcaaactcctttacttccctcactttttaaccattatattatactacctttcctctagtagtaaatataccagtttatctgcttcagagtccatgtctgaggactggaaccactgccacctgacctactgcccagagtcttcatgagggattcctttttttttttttttttttgagacggactcttgctctgtcacccacgctggagtgcagtggtgtgatctcggctcactgcaayctctgcctcccaggttcaagtaattctcctgccytggcctcctgagtagctgggattacaggtgcccaccaccacgcccggctaatttttgtatttttagtagagacggagtttcaccatgttggccaggctggtcttgaactcctgacctcaggtgatccaccygcctcagcttcccaaagtgctgggattacaggtgtgagccaccgcgcctggcctcttcatgagggattctaacacccagatgttcaggctccaggggcagtgtgtccctcctagcrttgcttggctgatcctctggtccttccagcttgaggttcaggctctatccccagaacacacagagctaggctagagcatatctggttctgttctgccagtataattaaactaaatatccaaaaaatgaatttcaaggattcaatcttgacagactgaagtcgagttgcaataggattcaggtccttaacatcatggcgggaggatagcacagtggctcatgtctctaaccccagaactttaggaggccaaggtgggtggatcacttgagctcaggggttcaacatcggcctgggttacatggcgaaaccccatctctacaaaaaatacaaaaattagctgggcatggtggtgtacacctgtagtacaagctatctgggggactgaggctagaggatcacttgagcctgggaggttgaggcagcagtgagccatgttcatgccactgtactgtagcctgggtgacaaagtgaaaccctgtctcaaaaaaaaaraaawtcatcaagggaatgagttccatttttgttataggggcctgtgccccaggactgccctgatgctggtgaactgcttcacgtgactctgatctcaactgagagcattggccaccactctcaagggcctctcccggcctcagtgatttgtgctctttccaggctgcctgttagtgcccctttagaggtttctaccttgagatggtgttggatggggagctgtggcttcaagtgaagagaagtttcatagattaaaaaaagccacacctcacagtttggggaacctcccaattccccaaagagtatagactgcctcagaggatccacacagggtaagaccctgtcctgcctcagagcaggaagagagattgggtatggttcagcagggctcacattagcctgattccttcaagagtgaagataaaaacagttttactgacaaagaagctgggagacagcagaggggccaataccttttataactactattgttaggttctgaatgccagccttggcgctcagcatcttacatgctgtatttgacctaatcctcaaaacaactttaggaggcagatgtgctacagcagaggaagcagaagcccagagagtttggtaacttgctcaaggtctcccagccagtaaggggccaagcttggaatggtgctagctctgcctagggcaacccactgcctcccccattacawggaacagtagtttaataacagctaacatctgtgtagcacttcaaggttcacggagtgccttaacatccattatctctactgtgccttgggaagccggtgcggtgaggccttccacgcccctttgggatagctgcctgtcaggggtccagcctctgctcatttcttccaggaagcactggagattatttggagttggctctgacgagccacgggagaggcctagggagaggctgaggtggagcgacttggccagttgctatggtaacccagatggctgagtaaccattttgagggttgctatggtgatgggctgctggtggcagggatcttgtcttcctgggtggctggcaccctccaggcctcttaaattgagatgttgcactttctgaacagaagagggcagcatgagagcaggcaaaggcttcttaccccagagcggatttgggaacttgaggcaaagcttagaaaaggtttctaggagctgggcagaaagggagctttggctggtgcccaagaggctggtggagcttcacttctgagactagaactaggtaattttcttccaagagctggtcaaaggataatgcttggggctgccccttcagtgcctggcatcagctactattggggaatataaaagttacagcagacagctacccttgcaaggaggaatggagagaatatgtgcatgtgtgcacacacacacactcactactagcaaagaatttcttttttttgagatggagttttgctcttgttgcccaggttggaatgcaatggcaygatctaggctcactgcaacctctgcctcctgggttcaagcgattctcctgcctcagcctcccaagtagctgggattacaggtgaccaccatcacgcccggctaattttttgtatttttagtagagacgcggtttcaccatattggtcaggctggcctcgaactcctgacctcaggtgatctgcccgccctggcctcccaaagtgctgggattacaggcatgagccacygcacctggcctaagaatttctttataaagcatcagttaacacataaaataatgcagcatgaaccaaaggtgaagaaaagctgggaataaactttctagaggttgaggaaggagcactagcagaaagagaaataattttgtacttccctctttcctccctacacatgaagtgccctcagcccttgaccactgagtggacattgagttggattctcaattgtcttgaatcagatctggctccctcccccaacccccataacagttcaatgaggcatccattccttcagcaaatatttattgaacatctactatgtgcaaagtattgtgttaggcccagtgatgaagaaagatgaaatagatgtctttgccctcaggaacctatgaagtaggaggttaaggaggcagtgatacagacatccacagtacatgtacctggagttcaagaccaacatagtgagaccctgtctctataaaaaatttttttaaaaagctgggcacggaggttcacacctgtaatctcagcactttgggaggctgaggcaggccgactacttgagcccaagagttcgagaccagcctggacagtatggtgaaatcctgtctctacaaatagcacaaaaattatctgggcgtggtggcacctgcctgtagtcctagctgctggtgggttaattggtgggcgcactgaggcaggaggattgcttgagcctaagaggcagaggtgtcagtgagccaagattgtgccaccgcactccagcctgggtgatagagtaagacgctgcctctaartaaataaatagaaaaaaaatttcacgtcatttggggtgaactttcaaggtagatttcagtaggtggagttgggggatgggacattctaggcaaagcctcagagtctgattatagggaaaggaggtacacacaagggtgtcattggagatcagcctgaaaaggaagctagatgtctaaatatggaagacttggaattccaggcttagataagggatgctgtgagacaaacatactctctccttaaatactctagccttccagctagtcagtagtcacagacagccaagtattttaggatcatctggttcactcattcatgcatttaatcaaaaatttaggccgggtgcggtggctcatgcctgtaatcccagaactttgggaggctgaggygggcagattacctgaggtcaggagtttgagactagcctggccaacaaggtgaaaccccatctytacgaaaaatacaaaaattagccgggggtggtggcaggcgcctgtaatcccagctactcgagaggctgaggcaggagaatggcttgaactcaggaggtggaggttgcagtgagcccagactgcgccattgcactctagcctgggtgacagagtgagactccgttgcaaataaataaataaattaaattaaattaaataaagtaaacaaatatacaaaygcrcgcgcgcgtgtgtgtgtgtgtgtatgtatatttttagagaccaaattttgccatgttacccaggctggtcttgaactcctgggctcaagcgatcctcctgcctcggcctcccaaattgttggaattacaggtgtgagccaccatgcatagcattaaagaaatagttggccaggtgcggtggctcacgcctgtaatcccagcactttgggaagccgaggtggatggattacctgaggtcaggacttcaagactagcctggccaacaaggtgaaaccccatctctactaaaaatacaaaaattagctgggcatggtggcaggcgcctgtaatcccagctacttgagaggctgaggcaggagaatcacttgaacccaggaggtggaggttgcagtgagccgagatcacaccattgcactccagcctgggtgacagagccagactctgtctcaaaaaaaaaaaaaaatatgtatatatatatatatgtgtgtgtatatgtatatttttagagaccgaattttgccatgttgcccaggctggtcgtgaactcctgggctcaagcaatcctctggcctcggcctcccaaagtgttgggattacaggtgtgagccactatgcatagcattaaagaaatagttggctgggtgcggtggctcactcctgtaatcccagcactttgggaggccaaggtgggtggttcacgaggtcaggagatggagaccatcctggctaacacagtgaaaccctttctctactaaaaataaaaaaaattagctgggcatggtggcgggcgcctgtagtcccacctactcgggaggctgaggcaggagaatggcgtgaacccgggaggtggaggttgcagtgagccgagatcacgccactgcactccagcctgggtggtgacagagcgagactccatctcaaaaaagaaaggaaagaaagaaagggagggagggagggaaagaaagaaaagagagagagaaagaaagagrctgggcgcggtggctcgcgcctgtaatcccagcactttggaaggcygatgcgggcggatcacgaggtcaggagatcgagaccatcctggctaacacagtgaaaccccgtctctactaaaaatacaaaaaattagccgggcgaggtggcgggcgcctgtagtcccagctactcgggaggctgaggcaggagaatggcgtgaaccccggggggcggagcctgcagtaagccgagatcgcgccactgcactccagcctgggcgacagcragactccgtcaaaaaaaaagaagaaaaagaragagagagagagagagagagagaaagagagagagaaagaaaagaaaagaaagacgaaatagttaatgagtgccctatatgtgccagatcakttgctaggtgctaaggatcctgtggtgaattagacgacaaacagtctcagccctcagggagcttacgatttagtaaggatgagagacactgtaccataacttcaagtgtgatgagtattaccaaagggtagaggaggacctattaattggaggggggsggggtcaaggaaggctttcccctggggagtttcagcagaagcatgggtaggagtgagccaggccaaaggagagtgatgaagggttataatctgggaggaaagtcggttggatggccctgaggcgagataacacattrgaggcgctgaaagaaatagaaagtggcagggctttagggataggggtatttgatgaggctttaattgggaggacaccaaggataaagggcattaatttccttgtattactcttctcttccactagatgcccttccgagtacatccttctgcttcccccattgcagccttcttagaaatgcagcagcagtctcacccatcaggagcaaaagaaaatcaaagaccaaaaggagaaagcctcagagcttttgcgactgtgtggtctggctataaatttagactgttgcttgaaagaagcgaaaaacctccccttcatagacttccttcttcccatcccccctggcagccgctttgttcctctagccttgtaaaattttctctgtataaaacaggaacatcagccaaacatgtggacttccccactttccattcattagaagaatgcattatttcaaaatctcctgggagcatttaaatgcaaattttgtcaagaaagcaatttgagtcttagagaagcyctctagccacaacctaaagcagaagtttcttctttgatttgtgtgtttcttaaaaggaatctcaaccccttgccttctccctgcaacgcccccaggtcttctctgattctcacagcggactcttcccctttttgcccctgttctttcttcacctttggcaagcatcagtcacacatcttgaggaacctgctcacaaagtggcgcgtgtagcagccccaggtgggaatggagggacttttctatgtagtgtaatggacataaggaggcagatgtctgtgtgggggtgagatgtctgtgtggaggtgtttgtatgcgtgatttctgtctgggccttcttaggcctgctggtataaaataatatgggaaatgcagatgactcagcactgacacagtcaagatccccagagttagcatttctatattctctgctgtttacgaaaaatgtgcttgtgccatcaatcagcaactcatcctgcattttccgctaaaagccttttactgaaaaatgcatatacttcaaacttattccccttctttttgtaaactgagctcattagcagctgacaccaaactgagaactagttttgtttgtttgtttgttttagcacggaggattaaactggaaggaaatgagcatttgtctaaggatcctccctgtcctctttcaggcccttccctgcatgatcttcatgcccacaacttgggcaggccagcaaaacttgatgggaaaagatatgattaatgacttgctcacctgatttctgatcagggtgtggtgtggaaacaaccagcatgcacctattagygaaaagcgtcatttgttttacttgttaccaatgtgctgagcattgaccaaaatacttggcactactcacaaggtacaaagacaccttccctagcctggggttaagaagtttctccttcaaactcttgagaatgggaactggaatggaagcccaagtcccaattttggttgctcagtgttgcatgaattctttttttacttgctaatgtgcccttattgtgagatcagccagtgtaacttcttacccacaaccacctctccagacctcctgaaaaatcaagctaacaggggaggataactgctaaatggggggtggcgggcacaacgtgtcacctacattgaccagagttcttcattcactgctcatggctccagcgcactccatgaatattgggattgaatgatacacaaccgaatgttggatcaaatgatgttgggagctctgtcctcaaaatggcccctaataaatccctacccatattttccagtttcctttctttactctttcctttcccctgatgacaaagaataattggcttccccttttcttccctgaccagctatgctccagagtcctttctttgttccctaacagtcctggttccgtctcaggttcccacatttctcccttttgatctctgtctctctgttcagatggctgtcacagtttaataattctggagggtctatcccctacagatttatgtctccctgtctctcctcttattcaccccatggtgcattcagaatcccgttttcgtgcctccctgggttgtcatttctcaggctctggctccttggcctggtttacttcatggtgctggatctgccccgtcacttcttgttcagcttcttctgtttctggaaaaccctttgttcccgggcttctttgtgggctcagtgtcctccggccctacactgcagccctgtctggatcttgcccttgtcctcgttctgaccgcgtctagccctgggatctgaggcatcgtggtcttttgccctctgctttcccttcagtttctccaggtccttctccagcagccgcacaggccccgctgggtttctctccagccagggagaaaccctcctttgtcccgctcccggcggcgtaggtcagcgctgactggggctcccgctcgccctgtggagccggcccgggtctcccygccgttcggccggcccagcctttcatcctgacgcgcggggcctcccacccagcgggactcccgcgtgggccggcctctcgcgcccctcggctcgggccccagtccgggccgggcgggggtcggcagcccctgggggmcccgtgtgggcagcccgggcccagccggccgcagcctggggccgaggactcgccgggacccgraggcggcggggagagggggcggggaacgggccgggcctggcgctcctgacaggaggagccgccgccgccgcccgccgctgcagccgcgccggggcgggctgagggaggagcggagccgaggggtgaggacgcggaaacgcgagccgggaccggcggagcgcgagcgggccgggtgcgagcggactgaggagcggagcgcgactgccgggccgggcgaggcgggcggacggcggagagcgagggcgccgtcgccgtctctgagacgcacaaagggycgaggctggggccgccgccgcctcagcgcgcgggcctggaaccggcagcccccggggctcggcgagaaggcggtgcgggcggccatggccggctacgtgccgggtcagcagccggccaaccgcagccaggagaaggagttcgtgcaggcgtacgaggatgtgctggagcggtacaaaggtagggccggggactggccggcgctgaggcccgcgggccggcgcagcgtggccttcggagccggtcggctcggcggctgcaggtggggcggccgggcggggtcgcacccaccgcgcggggcttggccctgagctgctgcttctcggggccagtttatttacagagttgagataagccttcggaaaccgcccccggggcagtcggcgcgctcagagcgccagttacatgatttgccctrttatccggccccagctggaagaaggcgagacaaggcgctggcctggagaccggccgccgtggggagttgctggggaggaggaggaggaggagttgggcgcgggagaaaccacccgctctgctctgggtgcgagcttcctcccagaggggctcggacctctgtgtgcccgcggagagtccctccctcgcccccttttgtctctytgagtctcggatgagtcgcgtggaagccgaggttggaaagcaccttggtgkcttcggggtggggtgggcagcggtgtgggtgagtgtgcagtttttggtggcgagaccttaccccctccatctccccgggggtctgggcctgctggaggtrggggtctgtttttttcctcccacataaagatttgccttggagctcggatttcagccctgaaggctctcttgcgagacacttctgcaagttaatgcctaatctgcgccttgggtgtatggggagaaagttttgacagacaagagggcctgtggactgcatttccctaactgctgtaggtgcccctgaatggaagccagggatgcgtggccttgggaggcccttgccttgatctttaacatccggttctgggagtttgctttggctggcagttatgctttccacagacggggagattttcccagaaacgacacaggcagcacttttccccattttattcagctcgggcccttgtgactaggcccttagtttctttttatctgaaggagaggaaacttcagcccctatgactgagtccagcgtacttgtttacagcacctatccagtgaagggaaactaatgaagaagctgtaaaacgccccccctctcccccctcccccccactttttttttcttgtggcattggaactctgcttgggaatgcagcaggaaaaaagtagagatgaaatgcgaaaaaagacctactagggtttttgcttgttccctctgcatcagctcctgtaaactgtccagcttttcctgcctgcagcaagttttctgtcaaccccctgtggtctttctttttaagaaatgtggttcatttcagagcacaaagaggttagattgtgctgctgaacttcattgaaaaaatgctgctcagtgaatggttgcattaagtttcctttgcaggcttttgagtaacactgctctcttcagagagaggagatacattaggaccgtcccgggctgtgacagcttcaaaccagcagaattaagacccaaaataggtgaagaaatctcagcacctcactggatggtagtactggtgacctccagcggaaaggaagttggactcctagcaaatgaggctgggaaagaagggggcagtagggcttgttccargagagacctcttttgttcagttttttttttttagctgtctcactcagtttggctttcctctgaagggccttgatcaggtgtataggaacttaatccttcccagacacaggtctctttcttgaggggaggaatgagttaaaaatggttgcccaaagtaaattacctcgagttgtatacggtggtcgtgcagtctgctcttctgatcggtgcagaacaatctctcttccccccactgcacmgttctcactgggaggtcagagtggcttagcatccgggcctttgttactttgcttatggaattcctgcattttccagacttagaaatccccgtactaccttaataggagaacagtttgtctaagcagaggagtgagctggaatctatagagtgaccaggggaaggagtttgtgaggatcatgccacgtattggttttggaaagagatgggaaaatagatattgatgatggtggggtgttctagacccttattggctggtcaccacattacttggatctctctctgctgctattaatttgtagtcacctcattatacaggctgaagcaggatttttatatgcagaaggagagctaaaattttcagctgcctaaactgcccctagggccaatgggagaagggcagtaatgtatttggagtgtgagggaagcagagctgtgtgtagtgcagctgtattaggaatggtagtcaagtatgggttttccagaactgtgcttggcaaccatttttttttttttttctgtgtggtggcagtgagcatggtcttggcaggattagatgattcagcatggaaataaatgctctcccttatttcctaaatgtcccaaaggttctttcagatagctggccagtaaacaggaggcattagataataacactggattctaacagttcagagtgggcagcagccaagagaaccagggtatatccttcatttccccaattctctgacagtcattaaagtctctcttggaggtgccacaatgttagatgccagaattctgaatgagatctggttcctgcccttggttattccatctagtaagggaaagatacttgcaaacaagtagttgtcatactgtgataagtgctagaacagagatagtatggaagccagaggaaggctgaaaccctatttggatttacctgggagatttgacaaaggaggtgacatgagagggttttttttttttttttttttttgagacggagtctcactctgctgcccaggctggagtgcagtggcacgatctccactcactgcaagctctgcctcgcggttcacgccggaggaaattaagaaggaatagtcagggaggtaggagaaccaggattttattcctctcctaggatagagaccaactctactgaagaagcaggtcacatatgagcatagttttaggttttaaagaggtggttaaaaaccagcacacttggttgatggtggttggttaagacagaattagacttttgttttcacaaagctttaaggactaaatagtctttacttgctgggctgggctaggaataaaagagaacattcacatttcaacattggtaacatctatctggtacttatgaaattcagaattgtcactaagtgttgtgggttatacgaagctagttaggaccaattttcatttatcctagtgcagaaaataacttataaaacttactgcacagagggttacaagtgaagagtctgcatattacttaatgtacaaaattgatatcgtagaaagactatgctttggatttcttctgttgtgggctccagtcctagtttttgccagttaatttctactgtgtgaccttggaaaagatttctctcatcttttgggtttctcatctgttaaaatagggatgataatactaatttcttgggattcatgagaatataaatgagctctgggcatatatttgtcctttaatgttccattttattttactttactttattttgaggtggaatcttgctctgttgctcaggctgggatgcagtggcacgatctcacctcactgcaacctctgcytcccaggttcaagcaattctcctgcctcagcctcctgaatagctgggattacaggtgcacgccaccatgcctggctaattttttctatatttttttttagtagagatggggtttcaccatgttggccaggctggtcttgaactcctgaccttgtggtctgcctgcctcagcctcccaaagtgctgggattacaggcgtgagccaytgcacctggcctattttattttttaactcttttctctccttttttttttttctatctcctaccagaaggaacctttaatgtttagaaaaacgttgatttatatcttatttaagctttataatatcctgaaggatagtattacacagatgaataaatttaggcacagagacttaaaattactgtctaagagccaggctccagatttctgggtgaaggtttcacattgtatcacagaagggagttttaaaatcacagtagatgacttgggctaagtgagaaattgtgaaaatgctttaattgttagtatcattattgttgttagttttagtttctgaagtatagtcacacactttaagtgacatacatttccagatctctgaactgtggagaatttcttttccccttattatgggagaagttttacgatatataaatcacattgaaattttcatacaaaaataatacaaaataaaataaaatacaaaaaatacaagaaataaatacaaaaataatttttaaaatagtacaaaatgatgaaattttgttaacacagtgattggaaaatatgggttgaggatttgggattgtttacctaagtgacgctctgaagcaaccttttggttatatgtagattcagcttatttatcctttttagtggatgttgttcttttttttttttttttttttttgagacagggtcttgctttgttgcccaggctagagtgcagtgtggtgagatcagggctmactgcarccttcacctctcaggctcaagtgatcttcctacctcagcctcccaagtagctgggactaacaggcatgtgccaccatgcctggctaatttttaagtattttgaagagaaaaggtctcactatgttgcccaggctggtctcaaccccctggcctcaagtgatcatcctgccttggcctcacaaactgctgagattacaggcttgagccaccgtgcctggcctacactcagtttttaagttcctttttagatcaaagtcctagagttggagtggatagtttttagccagaacaaaagagtaagtgctacttctggacatgaacactgttaattcagaaagtgagtcaagtcagtctgctgggaaatcacaagttttggccacattcatgctgttgaaataataaaatgtgtccatgtgctaacagtgcttatgggagctactgccttgtcttgggcttgttggcaaatgacgtaatacaaaccagggaaatgcaccagcgtaagcctattatactggtatttttcagtgccaattccaggtttaagagatcatggtggaaagaatacttcagagtgcatatctgagaacagaaacatcccaagatcaaaagtcacaaatgaacaattatagattgtaaggagtctgttgtgttttctcagtgttcttgaaaacacccagtctttactcctttttctaagtaaggttggccctttcagcttctgataattatatattgagccatgttgtgactaggttgtatggaatgctagagctcctgtttttactctcatggttttgattggagttgaagcctctctcgtctggcttctattggtggcatttactaattttctggcctggtaaatggcttgtggtagctaagaatgtttattccagttttttggagacagggtcacccatgtcagagtgcagttgataccattgtgtagctcactctaacctcaaacccccgggctcacatgatcctcccatctcagcctccsgagtasctaggattaaaggtgcatgccaccatgcccagctaattattttatttatttatttatttatttatttatttttggagacggagtctcactctgtcacccaggctrgagtgcagtggtgcgaactcggctcactgcaagctccgcctcccaggttcaygccattctcctgtctcagcctcccgagtagctgggactacaggcgcccaccacacacccggctaattttttgtatttttagtagagagggggtttcaccgtgttagccaggatggtctcgatcttctgacctcgtgatctgcccgcctcrgcctcccaaagtgctgggattacaggcgtgagccaccgcacctggcaattattttattttttttatagagatgggatcttgcaatgttttctaggctagtctcgaactagcttcaagccatcctcttgccctggcctcccaaaacgctgggatttcaggtgtgtatcttctgaaagtacagtttgttacttctgatgaaatatttttttcttccagagcttctcagtttctgaagtaaattagaattaatctctgattctttgtctctttcagggcttttcataatttgacttactctgcacacccaactataccatctgttactgcctaacacatctctcttctccwtttggactggtcttagcaaccttagcaacccttccccctgtgtcctgtgcctttgtttacattctcttttccaggaatgccctctcccttcctgattattcaaatctttttttttttttttttgaaacagagtctcgctctgttgcccaggctggagtgcagtggcatgatctcagctcactgcaacctccaccccctgggttcaagtgattctcctgcctcagcctcctgagtagctgggattacagatacatgccaccacgcccagctaatttttgtattttttaatagagacggtttcaccatattggccaggctggtctcaaactcctgactttgtgatctgccctcctcgacctctcaaagtgctgggattacaggcatgagccactgtgcctggccacagtaaaatctttaaaagatttttattaaagaagtaagatgtaatcccagcattttgggaggccaaggcgggcagatcacttgaggccaggagttcgagaccagtcaacayggtgaaaccctgtctctactaaaaatacaaaaattagtcaggcatggtggtgcaatcccgtggtcccagctacttggatggctgaggcacaagaattacttgaacctgggagacagaggaggctgcattaagccaagatgacaccactgcactccagcctggacaacagagcaagactttattgcaaaaaaaagaaaaggactttgttctagaaaagtcctgggatgaggggtaattctttttcaaggcaaatcttctagaaaagaattagcagtgttagtatctaaacttaattccctgtacctgcccaaaatgttctcaaatacaaccctctcttctttaacagtcatccctagagctgggcrtagtcccagtttctaagaaggctgaagtaggaggatcgcttgagtccaggagtttgaggctacagtgagctatcatcaccccactgtactccaacctaggctacagagcaagaccccatctcaaaaaaaaaagcaaaaacatcatcccttaatctaacctcatgactcaattacaatgcggcttcccagagagtagatttctactgtcacccatcatttacataacctcttcattaatcctgcccatcacataaaactcaaattcttcctactggcattccagaccctcctctccctacccctaatctcaatatcattctttcagtgcttctaagtggctcacccatctccctaataccactttccccatcatagtatctgcttgtaggtactagtagaatatagtgcacacagtgagcttattcatggttgttgactgactaaaaagcacagraaaaaaaatcacttcctatrtgtctcaatccaacatgttcctgcaggttgaaaactataaactccaaaaaacacttcaagcaagccctttcctttcatcaacacaaacgaattgtgtttatcgttctgaataaaaatcactatggaaatttgccatggtaagagggaatccaacagtacatctggcaatgctcttgtctaaaagaaagatgctgactgaccaattatttaattagtcttaggtgactactcaaatcatccctgataattggaacattcctgatggttgacacatggtcatacagaagaaagcaattttaaacagagaaaaataaaagcttgtgccaaatgaaagcagacttccactataacacaattttaggtagccacagcaagtggaggatatcagatcccaggcaagcaaaaaagatcccatccttggccaggtacggtggctcacacctgtaatcccagcactttgggaggccgaggtgggtggatcacctgaggtcagaagtttgagaccagcctggccaacttggcgaaaccccatctctaccaaaaatacaaaaattagccaggcatggtggtacatgcctgtagtcccagctacttgggaggctgaagcaagagaatcgcttgaacccaggaggtggaggttgtagagagcccagattgtgccactgtactccagcctgggtgacagagtgagactccgtcttaaaaaaaaaaaggtcccatcgttgctcactccattttttcccaagcatctacctgttggtcagcttgcctctctatcccctgcccctacacaccccsacccaacaaccacagaaagcatattgtctaaagctctgtatactttactgttttttttttttttttacaattttccacattaatatgtgttcataatatgaaaagaaattattcaaaaatataaatcagttggcttccctggtggtctagtggctaggattcggcactttcaaaaatataaatcaaagtccatgactctaaaaataacatatgcattgatatgctcgcccctttgacccttctctcaagagaaattccctgccaagtaatccacatacataagaagtgtaaaaagtccctagattaaaagagcataaaacttcattatggaaacacagtagtcccagctatttgggaggctgagacaggaggatcacgagtccaggagtttgaggctacagtgagctatgatcacgccattgcactccagcctggatgacagaggaaatattaattttagagtaatcagagaaagccgcatgaagaataaattaataagtatttattgaatgtctaccatgaaccagggagtaggtgatgtgctgagaagacaaagatattgtccttgtctctctatgatcttactgttaaatggaggaaacatattggcaaactgacagttactgtctattgtagggagggctatcatatagataaatgctgatgctgtggtagtgaagaggagtacccagtatagccagagtgagaaagtgtccaggaaggcatccaagagtaagtgaaacctgaactgttacctaaaggatgtgggaccctgagcaaaaagtttggggaaagagcattctgggcagcatgaacagaagtaaggggatgagcaagcttgagagggggaatattgggcattgataaggttggagcataggatgtgagggaaggagagatgagatgagatagggagagtgggcaggacaaaaatgttgactggctttgtatgtcatattgtatagagcttggactttatcctaaaggcttttgggagccattgaataaaagtaggcaaggaagactatgcttagatttacattttaggagtacttttcctctggcagcagtgccaaggaaggtaggggcgaggaggaaagactagtggcagacaagttaggaagctgtcacaggaatttaggcagggagtgaaactaaggttgtgaaaatagtaatgtaawaaagcaggcaaatcaagaaatgtgaaggggtaacatccatgtgttttgatgactaattgtatgtggtatatgagggggagagggaagaacctaggatgacttggaggtttctggcttgagtatttgtgtgggtgggtcgtgtcatgaactaaaatagagaatataagaggaggaaggttattttctgtgaagtggtggcagtgatggtccacgagaagatactgagtttaatttaggttacattgcggtcgaggcttctgagggatgctaggtagagatgtccaggaggtagttggttgtaatgaacatgaaacttaggagagtgataggtgagagggtgagagagtcatcagcttatcaaaccacagccataggaggggagaaggagctggctttaggagtgtatgtatattgagacaaaaactctggggaactccaacaggagagtggtgtcagaagcagagaaagaggatctcctgaaggaaattgtccacagaaagggagtggccagaaaggtaagaggaacaggagagaagtgagtttcaaggagagtgtgacacacattgtagattatgcagaggtcaaataaggcaaagactacagatgtccaaaataaaggttactgctactggaacattttcagtggagttgtgggaagtgaatggaaagtgcagaagaggagtcagtgacctttggaacttggactttgaaggaagagagaggaggaagacaggtgaagaagggtggggagagttttgtttatgtattgtaacacaggagagacttgagcatgtttattttaagtgctgttttgaaagagccagtagagaaggaagrtataatacaattcaaagacggggagaaaaattgatggagcatgggctctagagtcaaaagttgtgtcttttagaaagatcagagggttaaaaataagaatgcaggtgaytaagttggttggttagaggtgtaggaacttgagggaatttctcctgatgctcatactctctctatgaagtaggaggtgaagttatttgctgagagtcaggaggaaggaaagaaggggtgagtgtgtatgtgtgtgtgtgtgtgtgcacgtgtgtgtgtgtatgtgtgtgtgttttccctctagccctagaagcactcaacaacctgattgtaatagattccaaggcagacaggtagattgatctaggatcagaattttccagcatagttttgacggaagaatatggggtccttgtagtttgtcttaaaatgtagcatcagtttgattattgattgtttgtactgttgttctctggctggcttgtattttggctccccagtgaaattgtctactcctctgggaagaagcatatatgtaacttttgcattcctgcctgtcatttagctaaatactatgcagaaattaattcttaagtttttgttgagataatttgacttttggacaggacatcttgactcttgacatagagagaggctttcctcacttgtggtctttaatccccatctcattatctgacatggatagtggaggattcactcactctccatgagtgaactccaggcctagcttcttcattrgtcttaacaggttagctttactactctccccagggcagttgagctttgctttccatgaaggttatgtagttaatttgtactaggcttgtgaagacctgggtgtttacaagactggacagagaggctgttgtggaaaatgcagcctccttcttgtttattttggcaggcaggcaatgaaggagatagatttgttctcakgactcagagccctacctgctttaccttaacaggttcaatataaccaccacctttcagatgtgatagtgtccttcagagtttatctgacctttatatctaaaaagagtattagttaccctttgccctctacttgcttggttttttttcacttttattccagtgtagaggatatttcctaatgtgttagggccagctcagaattgatgtagttctttcccattggcacattccgcatctttgtttgtttattgccatgttcgccacagtgtgccttgttttgcgctccttgttttgtgaagctggactcttatcagataaacttgccatgagtcacactggggagtggaagtatgtctccactaatttggagaatctttgatcttgtttcactccctggtttggcttgtccagtgcaatttgtctctcaacctgmaagaggtgtgtgtgtgtgtgtgtgtgtgtgtgtgtgtgkacttgggtgtcccttgcctgtggcttcacctgttgccatgaatggttgacttcagggcatgcccctttgtgtatacagacttcctctactattgttatcaccatcagcaaaaatgtctctgttaagagcctctttgaatgtagaatatagtatataacactgagagttcataaaccctctgtcctctagggatttacagtatataatacacattacaaatgacaaaagacaataaagaatgtgtaagcggttgaacaaataatggattattgctcctcatttagctatcatattcacagtagaagatatcctaaaaagacatgtagtcagtgaggaagaggattaacagagaccagatcatcttcagctccaactaagatggcagagagctgccacctgtggccctttgatgccaggtaatttctctctgatatcctttctagtcaygcaggacctttttgccatattatctatacatatggggcaggatcctaacaggacctttgctctctagtggtaacctgtcactgaaatgggaggctccagtttccagcagggagagtgcctggaaggcttggctcttctggtacagttatctttgtaacttgagaaaatttattccagacctactacaaacattcgtgtgctcacaagcaccacagacagagcagcagccaaagctagctgcagcctgagcatgggtcagtgtagggaaagaagctaactgacctggcctgagtcacctctagaggggaagaatgtaggacttgtcccagcctttgttggttagtttcccaaatggaaaacagggaccagagtaggtggggtactttgaggtcctcatacctttcagaggactggatccttgttttcattcttgttcttattgttaataagtgtaataacagtattcatgtaacactgcctttattaggaagaatgaggaactgccaaagggctggaaattttctttactttccctgtgggagagaaagatagatggagcattaggtgcccatctctcaggcctcctttctctgattatcctgtgggaagtacctggaaagcagtgaggcattggaaggaatggtctaggccttggcatgagtatgtggtcgtgaaggcataagacaaaatatcttgtgtagctgtagcacaggtgctgtggtaagaggaaataggtttgggggcagtattaagggggctaataagcgcagaaaatagtatttgttgctgtcgttagttacttcactttgccttgcctatatgtattgtctgacagcagagccgaaactccagcatccttttgtctcctcctcctcctcctctttttcttattttctgacttataaagatgtatatcttcaataaataagcttgtgatgatatggaaagttaaataaataaaagttctagaaattggaaaactaaatggtgatttcattgtggtctttaaatataacaagtgttataggccacggtggctcacacctgtaatcccagcactttgggaggccaaggcgggcagatcacctgagatcaggagttytagaccagcgggaccaacatggagaaaccccgtctgtactaaaaatacaaaattagctggcgtggtggcccatgcctgtaatcccagctacttgggaggctgaggcaggagaatcgcttgaacccgggaggcggaggttgcrgtgagccgagatcgcaccattgcactctagcctgggcaacaagagcgaaactccgtctcaaaaaaaaaaaaaaaaaaaaacaaccagaaaaacaaacaagtgttataattgtaattcttgtaattccttaagccaaaactccattataacatttcttagtttgttgttgttgttgttgttgttactttttgtgtgtatttgtttgaacttcccagctgtattgtgatctctttgaaggtctagattgtgtctgatgagatgcatatgatgcacttcatgaattgagctactttgcaaatgatgctggttgttttatttcttagtgttttcagcaacttccagcacctttcacaatgtttctttccacgtggttgtcccacagatgttgcatacttgatatgtccaaaaggggcattgttgtccccctccctgctcctggacctgcctcttcttctatgttcccgattttagtgaatgcttttcccgtccatccagtggagaaattctaaatactgaatgctttgtgtatactaaatatatattctgtccatttcatagtttaaagtgttgctatcagatggagaattgtaatgtgcagaatataataaagcctctttttttttttttttttttttttttgagacagagttttgctcttgttgcccaggctaaagaagtgcaatggcatgatctcggctcaccgcaacctctgcctcccaggttcaagcgattctactgcctcagcctcctgagtagctgggattacagacatgcggcaccacgcttggctaattttgkattttttagtagagacggggtttctccatattgatgaggctggtcttgaacttctgatctcaggtgatccacctgtcttggcctccgaaagtgctgggattacaggcgtgagccaccgcacctggccaataaagcctctttataccattttctaatttctatttcatagaattttaaaactgcataagcctttaacctctgtttctcaaattcactttcccctttggaatgttataattctacttcacctgactcctggaactccctgttatcatgtaacatattttaattattttgattgttgtctgagtcttcctactacaagagtgagactgagtctcactcttggccaggctggagtgcagtggcgctgtctctgctcactgtaacctctgcattctgggttcaagagattctcctgcctcagcctcccgagtagctaggattacaggtgtgcaccaccacacttggctaatttgtgtattttagtagacacagggtttcaccatgttggccaggcaggtctcgaactcctgacctcgtgatctgcccgccttggcctcccaaagtgttgggattacaggtgtgagccaccacacccggccaacaatgcaaacttcttttaaaaatttgtttttaaattttttgtgggtacataataggtgtatgtatttatgaggtacatgagatgttttgatacaggcatgcaatgtgaaataagcacatcatggagaatggggtgtctatcccctcaagcatttatctttgtgttgcaaacaatctaattacactctaagttattttaaaatgtatagttaagttattattgactatagtcacccttttgtgctatcaaatagtaggtcttattctaactatttttwaaaaatgtggaacacttcacgaatttgtgtgtcatccttgtgcaggggcctccctaacctctctgttgttccaattttagtatatgtgttgcttaagtgagcactagaatgcaaacttcttaagaatagaggtttttatttgtgtattaactaatttccctagcacctagaagagtttctggtataaagtagctgctccaatcaatattgaatgaatgaattggaaatgttaagttagttcactcttgttccccataaggaaaagaggcatggaaaggcacaataacttgctcaagctaacgccatatctccttaccaggtaagtgggttttaaaaaagtttaaataaaacgatgcttaatcacagttcctttatgtgatttggtactaatgtgtattatggacttaactgtattatctctatgaaaaggggtgggggaagcaaaagggaagaagctaatatatattgagtccttactatatgccgggtattttgttttattttatttatttatttatttatttatttgagacagagtcttgctttgttgcctggtctggagtgcggtggcactatctcggctcactacaacttcgcctcccgggttcaagtgattcttgtgcctcagcctgctgagtagctgggactaggcgcgtgccaccactcygggctaactttttatatttttagtagagacggggtttcgccattttggccaggctagtctcaaactcctgacctcaggtagtccgctcgtcttggcctcccaaagtgctaggattataggcgtgagccaccgcgccaggccagtcttatttaattgtcataaatgatatcctatgatagtccagtaaccttactagattttacagatgagagaactgaggcttaaggaacctaaatcacttcccagagggtcacacagctagtaagtgactgaactgggttttgaacccaggcccgattaactccatttggccctcttttaccttaaggcacaggaaaattttggatttgtggtctgggttgctttaagattcccagatcagactactcttgaaaatggtctgatttgaactactcaagtagagttacaaaaattgtttaccttaagacagccccatggagcagtggggttgtgtctgtagcgctcttgagtaaaaaaaaattctgtgttgcacatactcccactcagttgtatcgtatataattcacatttcagactttctttttaaccagggatccagaataactacagaaaggtgattatgtaacatacttgtacagtgcagccacttctgtgtttggtaatattctttttttttttttttttgagatggagtcttgttctgtcactcaggctggagtacagtggcgcgatgtcggctcactacaacctctgcctcctggattcaagcaattctgtacctcagcctcccgagtagctgtgattacaggtgcccaccatcatgcctggctaattttttgtatttttagtagagatggggtttcaccatcttggccaggctagtcttgaactcctgacctcatgatccacctgcctcagcctcccaaagtgctgggattacaggcgtgagccactgtgctcggctggtagtactgttaagcgctaagagcacaaacaaaaactatgtctaaaatgtagggcaggtagagcaggtgaggattaaacccagttgaaatcagcggtttcagtagtaagtgggcagatcataattacctgtgttgctcagagacctaagctgagagtgggggtggggaaaggtcacacccattatctttggagaaatgatgagagtaaataacccatagtttccagtttattccagaagcattctcgccagagtcacaatgttgaagtgggttttgagttagaccttgttaccccagatcatccaaggttaacatagtttccttagataccacagccattcattgtgaacgctgttagcttcctcttaggtagctttatgtagcctaccttagaaaggagggtggggtctgggaggggagaggagggaatagcaaaagtagcagagaaacaaaggactaattaggaggttcctcagtcatttgggagtagatctttttcattagctgatcactgagatcaaggatggaggtggtgatccaggaggaggaggagttgtagtaatcagaagcagaatagcataacttggcagtcagtggtggtccaaggaccagcagcatctgatagcttgttagatacatatatatataaattttttttttttttttttttttttgagagagtctcgctctgttgcccaggctggagtgcagtggtgcgatcttggctcactgcaacctctayctcccaggttgaagygattctcgtgcctcagcctcctgagtagctgtgaccacaggtgcatgccatcacacccggctaatttttgtatttttagtrgagatggggttttaccatgttgaacagactggtctcgaactgctgacctcagatgatccacccgcctcggcatcccaaagtgttgggattacaggtgtgagccactgtgcctggcctgaatcaattttaattttatcaagattcccaggtgattttttttttcttgaggcagagtcttactctgtcacccagcctggagtgcagtggtgtgatgacagctcactgcagcctcaatctccccgggctcaggtgatcctcccmcctcagcctcccaaatagctgggactacaggctcgtgccaccatgcccggctaattcttgttttgttttttttttttttttttttgtccgaggcagagtcttgttctgtcacccaggctgaagtgcagtggcatgatcttggctcactgcaacctctgcctccygggttcaagcaattctcctgcstcagcctcctgagtagctggggattataggcgcatgctaccatgcctggctaattttttttgtatttttagtggagatggggtttcactgtgttggccaggctggtctcaaactggctggtctcaaactcctgacctcatgatccgcctgccttggcctctcaaagtgcgggattacaggcgtgagctactgcacccgaccaattcttgtatttttttttttttttttgtagagatggggctttgccatgttgcccaggctggtctcaagctcctgagctcaagtgatccgcccaccttggcctcccaaagtgctaggattacaggcatgagccaccatgccaggcccccaggtggttttttaattcgattctgtgcccgttaaagtttgagaagcaccaagtttgtgattaggtggttagtgcaaggggctttggagttggacagacctgggattgaaacctggtttggccacttactacctgtgtgactttagataaattatttgaactctctgtgacagtttctcatatgtgtaataggggaactctctatttcatagggttgtgggggagagtaaatgacatggtgcattttgcaactgacactatcttagatttaatgaaatttagtaatgtctgtatcatattaagcactgagtctagcacagcctagcatactcaataagtgttattactaataattaaattaggcaaatttacaggaataaagaggctttctcctcttcctctttttctctttatctctcaatgagtacgtttgtctgcagttttataaagctgtattgtgtgtgtacactctttggtgttttgcctagcattatttaatggtagttatagcagcagcattaacacatcttgtacttattaatgtgccagkcataatttttatgtactttatgcatatattatttcattcagtccttagagcaaccatgtgaaataaatattatctccattttcggatgaagaaacagaacaaacaggttaagtgacttgcctgagatcacatagccagtcagtggcagaatcaggatttgagctgagacactcttattccagcatctgtgctctattttcatgtattgctattgctctcaaacttatgtggtgtgatggaaatcaggaaactttgattggatacttgattctgccactaatttatttgtgaccttggtcaagtcacttgtcgtctttgggcctatttccttattataaaaatggagggattatcaaactcaaaagcaattaaacaaaaaaagacaaaaaatgaaaaaagagtaaaacacaaaaayggagggattagatgagatttgtaaagtctgttcagtgattcattcaacatatagtgatttcaagcaaagattggaagaaaattttatctagggaattggttcaaaagtacttgttcaagcaggttggtgtcattaagaacaaggggtttgaatcttgactcagccacttcctggctatatgaccttgggcaacttacttaacctttctaaacattgatttcctcgttagtagtggggagaatagttcttaccttgcagggatattgtgaggtttgaataagataatacgtattagcacctagcatatgtgaaacatrcartggatactcaatatccgtgagttgtcttttcttccttccattcattcgggagatgcttagggaagcagatataccagattcaaaaggatttagaccctcgcttggtccttatgtccttttctgtaatggtattctcacctttgggaaatgagaattagtagggaaggaagtgtgcatatagccaggtcctgtctgtttttaaataatccatctttttgattttagattaaaatttctttttacaatatataatttaggccagtaatcccagcactttgggaggcctaggtgggcggatcgcctgaggtcaggagttgaagaccggcctggccaacattagtgaaaccccatctctactaaaaatacaaaaattagctgggcgtggtggcatgcgcctgtaatcccagctacttggaaggctgaggcaggagaatcgctttaaccygggaggcggaggttccagtgagctgagattgcgccactgcactccatcctgggcgacagcgcaagactctgtctcaaacaaaacaaagcaaacgacagcaaaaacatataatttatgacaggataaatgccattttttttgaccagctgggcaacatagtgagaccctgtctcatagtaataacaataaygaagtaccacaaactgggtggcttaaacaacagatatttattgtcttacagttctggaggcgagaagtctgaaatcaagttgtcagcagagttgattccttgtgaaggctgtgagggagaacctgttccatgcatctcttctagtttctggttgcctcagatgttccttggcttgtaaatgatgttctctcaccgccttcacatctgtatatgtctgtctgtgttcaaatgtcccctttttataacactagttatattgggttagagccttttcgaatgacctcatcttaagttgatcatttgtaaagaccctatttccagataaagtcacattcacagtccctggggttaggacatctttctgggggatacaattcatcctataacaaatggtttagggccgagcacggtggctcatgcctgtaatcccagcactttgggaggccaaggcatgtggatcacctgaggtcagttcgagaccagcctggccaacgtggtgaaaccctgtctctactaaaaatacaaaaaaattagctgggcgtggtggtgggtgcctgtaatcccagttacttgggaggctgaggcaggacaatcacttgagcttgggaggcagagattgcggtgagccaagattgtgccactgcagtccagcctgggcaacagagcaagactctgtctccaaaaaaaaaaccacacaaaaaacaaacaaaaaaatcaaaacaaatggtttagtcactttgtaacctggacagaggagtgaacatatatgaaattaactttctttggtcttttaagatttattactaagatttaactagagttaaaactttccttgtcctgttggccgggtgccttggctcaagcctgtaatcccagccctttgggagggtgaggcaggtggatcacctgaggttgggaatttgagaccaacatggcgaaaccccgactctactaaaaataacagagtagctgggcatggtagtacacgcctgtaatcccagctacttgggaggctgaggcaggagaattgcttgagcccaggaggcagtgattgcagtgagctgagatcacgccactgcacgccagcctgacaacagagcgagagactctatctcaaaaagaaaataaaagctcttcttgtcctgctaattctgcattttgatttttggcagcatttaggaaagagctgaggtggacctggtgtgtagcgttggtgggagttccttcgttttctgggctgaatgatttaataataatataatagtggctttcattaatttcttactatgtgccaggaatggactgtgttaagcactttatatacattaatccacttaattctcatgataaccctgtgaaatagattatctcattttgcagaggagaaaagtgggtctcagccagtgaaataacttgctcaagttctctcacccagtaaatggtagagcagtcatttatgtgtagctctgttggacttcagaactccagctcttaactcagtatatacttttccttcacttccttgaatagaactgtttggcttgagtctccttttctctaaaaactcctagttctggaatggtgccaacttaaggggtcagggaagtgacctttacttgtgttcctttgagctgttattgttttcattgggaaagagaatgtgaagtcagttcacatttcttacctactggttgcagtcttgccatggggccctagtcagatgtgagatgttgtaagttacttaaaaaaaaaaatgtcctagtgattaagaggaaaaaacataggcctgctatgtttatgtaactctcttttgtattattacaaaattaaacatgttcactgtaatacatttaagcagaaattacaaagaaaaaagtaaaaattctcttttctagtctttattttctccacctaggcccactggtcagggtaaccactgttcaagctttggtttgtatccttacaggttttttcttgccaggcttgctttggaactgcacctttacatcctttatattcctttaggttggttgtgtctcttcttgactcatgagccttacctcttatttatttttattaccatacatctggcttacatttttattttttattttttttttagagacagggtcttgctacattgcccaggctagtgtgcagtggctgttcacaggcaccatcatagcacagtgcagcctcaaactcctggtcttaagcagtgccccctgagtagctgagactacaggactgcaccactgcactgggctgccttacttttgagtctccctttgatacttaagagttctgccatagggccaggcayggtggctcacgcctgtaatcccagyactttgggatgctgatggatcacaaggtcaggagatcaagaccatcctggctagcacggtgaaacctcgtctctactaaaaatacaaaaaaaaattasccaggcgtggtggcgggcgcctgtagtcctagctactcgggaggctaaggcaggagaatggcgtgaacccaggaggtggagcttgcagtgagccgagatcacgccactgctctccagcctgggtgacagggtgagactccgtctcaaaaaaaaaaaaagatttctgctattgcacccttttctgtagtctttccctcacctcctggtaaaattttacttacctttgaagctcagttcaagtcctcccttttacattaatccactggaaagctaacccatgataactcattctgcttcataactcatagcattaatttctaccactcatttgccagttgaccatgaaatgccgtgtatcgtcacttgtattttattatttgttatttaacttatcacacatttgcccagttagattgtgctgcttgggctcatggtgatttattctttctagtcccaattttgcctaacacaatgtcctacatttagcaagtactcagtaaatgttgatgtgattggattttgttagtacttcacacccttctaaagatcaggtgcttagagccggaagcctaagggaacacttacctggctgacatcatcttggctgcctgtcaagatggggtgtgtgcctgagagaactgcccgtaaatgaaatacttgtgcaacaggttatgttttctcctttagtgggtgggattcaagacttcacattgggaaaaagagatagtaagtgtaggaagagggctgaaaaggggatggatgggaggatgctaccttgtgagaggtggggatatggctttattaaaaacataaatattaaaggctggcgtattgcagagagaagcttcttggaaccagcaggctaattaggcaaactggcttctctggtgcaaaccagttgttaattgccatttattttctttgctataaaactgtaccagccatctacttactttctcattagagtgaatctggagaaaaggcttagrttagatttaggaaatccaggagaaaaatgcaggacagtcagagtaagaccagggatgggcataatcctttctctcacttgtcttaccagccctagaccttaagggtggccaggacctccttgcatttgccagtagaggttgctattgaagtagtgtaaaacctcttgtttctattcctgctaactccttttgccccatcttatttttctccttcactgacaccctcctatcacacacacattattggttagttatcattcccatctctgaggttcasatatgcagtggaccaccctgcctttagctgtccagactttgactgcaacctgtctttctattccactcctcctcccctcccccaaatgatttgaaatggagaggaaaggaaatggagtttgatggttttaactcttctgtggctgtggcttagggagcagaatgttttgattgcttgatttaggggtcttgaggtctcctaatacaatattctttttgttaatagaaaggccccactccattttttttttctctgagtattttggactcaaagtcttgtgttgaaatgtcggtacctgcccccgaaggggaaaagatccctttcagagtttatttttcccccccattcatggggaattcttctcattatcagaagatgaagattactggtcctttgaacagagtataaatatagccaacaccctaatatatttctaatgattgggctttagctttaaaaacattaggctagatgcctccctattttttgtggcatgatttagctgtaactagcctggaggcaataacaatactaaatgaccttttgtagtcacattaaacattgaaatggtactgagactgccttggtggggagttttggcctatgggaatgatgtgrgttttggtttctactcctttctctgttwtcagataaatcctcctacatgtcccattctctggctctgggaagtactgacagtagggaaaagttagtacactcatctcattgttcagatcaagtttcctgggtgcggttttgcagaacttcctacaagagctgactcaagagttctcttctattgtggagatgttcctgctcttatatgtcatactaatttatatccttgaaattttgagcagcatcatttggatgtgttaagttgggaatgaagaaagtgaaaatattttcagagattccttgagaaaagggttccttttgctgggtaaatcaacgttccctagatgctgtggctaagaagtgaagaattytaagccaacttttttttaccccttttcttttctttacttttttttttttcgagatggagtttgctcttgttgcccaaggctggagtgcaatggtgtgatctcggctcactgcaacctccgcctcccgggttcaagcrattctcctgcctcagcctcccgaggagctgggattacaggcattacagacgtgtgccaccatgcctggctaattttttgcatttccagtagaaacggggtttcaccatgttagccaggctggtctctaactcctgacctcaggtgaaccacccacctcagcctcccaaagtgctgggattacaggtgtgagccactgcgcccggccttttttttttttttttttttttttttttaaragacagagtcttgttctttcacccaggctggggtgcagtgacatgatcataactcactgtaaccttgaactcctgggctaaagcgatcctcctgcctccatctcctgagtaagctaggaatacaggcacatgccatcatgcccagctcagttttattattttttttttttttgtagagacagggtctcactatgttgccaaggctggtcttgaactcctggcctcaagctatcctcccacctaagcctcccaaagtgttggattataggtgtgagacaccttgtccagcacctgtttttcctttttgatgtcagatccctctgaataacaagttatttgcctttttttccctccataagactgtgagcaccttgagagctgcgagaacatctcacttatctttgtatctctgatgtttaggacagtgtccagctcaaagtgtctataaatgtatgttgcattgaatagtggagggaagctttaaatacatttactgcagacagatgtatgcttagcatatttaattgggagacattattagaaagtggagatggataaagaaaggaatttttgtggatatgatatagagaatttttgtttcytaaggatttaaaatttttgtttgtttatttattkgtttattttttagagatggggtcttgcagtgttgcctaggcttgtcttgaactgctgccttcaagtgatcctcctgcctcagcctcctgagtatgtggaattacaggcatgagccactgcacccaacttgcctaacaatttttagagtaacagttattttgcggttcctttacgtggagaacctttagaagtgttccatctgactaccttggacaaggcactgtgaccttctttgtagcagagactaaagacacctgcccatttccctcaaatggagggatatccctcagtaaaggaaggagctcagaattagattgggggtagagaaaggaagcattgagtccctcctagccctgcactgtggaaatgtaaagctattattatgataattgctgttggcaaacaagaaaattctcagcctctggtttgtacctacacccagtcacaacctcaggttgggtggatgcagactttaaatattggggtcacctgtagctgttggaaaaggtccctgtggtttctctgggtgttgtgcaagcattactttttggctcttttccctgtatccatcagtaaaaagtaggaagtttgaggagctgtgctttcggttggcattaggcattggagtgcctttatttcctacatttaactggtaaatatccaacactccataacaggatggccctgcttggaaattcttacctagggagtgactgaagcctaagaggaactgcacagccccctgtattgaaaacggagtagtcatttcctagagcatggcttggatcctgatcagctgatttcctgtctctacagggatgtgatgtgattcctcccccttccttctggaagaaatggatattttttttcatttcctgtttgatagcatattttctgagtaccaggagacacttgatgactataaaacatttgatgtgtggggggtgggaaggaaggaggcttttgttttcagcagaatggctttcatttgaggaattcaaagcacatacatgaacccaagctgttttgttcccatgggagagacacaggctctaagaagattgtttcgaatccctttcctgggctgtgtctacttgacctgcactggtagagccccttctcccccataggttagaaaagctcggtccctcatggagctctgcatgctgtggattctgctcttgccacatccgctactcagccctttttgtgcctaaatccgctggagagcaactattagtccctgggggaagtgacaccacccttggaatggaacctggctggatgccccttgatccctgactgagtgacacagactgggacaggaatctggctgtccagatttcctgtcctctgtcctcactagccgacttggctgcttccaccctggggctgggggtatggggtgtggtgggagctggttgctaacaagcagygcygcctgtggacctgcacagccacttgttttcctagccaagagctacccgtccagtctggcctgttcctgatccatctggagtgagagcagagacctggaagagagatcagtggggaggcagtcattgtgatcccttttgtttgtagtgaagctttgcttagtgtttgagggcctggggtttaattttgtaacagactcttactatagttgtgtgtgtttaactataagattttcttttcttctcttttctccttcctcgtcctcctcctcatcctttctcctcctcctcctcctccttcttcctgtctgtttttatttttcccaactttataaaggtataattgatatataaaaattgtatatctttatggtgtacaatgtgatgttttgatatatgtaaacattgtggaatgattaaatcaagctagttaacatctgtcacttcacatagttttgtgtgatgagaatatttaagatttactacttccagaattttcaagtacgatacattgtttgctgtacaatacatctccagaacttattcattttttctagagttgctttttcttaaataaattattaggtttcttcttgaccttgaagaagtccagaaaaattcttacaaaatagggaattgcatggtaggtaggttatgagaagtttcatttttgggttttgtgaataytacgaacagcttttcctagtttgctagggatttgygtggccaggtatttgctgcatttaaagttcttagatattatcatcagaagaacagtcytttttttttttttttttttttttgagatggggtctcgctctgtccgccaggctagagtgcagtggcgggatctcagctcactgcaagctccgcctcccgggttcatgccattctcttgcctcagcctcccgagtagctgggactacaggcgcccgccaccacgcccggctaatttttttttttttgtatttttagtagagacggggtttcactgtgttagccaggatggtttcgatctcctgacctcgtgatccgcccacctcggcctcccaaagtgctgggattacaggcatgagctaccgcacccggccagaagaacagtcttaacaagaataagtggaatcagggagcatgcctctaacatttaacagtacattcttccttttacctctgttgttgaccatgtgccttcttgctccaggggttttcagttttcttttattttgttgtatcagatacattttccctctagggtagaaagcagcatcttacagtggaaaggaaccctggctttgggtcttactggctctgtggtcttaaacagtcatgtaacccctttcaactgtgtgcttttcctaattccccatttgtaaaatattggtggtgataaccatcttgcagggtttttgtaaaggttaaatgagttaatatacgtaaaacacattggttggcacatagtatgtaattgtagcttgttttttattagtaggagtcataataacaatacgcttgatttttttatgataaaatacactaatataacatttagcattttasccatctgtaagggtaaatatagtggcatcaagtacattcacttgattgttgtgcagccgtcactattatctatctctagaactttttcatcttctcaaactaaaattccaaacccattaaacaataactcaccttccccctccttagcccctggcaaccacaattctactttctgtttctatgcatttgactactctatgtacttcatataagtggaatcatacagtatttgtccttttgtgtctggctcatttcatgtagcataatgtcctcaaggttcattcatgttgtagcatgtgccagaatttccttcctttttaaggctaaataatattccatttatgtatctaccacattttatytatccattcatctgttgatggatacttggcttgctaataatatgattatttttgggtttttttgacatcttatttaattaattaatttatttagacagcgtcttgctctgttgcccaggctggagtgcaatggtgcgatttccgctcactgtaatctccgcctcctgggttcaagtgattctcctgcctcagccttccgagtagctgggattacaggtgcatgctaccatgcctgactaatttttgtattttttyagtagagatggggtttcaccatgttggccaggctgatctcgaactcttgatcacctgtttcggcctccctaagtgctaggattacagatgtgagccactgcgtccggccagattatttttaatagtaatgaattgattgtctaaggtgcgttcaaaggcttcaaagctggggagaagaggatgaagtagaacaatatccttgtttgtgtgttgactttgtctctctgggttttgcttgcaagacctattttgataggagtctgatgaatgatggacctactgaaccctatacagagggtccagrcctggcagaattctaggaaaaaaaaattgcctcctagtctaatttttctcagtgataaactactctgtgtgcttacagtttgtctatcttgcttctctccctctctcctttgctcctactatgaatgggattcttggaatggtgacatatctagactcttggattgttttgcagaggtcgaaggctgagagagaattgctatatagctgaggggtgatgagtacagcgaacggccaactgtgtgccaacctggctttccagggcagtatttttaggatatatgtacctatatgtgtacacacatatctctacacacacatacatacatatgtacacacacacaaatatcccattattgacacttgacacagtaagggagctacatgttcttctctgggttcccctcaatgcagcccaccaccagaatgcatgcattggaaacgggtccaggataatgtgagaggtctccaaggagttccaagtataaagagccttagcagaagggccttgacagcttagacagtctcttacaatgtctaccaaaattctgaagaaagactgcyatccagctgtgatttttctgccttccaggttagacctgaaaaagtccaggagcctagcttctgtgtcctgtgcttatgctggacatgggtggagggtgaggagaggcagtagtccctccaaacccttgtatctccaactgtggattctcctgtttgtttatagggtggaaggsgtggtttatactggtttgtccccagttcctgctctgtgcctgaggggactgcagtggcattaggattttttgcccagttgctcatggacatagagacacgtcacctcagtgcacccccctgtgcaaattggcctaccctcatattacctgcttttgtacctccaatgcctagagaccagttgtctctcagaagctactcaggatgattttatgctgtcagcataataaaagtgaattaattctatattaaattaataaagaccatatttagtattagtcaactaaggttgtatatgtacatattactaaagaaaaatgaattttaaaaaagaatctattttagagaaacagattaaatatgaacgacagtagggggcacttgtatgacagtagaataaagacaagcgtgagagtgttcagtttgaaatttgaagtttaacttttacttgtttcttggaagttcatgttttttcctcatgcaactttctgcaaaactgaaggttggattttaaatataaaatatttgacatgaccaagttatatttaccctttgtcaactaaaaattgacttttttcaaagtttgttatttttttaatttaatttaatttaattttattttgagacagagccccctctgttgcccacgttggaatgcagtggtgcgatcttggctcactgcaaccaccacctcccaggttcaagagattctcatgcctcagcctcctgagtaactgcaattacagatgtacaccaccacgcctggctgatttttgtatttttgttagaaacagggttttgccatgttggccaggctggtctcgaacttctggcctcaagtgatctgtgtgcctcggcctctcaaagtgttgggattacaggcgtgagccaccatacccagtctttttttatttttttaaagacaggttcttgctctgtcgcacagagtggagtgcagtggcacaatcatagctcactgtaacrtgtctaccaggctcaacagatcctcccacctcagtttctcaagtatctgagactacaggcatgtgccattacacctggctaatttttaaatkttttgtaaagacgaagtctcattttattgcccaggctggtctcaaactcctgggctcaagccatccttctgccctggcctcccaaagagctgggattataggcatgagccactgtgccccaatttatttattttttatttttttaccttcagatgctctttggcaagcaagtaaggattgctcaattaaaagtattgcattatctcattcaactatatgaacatacaaaacttaaaaaaatttgtctgaggccaggcgtggtgggtcatgcctgtattcccagcactttgggaagccgaggcaggtggatcacctgaggtcgcgagtttgagaccagcctggccaacatggagaaaccccatctctactaaaaatacagaaattagccgggcatggtagcacgagcctataatcccagctactagggaggctgaggcaggaggattgcttgatcctgggaggcggaggttgcagttagccgagattgtgccactgcactccagcctgggtaacagtcgagactccatctcaaaaaaaaaaaaaaaaaaaaaaagtctgaaacagtattggaagctttaatttctatttcaacaaatttgtgctactctggattatgtgctacctgtcactcaaggatcttgttgaaatactttcttgtacaaaaacaacgaatcaaaacaaaacaaaacaaaaatgagtgtacttcatgttgtatttgagtagaggtcctaacaaacacttgaaaaatggctggtggtaggctggacgcggtggctcacgcctgtaatcccagcactttgggaggccgaggtgggcagatcacaaggtcaggagatcgagactaccctggctaacatggtgaaaacctgtctctaccaaaaatacaaaaaaattagccgggcatggtggcgggtgcctgtagtcccagctactctggaggctgaggtgggagaatggcgtgaacctgggaggcggagcttgcagtgagcagagatcgcgccactgcactccagcctaggcgacagagagagactctgtctcaaaaaaaaagaaaaatggctggtgttagatgaacacagctttctctcatttcaataatgatattgaaaggttttaaaggccaaataattttttttttggagacagagtcttgctctgtcacccacgctgtagtgcaatggcgcaatctcagctcactgcaacctccgcctcccaggttcaagtgattctcctgcctcagcctcctgagtagctgggattacaggtgagtgccaccatgcccggctaatttttgtatttttagtagagatggggttttaccatgttggccaggctggtctcgaactcctgacctcaggtgatccacccaccttggcctcccaaagtgctgggattacaggcgtaagccaccgcgcctggcctaggccaaataatttttatgaactgtctggagaagctttgatgaggaataacagtatcattttcaaattggcttctgcacaaactacgtaattttgagtattccatgttaatgcatatgatgtagctggctcttaatcaccctatgaaaatggagtacaaggcatgctgaatacttcaaattcacagataactactaaaactaattttaatcaactgtctcgtcatttattcctacttgaattaccaaagatgcttgcttatggggggaaattgaacagattttttttcctcttgtttaccctttaccttttttaaaatgttatctgccactgttttttttttttttcaracagtctcgctctgtcgctgcaacctctgccttccaggttcaagcgattctcctgcctcagcatcccaagtaactgggattacaggtgtcccctaccacgtccarctaatttttgtatttttagtagagatggggtttcaccatgttggccaggctggtctcaaattcctgacctcaagtgatcctcccatctcagcctcccaaatttgccactattctttatattccagctaaaatgaactagtgctttctgcttttttttttcctagctttcctgctttcatgcctttgctcatgctgtatcctgtgcctgcattttcctttaatttctacattatatttggtccttacatatccatctcaaatgttactttttgtggatccttccctgattatctcagatacaagttatatcatctttctgaactgacataatattattgaaagaaatacacttaaaagtaatagtaataactgacaacattcagagtctgttacaaaatgttttcacatgtattagctcattggaacctcacagatgtttttcatcactcctgttttacagctgaggaaattaaggcttaaggagattaagtaacttgcctgaggttacccataattagaactaaatcttttttttttttttwwttttttttaragacaaggtcttggctgttgcacaggctgcagtgcagtggtgtaaacatggctcacagcagcctcaaactcctgggctcaagagattgtcccactccagcctcctgagtagctaggactataggtgtatgccactacacccagctaaatttttgtgttttttgtagagatggggtctcactgtgttgcccaggctggtcttgaactcctgacctgaaatgatccttctgcgttagtcctccaaagtgctgggattacgggcatgagccatcatacctagcataaatctaaatcttatgacctcaaatcccatgttttttccaccaaacagtgctatcttacgattcttatcacttgctactatgggttagaattacttgtgtaaatgtcacatctggcctactactttgtactgtccttagatgaagagttaatgccttattctttgtctctgacatcccatagcacagagtattgcgtataataaggcttcaataaccattgctgaaaggctgacaagttgaagaaatgttgatgaatgcatgtgtctagcacagtgcctcgcacatagatgcctaataaacatttattgaatttaattgtaaaatggatcaaagaccatagttaataagagcttatagggcacttaataagtgccgggcaactgggcaccggtggctcacgcctgtgatccctgcacttttgggaggctgaggcaggcggatcacgaggtcaggagatcaagactatcctggccaacatggtgaaaccccgtctctactaaaaatacgaaaattagcagggcttggtggcacacgtctgtaatcccagctacttgggaggctgaagcaggagaatytyttgaacccaggagkcggaggttgcagtgagccgagattgcaccactgcactccagcctgggtgacagagtgagactctgtctcaaaaaaaaaaaaaaaaaaaaaaaaaaaagtgccagtcactgttataaatgctttatgtcaaattaactaatttaatccttagaacctatctccattttacactggagtaaactgaagaacaggagggcatagtgatttgcccagggacacacagctgttaagcagcagagttaggtttcacaatttgctctaraattctcatgtactcaaacattatgctataatcagttgttcataatattttcacgctgttaaattcctcctgaatgcctgtctgtcttgggtgtagctcaaagaatgaaaagcagaagcagcataacttgttgaatatactcttgagcctgcgtcaraatcacctgcagggcatgttaaaacacagattgctgggtcccatcctcagttctgattcagtaggtctggggtggggcttgagaaattatatttctaacaagttcccaggagatgctgatgctgctggtctggggaccacttggtgtagcatataggtgttaagagcatggactcaagctgctgaggtttgaatctcagctctgccatttattaactgaacttgggcaagttcttgaacctttctgtgcttcagttctcatctgtaaagtgttttactgttaccacatatatcataggattctgacggagattgaatgaaataacatgtaaagtgcttaaaatggtgcttggtttgtagtaagcatgcagtcttagctacagtaatggggataggacatgtttcttgccttgtagattttagagtctagttattagacttaaatctaataattttaaaaagtacaaattcaggtattagtttacatggttctgattctaccttagatttggaaagatgaaatgcgtgtatcttgggggatatggtgggtagtgggagaccaggaggaggaaaggtacatgaaactagaagataatggaaagttatatagtcagaatttagaaaggttggaattgccagtggttttggtattattacctgagaacttgagggagatagaggaaggtgcctgtgctctctgtttgccaaagagataactgactccttttcccatttctctttcttagagctggtatctggtctgcaggcagttccggcagcatttgctttttgtggggaacagtggctaaggaagtgatttgctactggcttcagaagttgggctctgctgcctttatcctccacagctgcctcacatagttttgattcttcctgagaaaggcagttgttaggtttggaagtcttcagattccagagacagctggacagctgaccctctggtagctatttcccaaactgccagcctcctgttgcctcatctccctgggccccttcttttttgctttgaagcaatatcctatatttagtgaactaaccaatttgaggttagaggaaatttgatgggggagtctctcccaccttaaaatcctggatggatggagtatttgggcccaggaacaagatgtatcctgttaaaaaaaatttaacaccttcatcaagtrtactccaaatgacagcttacagtgctatgaatgtacctctagctcatgggtaaggagcagtgtttatttttgggtgccctgaagaaaatatttgggggaaggagtggggagaagctcaggcagctccatttatggttgagcaatgcttggtattctacagaagggaccatatggacagtggaagagagtttagcattctgattgttcacctcttgctccttccattctgatggctaattagggacacctcattagctawcagagtggaacaagtatttgccaggctgacatgagcctcagccctgcatcctgcatcttctgctttcccaacctgctgagtcaccacctaggaatggcagtagccaggttaccacctggagcacctggagcactcttggcataatgcactgttgactggttttggtctcctagacacagcttgggcctctccaagcctgttggagtgataggctgggtcttagctctccttccagcttgttccacaaggcgctgacctacttttcagggacaattaagtgtttgtgagcaaaggaaggcggtgacccgagtgaaggtgaaccagagctgcattaaacaaacatttggagtcactttttctatcttacacaggagggcccatctcagtccaaatggaatggcagatcaggctgattgtggtagccacattctagatgcttatcaagatagtcaactaacccttgaatttttattctttctatcaatgtaccttaatatcagaagttacttttcataatcattgtaccccttgtctgtgggctatacgaaaagatttggaagcaagttggggctcttagagtgaattattgatacaagctagcttttgatataccttttggtgtatcaaagatacactttctggtggcaatgtctggttcatttgtaacatcttggagaggattggaatctcttttcctttttgtatcaggccaggataataggatagaggagaggccagatctgtagagaatgagcaagtggcttgtttagggtttcctgcccytgtgaggtaagggctcaaggattagattcagtctttccatttgcagtgaaaggaagtaaactcactttcccaccctcatcctggaggttacttatgttatttgcagaccccaacttctgcctctctgttaagtwtacttcttatgcaggttgcccttactgttacatcttaccactgggggaaagatccaaggctctgggaaggacagtgacagttgtcctacattggctagtttcaagaccctgagggaattgccaagccagcaattaggcaatttctttttcttttcttttctttccttttttgagatggagtcttgctctgtcgcccaggctggagtgcagtggcgcgatcttcactcactgcaagctccgcctcctgggttcacaccattctcctgcctcagcctcctgcctcagcctctggagtagctgggactacaggcaccagccaccatgcctagctaattttttttcatttttagtagagatgggctttcactgtgttagccaggatgatcttgatctcctgacctcgtgatccgcccgcctcggccaccaaggtgctgggattacaggtgtgagccacggcgcttttttttttttttttttgagacggagtcttkctctgttgcctaggctggagtgcaatggcacgatctcggctcactgcaacttccgcctcccaggttcaagcgattctcctgcctcagcctcccaagtagttgggattacaggtgcctgccaccacccccagctaatttttgtatttttaggagaagcggggtttcaccatgttggccaggctggtcccgaactcctgacctcaggtgatccacctgcctcggcctcccaaagtgctgggattataggggtaagccaccgcccccagctggaaatttcttaaacttttatttttagcaactccatattcatgagaactctcataatcttctagtcagtaaaaagaaaagttattgaagttattgatactgcacccagagatccagatcaaatcttaaggaaggaagaagcttagaggagaacttcaccctgccactctctcattggaattcccttctaacaacgtgtgaggtgtcagccccatttgaagaactagtttatatatcagagcatggcctggaaatcagcgtggcatcaattttggtctttttttttttttcaaatagagacaaggtctcactatgttgcccaggctggtctcaaactcctgggcttaaatgatcctctctccttggccacccaaagtgctgggattacaggtgtgaaccactgtgcctcaccagttttggtcttacagatgactaagttttttgggggagggtattttaggtgacgtgcaattgctccattcctcctagacatcccagaatctggtcacaacctccttttttccacttatcctttcctttatgcacattaaacctgttctctgctgtttcccagtctgtcagcccctttatggtgtcagtgcttcctgacctatcatgtacaatagggcycgtactggcattctcagatctcttttttttcttccacgccttttctatccccagtgctggacctgtgttcattttctccactgagctactgagtgccactgcataacagtgtgctgactgactctattacagatttatgagctctagccacagcctggctctcaatcctatcctgaaacctttttattctcttctggttgactgccattcatttttttctgcagcagccattccagtctttcaccattctcttcaaacttgttgctccaccccaccttataaactctcaataagtaatttagtcttttacgtctcaatttatctgtaggctttaccagtccttaccacattccctcctatttcagaggcaggtctctgggcatatacatatatattttgtgttcttagttcctcccttcctagtgactstttgtaaagatattcaggttttctccatcctaagataaaaattcctttaagcttatctcttcttcagactaactctctgtgctttttttttctttaccaccaaactacctcaacagcctttcttctacttctttagtcatcgtgagccactatagccaaggtttgtgcccaccatcccaatgaaaggctcttgtttgtgatgacttgcttgcagaactcagcagcctctttttgttctcacgctgtttcatcttgtcacagcatctgacaccatttggacctctttccttccctgactgtgtgctatctctggatgagttgacctactctggtgatttcatttaggaatttcatctgtgtgtacagtgatgactctcttgtcagaatctgtaactacctattgtatgagcttttcccccaggtccaaacttgtatttccaaatgactactctccttttccactttgtagcctacagaaatttgcatgtaatgtatccaaaattcagcttatacaaccactatggagaatggtttggagaactaaaaatagagctaccatacagtccagtaaccccactccttaggtttatacccaaaagaaaggaaatcagtatattgaagagctatctggactcacatgtttattacagcactgttcacaatagccaagatttggaagccacctaagtgtccatcaacagatgaatagataaagaaaatgtgggccgggcacagtagctcacgcctataatcccagcacttagggaggctgaggtgggtggatcatttgaggtcaggagttcaagacaagcctggccaacatggcgaaaccccatctctactaaaaatacaaaaactagccaggtatggtggcgcacacctgtagtcccagctactcgggaggctgaggcaggagaattgcttgaacctggaaggtgaaggttgcagtgagctgagattacgtcactgcactccagcctaggtgacagagcaagactctgtctcctctcccaaaaaaaaaaaraaagaaagaaagaaagaaaatgtacatatacacaatagagtactagtcggccataaaaaagaatgacattctgtcatttacaacaacatggatggaactggaggacrttatgttaagcgaaataagccaggcacagaatgacaaacattgcatgttcttacttatttgtgggaactaaaaattaaaataattgaactcatgaggatagagagtagaaagatggttaccagaagttgggaaggggggatggggtcacagggaagtgggggatggttaatggatgcaaaaaaataaaaagactaaataaaacctagtatttgctagcacaacaaggtgactatagtraaaataatttaattrttcatttaaaaataactaaaagagtttaattggattgtttgaaacacaaattgcttgaggtgatggataccctatttaccctgatgtgattagtatacattgcatgcctgtatgaaaatatctcatgtaacccataaatatatacacctactgagtacccacaaatatttgtctttgtttattttcttcttcttcttttccttcttccttccttcttcttctcctcctcctgttcctctcctcctccttctctctcttcctctcctcctcctccccttcctccctccctccttcttttcttcttttccctttcctttcccctttccctttttcccattcccctttcccctcctttcttctttctcctttctcgtctctcctctcctcaccttccccttttcccttttcttcctttcctctctcctctctcttttccttccttccttctcttttctttttccttctcttttctctttccttttcttcctcttttttccttccttccttccttttctttttccttctcttttcattttccttctcttttctytttcctttccttccccttctttccttccttcccttttctttttccttctcttttccctttcctttcctttctttcctctttcttttctttcctcttttttcccctcccttccttccttctttcccttctttctttcttttcctcctttcttttccttctttcttcttcaacagggtcttgstctgttgcccaggctggagtacagtggcacaatcatagctcactgcaacctgaacatcccaggctcaagctctcctcctgcctcacccctcatgtagctgggcctacaggcacacacaaccaaggctggtctcgaactcctggcctcaagcagtccttctgccttggcccctcaaagtgctgggattataagcatgagccaccccacttggccctatttattttccacatctgattggacactaagttctgtttgtctagctgaaaaatatctcaacagatattgtttcctggctagactcactgccctattttagaccctcgtcttctttgatttatgccagtggtcatgccacatttcctcttaaaaactgatgatcagtttcaccccttgtttatgttgttttctatgccttgaatgatctttttactttttctgcctcacaaatgcttgttcatactgtaatcttttgtcccaactcaaaacttaatagattttaatggtgttcctgcttctttccttctaccccaaccagtaaaaaatttcacttaccttttcatctgagttcttatggtaggatgtacatcytttgtgatagtatttatcatcttattttacagttttctgtttaattgtcagcctcccctagaccatgagttcagtgactgcaggctgtactttcttcatctttgttttttggtgccataacaatttgtagaattgttgggctgtatatagagttcctgctttctccagataaagaatgtttagaaaaatctgaaagagttatgctactgttggatattggttgtggcagaatctcccctcccctttttacttcataaaatattcatgtttgttgtaggaagattttaaaataataaataaaaatataaaattaaagtgaccaaaaatcctaccatttataactgctgtaaatattttgatgttttctttcaaatattttcatgtgcaaatatgcatgcaatacatatttggaaaaaaacagtttgtaacatgtttcttcacttagtgtatgttgaaagtctttcagtgtcaaaaatatgtatcagcatcatttattaatatgttgctatcagtattctcttgtatggatgcattgcacttgagacagtcttctgttgttggacttttaggtaattttgcactgtttggtgttatgaacaatgagatcaatatacttacatgtatatatttgcacacttaactgtatttttaaaaagataaattcctaagaatggaattgctgagtcaaaagttatttgtatactttaaaaaacttttgccaaactactctccataaaagttttaccatgtggttgggttttacatttcattgagatttttttccccctttggttgattttatgttgccgttggaggttttatacattggaatgatttaattaaggctgtgtttctaggaatattaatatagcagcatgtgcaacatgaattggataaggaaagtcagtttttttgaggctgttctaacaatccaggtcagaggtaatgaggatcagaagggagagggtgactcttgaatgccggagagagtgactcttgaatacagaagaggatgactgggagaggtatttgcaggaactgataggatttgagaatgggttgggtaaagggtagtgccattacttgaagtgggaaattaaaaggaggcattggctggatgtggtggcacacctgtgatcccagcactttgagaggccgaggttgggggatcacttgaggtcaggggttcgagaccagtatggtgaaaccccgtctctactaaaaagacaaaaaatagccaggcatggcagtgcgtgcctgtaatcccaactactcgggaggctgaggtgaggcaggagaatcacttgaaccggggaggcggaggtcgctgtgagcckagatcgtgccactgcactgaagcctgggtgatagagtgagactccgtctcaaaaaaataaaaataaaaataaaaataaataaataaaataaaataaaataaaaaataaaaggaggcattgattttgggaggaaagatacggattcacttttagtaatttcagttctgtttgctgtgacatgctccggtggaaatgttcaagcacttggcactacagagctgcaataagaagagagccagggttcagtcatcccagcccgatatgatatttaaagtcctccataattgcctctctagcctcctctccaaccactttctcacttctaagccagacaaaactgtcttaatcttatcccattgttcaccacctgcctcaaagccctgtaggaagtcttctttgatctctccactggaagttagttccagttttctaaacttaatgctagttgtattttttttccatatcatttgtattatactttaacatcctatttgtatgtatgcattattttcttctacaggattttaaactcctagaacctgggactatatcatgaacttttttttttttggagactgtctccctctgtcacccaggctgaagtgcagtggtgcagtctcggctcactgcaacctcctgcactcaagcaatcctcccaccccagcttcccaagtagctggggttacaggcgcatgtcaccatggctggctaatttttttgtatttttactagagayggggttttgccatgtgctcaggctggtctcaaattcctgagctcaagcgattcgcccaccttggcctcccacagtgctgggattacaggtgtgagccaccgtgcctggcataaactcttttttgtctctcacattactagttctgtattttgcacagtgtcaaaaaatatttggtgatttacaaagtaaatggaatctgcttaaagtaatggtaataatacagtggattattgtcattctacacctaatacctactaaatgttaacattattttatgtgcattttcctctttatttttcttaaatactcaaacatattatgggagggggagtggaaaacaaaagatgttaagtgagaatcccctttcacagccgtgttctttgtttcctccaagattcttgaagaatggtatatacctgccttttagcttccaaccctctctgctacactgaaattgcagttgtcaaggtcaccagtcacctcctaattgccaaatccaatggtaaattttcagctctgatcttacttgacctttctgtggtacttgacactatgaaacactccattctccttaaaagtttctccttccctaaccttttgtgattttatcctctcctgattttctttcttcctcattttcgtatttatcttccctttgttcacctttaaagaaagatactttctaggattttgtccttggcactctacatagttttcatgagtgatcttatttgtactcatggcttcaactgctgtggtgactctgggccagttttctcttccgagctccaagattttatctctgagagctagaggacttcttttggatatcctgtaggtgtctttgactcaacatgttccagatgaaacccttcactctggcaaacctgcttttctctctcttactccttactttatttaaggtactatcttctatccaggcacacaaatgagatatttgggaatcatttgataatcttccttctctttgtccatacaccctaccagaccccaattcaaataaaacagcgatcaaatgctgtataatttcgtttcaaatctgtgtcctttcctttgttttgataacagtagtactttcttagttcagattctgtatctatagtgtcctaattggtttcctcccttccttttcgttactgccagaatgctctttctaaaattaaaatctgattataaaartagtcactcggaagcccttgcaatgggtttccattgtctttggggtgaatctggtttctttagcatggcatgcaaagctttcatttcctgccattattcttccgaagtagaaagcaccctacattctagccatattaaattgagttgcttaaatgcttcatgtttgctcatgtttctactttgtttcctctgtctgaaacaccctgttcccctcactcttaattctctgtggccctgaggtcccagttcaagcatcatctcctttggaaatccttacctaggccactaggcttcctttttgctttgcttctgtatatctttatctgcattagttgtaccatattatgtgttaggttacttgtttgtctcccttactagattataagctgagagaggaaagagactgagagctcttcatttccatcagtgctctacaaatttggcacagggtagtgaataaaaaactgcttgttgagtatatgaatgattaagaagggtatgtgttcagtggcagtactgggatcaggattcagaactcacattcttgtcttttataaaatatatatattttttatttttttttaagacggagttttgctcttgttacctaggctggagtgcaatggcgcaatctcagctcactgcaacctccacctcccaggttcaagcgattctcctgcctcagcctcccaagtagctgggattacagatgcccaccaccatgctcagctaatttttgtatttttagtagaaatggggtttcaccatgttggccaggatggtctggatctcctgactttgtgatccgcccaccttggcctcccaaagtgctgggattacaggcatgcaacactgtgcccggcrtgcacagtgtatatctttaggtaaaattcttaaatgtgaattgctgtttcaaaaggtatgtgtacttgtaaatttgatggataatttgattcattgctttaatttttttttcttttttaaactccatggaatatttctagtcacattgctgtaattgttaattttgtatatttcaagcatatagacaagtacagaaaatgtatagcagatacatatgtacccactactttttaaacagatgttgacaccctcattgacgttctccctgttaggtgcttttagcacttcctcaacattgtgatgttctcccacagaattttatcttagacgtcacagtaaaaaagttcctcagaattcatacactaccattctggaggtgccaccatacattctatcttggactttctttttaaatatagcctcattgttagcaaaaggcagcttcagaggaaaattccgttatgttatttttggtgtctggaatctgacttttgaaaaatgtttattttgccttcttcctctactcaaaagcaacaaaagaatgctaccagaactttatcacaaaccaagtgacttaaacaaattaaaaaaaaaaaaggcagttggtggcctatgtttctagagacttgtttgatttgctggcagaacagcccaggtgagttgagccagtaagcacttttcttccactaggtttttcagaataaccaaatgtagttctcctaagcaggcactgatctttagctgacttagtggtgcagctgtatcctctgggttttgatggagttgatgagagaaactgttcttgcgggtggtaggaagctgttgacctgacctctgttacacctgactgtttcaatatgcctttgtggaaatcaatttcctacccttccatctctctgctagagatctataaccttgttccagtggaaggtgactcttacctctgatcttttcctaggtcctcagaatgcctggcagtgaggcttttaggttattttgggattttataaactgagaggggaaccttagtctcaggtggggctagaatctgaggtcctataggtacagatttatcctaaaagcaagtgtttttgccttctctctcagttgctcagtgcttcttacctcatttgatctcttagtattacataagcaccttagggaggaaaggactcaaaggagccaaccatttctccttggacccacagccaaaaagaaaaggctcaacgagagtgagcttattcgagggtctgtagcctaaagcatgggctcttttaaagcctcttgttgggccgtgaagcataggtctaatccacgtgaagtaattacccaggcctggggtggccacagggtgagcagagctcttcgtaccctttttgccagacctacacttaatttcctttaaagcctcacttggtcttgccatttcagccctttccttcgaagtatgaagcctgactttttttgtcttcctttcttcagccctgcagaggcagctgtggccctggggacagccctttcttcaaatggcaaactcattttctgtccagcagaccagaaggacaaggtgtaattcaacgcttctctccaccagacactgctgccagggggagacaatgaagaaagtgatctttgttgctccctgaataggtccctgaacctggcacctgcttttgttactggctccttaagtcactggagacatttttgctgtttcctgggttagcagctgctttgggataatagtagcaactggttgtcaggatgtcagttctgcctcaaagaaaatcagtgtatttatatgaggagagttaccttttctgttcttaaatttcttcagggtttgtctgaagagtgagcagttggaagtcagctgtgcccttagtttgatgaccccatgaccctcatctttgaatctgaggagacactgccatttctactatccaagtactaaccaggcctggccctgctcagcttccaaaatcagacgagatcaggcgtgttcagggtggtatggccgtggacgagacactgccatatttttttcgtcctgctctccctctggtgagactctgagttctgggttctagcatgtaggtcagtgcctcctacctggtaagcattcaacagatatatgtgggatgaatgattgaatgaattccttgatcttgctgtccaggttcagtttctctgacactgatacgtgggtgctctatgggagggggacctttgtttttaggagaaagattgcttcaaaggaattatggaaggtgttgatttctagggggctttgggggaactatgggaactctaagatatgattcgttctcgcctcattggtctagatctttctcctcgatagtaactgtctgctgacagacttgccctgtttcaggagcagtatcctgaacctgactcatctgggctctgtccttgagcagggtaagggattttttttttttaacagccatcctgtcactgtagattcagaagccctcaggaccacatctcaggcactgtagtcttggacttcctgatctggctgcattcagtcaagttccactcagctcttaggtgtctgtgcctttgtaagggctgttggagacagaagggctttttttccgctttgtcagcagctggccagagaatgcctattagtctgccagatcctaagtmtttcacgtttccctgtctgtgtctggaacttagggcagaatctcttaccacctgaggttacatctcactatttgcctttgtgggacccattggaggataaaagatgaatagccatgaaaggcatgcagagttattgaactatggttctttgaaatgctgtgactctgaggaaagatccctggtctccaagaatacaactggagccagaccattgcaccaccaccctcctttcccaagagcctctttggaaccatcactcattccatagttccaaacatccttgtttttgtttaatttttatctgataaatgttatgaaacaattttaatggtgaaacmcacagaggaaatgacaaactagcatgtgttgtcttttaaatgcacttagttcaagtggttaagtcagttgttcctgttgttagattgctgttgtgtagtcgactttccttctttaggtgggaagagtctctgaatagacttwaaaaaagcaaaaggaaccagctcttctttagctgattgatcattcctttacatctgactcttttcagcacttaaattcagattgtactatgctgattgctttcagatcatgacacagaagaggtcttaaggtcatttcaggagttctttagctgaggtccatgtgatacttctccacttgtaaacaaaagtttgtatgtaggtaaatatgtatatttttatagggaaaagtatccttagttttcatcagattctcactggagtttatgacctaaaaatagttaagacttagtattttatttatttatttaagatggagttttgctcttgttgcccaggctggagtgcaatggcacgatcttggctcactgcaacttccgcctccgggtttcaagcaattctcctgcctcagcctcccaaatagctgggattacaggggtccaccaccgtgctyggctaattgttttgtttttttttttgagatggagtcttgctctgtcgcccaggctggagtgcagtggcgcgatctaggctcactgcaagcttcgcctcccgggttcacaccattctcctgcctcagcctcccaagtatctgggactacaggcgcccgccaccgcacccagctaattttttgtatttttagtagagatggggttttatcgtggtctcgatctcctgacctcgtgatccgccygcctcggcctcccaaagtgctgggattacaggcgtgagccaccgtgcctggcctattttgtatttttagtagagatggggtttcaccatgttggccaggctggtctcgaactcctgacctcaggtgatccacctacctcagcctcccaaagtgctgggattacaggcatgagccaccactcctggcctatgacttagtattttataagaatttgggggcttggcatggtggcttacgccaggcccccagcacttttggaagccaaggtgggatgatcacttgagtccagaagttcgagaccagcctgggcaacatggtgaaacactgtctctacaaaaaatacaaaaattagcgaggcatagtgatgtgtgcctgtagtcccagctacttggggggctgaggtgggagtatcgcttgagcctgggaggtcaaggctatggtgagccaagattgtgccactgcactccagcctgggtgacagaacaagaccctgtctcaaaaacaacaaaaaaagaatttggggctcctgcctcatataactagttagtggcaaagttgagatagactctgaaatcctgggattgactctacaagaatctatatttgtgttttttactatatcctactgtctaatttacggtctttaagcactaaactcctttttaacctgttaatcttgcctatcaagttgcattttgagaaaaatgaaccatgtatttgtgtttctccataactcctaatactcacatctgcacaaagtagtaccttgctggttctgttgactgactagtagcattggaaggcacaaaagcttgggttggttattactttccctttccattatctttttttttttttttcctctaagttggggtcttgctctgtcacccaggctggagtgcagtggcgcaatcacagctcactgtagcctcaacttcctgggctcaagtgatcctcccaccttagcctccccagtagccaggactacagtcatgggacagcacacctagttaacatttttagtttttrtagagatgaggtctcactatattgcccaggcaggtctcaaacttctgagctcaagcagtccgcccaccttaccctcccaaagtattgggattacaggtgtgagccaccacacccagcccctttccattatcttagcagctgtcacaattatttagcctgatctttttaggtgggcatactcccttttctctctgtttttacaatgctacttacacagtttctccacctgcatccaatctgtaattgggagttttgcagagcagtgtatttggtatgctgtgaactcttccctaggtcacccaatggcatcttgtgagccaggttgtctgaaaaacttcaaatcttggtggcagtgtggtgggtgtatctcccatatgagggattgttccagggatstgactcaattgacagctcctgaatttctaatatgccaaggcttttgtggtaagatgagcaagaatttttcaagctcagatttggggawcatagcttcttgccatgctatctcattggcatgatgtgtgacttttgggcagattacttaacctctgtctatttactttttctttttttgagacagggcctcactttgtcaccaaggctagagtgcagtggtgtgatcttggctcactgcagcctcaacttcccaggttcaagcgatccttcatcctcagctccccaagtagctgggactgcaggaacgtaccaccacacccagctaattttttggagtttttgtagagacggggttttgccatgttgctcaggctggacttctgtctgttttctcatctgataatgaaaagttgcaattattttcacaagatactttcaaagatgagtctwataatgcagatgagccattttgagttccttacaacaaagatgctgtggaaatttcaggattttccccctttagttataatatgggtagcttatcctaagaacctgtgactattgggatggtcatctttttgaggccagcagtagaaagaaatttgcagtagtgactgacacattaaagcaacyccgaaacaaatcagagtgaaatagtgtcctggagttggggatatgtgggtgatatctgggctgcattttctctctaggtatccatggagagggtcctgtctccctgaatggttgtgctttcaacagttagggaatgagcttgacagtttctgcttcttccctccccttgccttgaactgccttgatatgcagtgcctcctctgttgtgtggctgtattccagtccgtaaacatgactgctgtaaggagagtacagagtattgtttattttgtaaaacttgtctcattgccatgtaatatttgctcaagagctcctgttgtggtgatattcttgtggtgagcatggccctttaaagattttgttctcaaatgttaaatgagcccctgactggtgtcctgaaaagcatttaagcttctctccctagagtttaagcaagaggagcagtaatcccagtggagcctgggctggggtctagagagaaggtggcagatgaggtggcagatgacaggcaggggcggttgtggtccygtagytcatttgcacaaaggaggggctggcctctcctggggaggtatttccgctcactggaacaaatgagggcgctcaaaaggctgtaatgtaatgaggcttctctggtgacgtcacttgtaaatgtggtcaaagtccagttcttgggggctagtagaagcgggagtagagatcattcggtttgcatgctttcacttctcagctgtcactgtgccatggtgcctactttcagccagtgaaccaactcaactgggccgggcatgaacgcttacaagtatcagaagttcctggagggactcaacaaccttagaggtattacaaggcttcaggctccctaccctttgtccttgctgatcgtgtgagcacttattatggtgtgtrttgtatagggtctgtaaaaccctcctgctctgagctggccctattttttatgcgtttaggcaattaaacagaagggatagagtttgtaaatgcaatcctaagtgagtaggagagaatctccttaggtacttcagcaacagcctgttgtcttgcttgaacggacaagtaagaaatgtcccctgtattcttgagctcagagggctcagggcactccctgttttctttgaggtggccagacagtgtgggtggagggctcttgccatagggccctgcagcctcacctaggtgtagttatgtttcttgggccaggttttccagttgcttgtgtctacagtgagtcagagtcccatttggagagaactggagttgggagtggggaggagggtggagggaggaatgcaggttgatgggctatttgtaagcccattgtaaagtaagcctttgtaaagagtaaaacaatgactttgaaagaggaagctttttattaaagttttaaaggaaatagtgttttctttgcatcatgggcaaattcttcactgaccagacatgagaagaatgtactcagatgtgatgtaggactctttttggatattaaagagaaaaatgaatgaaatctttttactttcccttctctaattaataagtggttttatttccatttgcagaggagggtgcttaaaccatttttctttcatcagtagttaggattctggacccagagcaaccatggggtgtggagagagtgggagggggtagagggaggaaaggagtaaactgggttttttcagggatgaggaaagtggcagacagggtgtgggcaggagatctgtactcccttcttgccagggtatgtagatgttttactttctttcactatctgttgaagaactctggttctaagaaatatatatggagagctttgtatgctataaagggatatacaggtcgggcatggtggctcgcactcgtaatcccaacactttgggaggctgagatgggaggatcgcttgarcccaggagttctagaccagcctgggcaacataatgagacccccatctctacagaaatgttaaaaaattagctgggcatggtgatatgcacctgtacccttaactacttgggaagctgaggtggaaggatcactctgagttcatcttagaggtacagaacccaaataacacagcaaagagccccagagtctggagtgagaagagtgctgctctctggtgctagagaccatgtgaagaagggaagaatacccacatctgactaagcatatgtgtaaatgcaccttcctctctgagacaaagagctgtagtatggggctttagagtgaaggtaatagatcttttctctccacactactactcaccttgaatggagttctgttttctaatctttcattcactattgtttgcttcattcacttatatacactgtataatagtctttatagcataaaacatacaatatatagcagtttctcttrttgacccaaagaaaggatcagatttaaactcttctttgctcctgcaacctgagtctttttcaggtgggagaagttcctggaaagagsacatgtagtttttttggtttagtccttatcattttttggaatrttgctataggtcttagacaactattcccccaattctgggctgccaggcagagagttagatacaaaccattgcctttgtcaaatcctcctgtgggttgagtttcacccactgtgccccctgattaaggtgaatggttacttcccttcttcttttcacttaatatctttgtgtattccagaagggctgatggaaagaggtaattggctcccctcttcatttagttactgactgttgcttttcttggcatggttcagcttgtaracattcctccatctagtgggtaactgttgaagggaatccagtgggagaatagagacrttgtacaagtttttgaagttctgatccccaaattcctatgaatttttggtgttttgatccagaattggggtgcaatattttccactgctcgtgctttttctggagggctttaacttatatttctcaagcctgtcaaaaaccttagttattggggtgatttctggccagatggacctctctcatgggtatgacaggctgaactattggcccgagtcctgatttttggcagagtccagacctgtgccatgactgggataagtaggtaattagggattaattagggaagcagagaggtaggtgaagtagagtggtgagaaagtggttcactagcctttactaagaaaaatttatgataggactatgagataactgacttttaaaacagaaatataatggccaggtgcagtgtctcatgactgtaatcccagtgctttgggaagctgaggcaggaggatcagttgaggctaggagtttgagaccatcctgggcaacagtagcaaaaccctgtctctaaaaacaagcaaacaaacraaaaaacaatacaaaaactagccggtggctgggcacggtggctcacacctgtaatcctagcacttcaggaggctgaggcgggcggatcacaacgtcaggagtttgagaccaggctggccaatatgatgaaactccgtctctactaaaaatacaaaaaaattagccaggcgtggtggcgggcgcctgtagtcccagctactcaggaggctgaggcaggagaatggtgtgaacccgggaggcagagcttgcagtgagcagagatcgtgccactgcactccagcttgggcgacagagcgagactctgtctcaaattaattaattaataataaaataaattaaaaaaaaaaaactagccgggcaygatggtgtgcgcctatagtttcagtttcagctactcaggaggctgaggtgggaggattacttcagctgggggtttcaaggctggagtgagctatgatcatgccactgcactacagcctgggtgacagagtacaccctgtctctctgtcttttttttttgcaatctccgcctcccgggttcaagcaattcttrtacctcagcctcctgagtagctgagattacaggcatgagccactgtgcctggctaattttttgtatttttagtagagatggggtttcgccatgttggccaggctggtctcaaactcctgacctcaagtgatctgcccgccttggcttcccaaagtgctgggattacaggcgtgagccactgtgctcggcctctgtcgcttaagtaaatagatagattaaaaacaaaaaagaagtataccccaacatacctatgtaattttacccttctcttcctttgcatatactgtcttatttcctctgcctggaatcccattatttttttctctttgtaccaaatttctgctcatctttcaatgcctagctcaagtctcactttccttccgtaagttttgtttttgtttttgtattcccagtagaattattctctctccctcatctatgttgccatggcactttaaacatacttgttttagagcatatcacattatgttttagttattttattaaacatttgattttcctgctagtctttactgcttggtcaagttttctataactttcataggcttcagttttttcatttgtaagaaaggggatgatagaatttactttacaagatgttgtgggkattaaatgagatagtgaatataacatctgatgcagactaggagcctgatagatgttagcgatactgtttctaaaggcgggaactgtgtctcatttatccttgagtctcctttacctagcatagtgcctggcacatagtaagcataaaaagagtatttgggggaattgaattgaactaaactcatatatttaaatgtccttcagtagtcaccataggaggttaaaaaaatattctaacaatggtgcctatgctgcatacttttatttaagcatgctttttgtgggttttctcttcagtgccaggttatgaccctcataagaaactccatagtcgccgggcatggtggctcacgcctgtaatcccagcactttgggacgccgaggctggcggatcacgaggtcaggagatccaggccatcctggccaacatggtgaaaccccatctttactaaaaatacaaaaattagccgagtgtggtggtgcrtgcctgtagtcccagctcctcaggaggctaaggcaggagaatcgcttgaatccaagaggcggaggctgcagtgagctgagatcataggtgagcctgggtgacagagcaagactgtctcaaaaaaaaaaaaaaaaaaawgaaaagaaaagaaaaaaagaaactccatagtcattttatagtcatacctaatttttggtcaaaagatgatattacccaagacaaaattaaacccaatctcaaagaatgaaaatgcactactattgaaaacattggaaagatggtactactagtctgtaggtagttccagatgaggggttccaggtattttgaacagcaacagtattgttgaataagtggaaaaagtgactactgagaaagaacatggtcctttttggttctcttagttctgatacatttgtcagatcatgtttctcattatcttagagctttacttgggacatccacttagtctgccttctgagaagcctgtcccctgttaccacatacagtcaagcaggacaagctttcacaccccaacatacaccctcagagagtgaattctttttttaagggggtgcttttttcccctcttcaacttggcttggaaaaaagacttttttgactttttttctgatgttaaatgatggactacattgtccttatagaaagcagggaaaaataaactaataaaatcaccgaaatcctacaaattactaggctcatattttgctgtatttctgtcatcttttctctatccatgtgtatataatgttgcttttatatatatctgttgttgtagttctctgtcttgctctttattattttgtgagcattctttatacctttatctacatcatgattttttacagttttatggaattccatcaaatggaaggttcatttatttaacatactccagtagcggggcatgtacattgctaatttttcactgctatgataacgaacatccttgtaaataaatttttctgtgcatttctgattttttttaaggatggatttccacaagtggaatcactgggtcttaatacatatattcaaagctctggatgttggcttttaattttatttcacttttaaaggctactgagggtaacaagaggctatctgtaacactgaatacctctctgatagctcttggccccttgtcctctagggatggccctgtcttcaggcttagtggccagttggctcagatgttttattatccagttaatttcatggtagaacaggggccaagtggccttctcacttagtcagcagctcccatcatgtcatcatcatatcactgcactgctttactctgaagcttttctcacagcaactctaggcatttaaatagcttcattgatccttccaaccctagtacccttttctcttgtagtggtaagggacccattaatgttgattgggaaactgcagtagcaagaatgaccatcaatattgtacaggaatcccacattggaaccctggattggtaccagattgagattctctttgttttcttgctgttactgagctagcaccgaggtaataaattgggccagcttaatttgataaaataggttgacaaactttactgtgtcaacacacccctgctttggtagatttctgcctctggaagaactagaactggtgctgtgttttaaatcaatgtattacagccaagtgcaaatcagcttctgttatgtgggactgatagccttagagtagaattatagacttgatgagagtacatccttgtttctgacttggagtggacatcctggagcagataacgtgaggttttgtagctgatgatagactggggatatttggaggttagctggagaactgaaagaaggcacatgtgtaggactttgtgtgtagggggccaataagaaagtctctgcagcagttaggatagtggaaaatggcttgagtcactgacaggcttgcgtcctgcatccttcatagtgagaactgtgtgcctttcccattcccagagcccttaagcaaagctgtcataaaagggcgattctctccactgcagggaatctggaagtctgcatgcttctggggtgaggcctgtcaacaccttttacagcactaggcacctagtagaccatgtgcttatttggatagttgatagttttgtcctgttaaagttttttctctccttaattgtatactttttaggcttactgcatgtcactgggctagagagggtcatcagcacaaactcactttggggttggtttcagttgctgctgtttttgcaatgtgtattttttttgttacaactggagatggttgttatacgatccctatttctcaaagagtgagcctgtatagctaacaagcatacaataccattttcccctcatccttgattttgttttcttrtcatgtaggcattagtattgaaaggttaaggccttcatcctcactatgctgctgtggtttctattggttgttggagaaaccccaggctgataatactacttttatgttgattactcattgtaacaactgtggggatggtactttcaatgaataccagttgttaaatagcatcttttgctcattgtggaatggcaggaaccttttggacttcttggtttgaaatcctttgatttggaagatcacttttttacaatctgttatcaacttaattgcctcactccctgatcatgttccatgtttcctgttgcatttactggaagtctccatctccttccttcctttcattgagaactttctgacaggatacaaagattattgatagtccctgtctttgagggattatcagccccatatagtttagtggggagactgtagagggcactagattttttttttttttttgagatggagtcttgctctgtcacccaggctggggtgcaatggcatatctctgctcactgcaacctctgcctcccaggttcaagtgattctcctgcgtcagcctcccgagtagctgggattataggcgtgtgccaccatgctggtctaatttttgtattttcagtagagatggggtttcaccgtgttccccaggctgatcttgaattcctgacctcaggtgatctgcccaccttggcatcccaaagtgctgggattacaggtgtgagccaccatgccctactggcactagatatttatttatttatttaaccatgccctgccagcactagatatttatttatttatttattyattyattcattcattcattcattcgagatggaatttcgctcttattgcccaggctggagtgcagtggtgcgatcttggctcactgcaacctccgcctcctgggttcaagcgattctcctgcctcagcctcctgagtagctgggatttgcccactaccacacctggctgattttttgtatttttagtagagacggggtttcaccatgttgcccaggctagtctcaaactcctgacctcaggtgacccatctgccttggcctcccagagtgctgggattacaggcgtgagctgtgcctggccagcactagatatttttaagacagaggaatgacataaacaactagggtgggtattttttgaggggtggggtggggagagataactggcagcagtgtgaaagatcatttatagggatcatttacagggaagtggggatatagctaagccagtaagtatgtacctgattttagtttgtttaggatgcaaagaggtgagagaagtaaagagcagggatgttaaatctttctttttgatggagtttcgctcttgtcacccaggctgcagtgcaatggcacaatctcggctcactgcaacctccgtgtcctgggctcaagtgattctcctgcctcagcctcccgagtagctgggattacaggcgcctgccaccacgcccagctaatttttgtatttttagtagagacagggtcttgccatgttggccaggcttgtcttgaactcctgaccttgggtgatccacccacctcggcctcccaaagtgctgggattacaggcttgagccaccgcacacagccagggatgtgaaatctttctaaaagagaatttgggctgggtgtggtggctcatggctgtaatccagcactttgggaggctgaggcgggtggatcacctgaggagttcaagaccagcctggtccaacatggtgaaaccccatctctactaaaaatacaaaaattagaccgggcgcggtggctcatgcctgtaatcccagcactttgggaggccgaggtgagcggatcacctgaagtcaggagttcaagaccagcctgaccaacatggagaaaacttgtctctactaaaaatacaaaattagctgggcgtggtggtgcatgcctgtaatcccagctactcaggagcctgaggcaggagaatcgcttgaacctgggaggcagaggttgtggtgagccaagatcatgccattgcactccagcctgggcaacaagagtgaaactctgtctcaaaaaagaaaaaaaaaaattagctgggtgtggtgacaggcacctataatctcagctattcaggaggctgaggtaagagaatcgcttgagccaaggctttggaggttgcagtgagctgagatygcgttactgcactccagcctgggcaacagggcgagactccgtctcaaaaaaaaaaaaaaagagagagagaatttggtttttaaaaatattttatgttgaatgttagctggaactggagatccactttacccccacagctcaagttcagcttgacccttatgttgtgcaatgctttgtgtttgggttggtatttcctgggactggtcaggtgatgcacttcagcatgaggcctgtgtagtagctgaagagtagtgacccaaggtgtctatcagtgataagaggagagaagaagcccgtttagctctggacagggcctctgtttcctctgagatctcttgtctactctccctggtccagggctccatctttgcatamctttttacagatagatttgaagtgccaacttcattctgttttggagtactggcattggacacaattgattacatcsctgcctgtttaaaatattctcttcttttaccttcaatgagagtatttcatggttttccttaacctatctgattgctgtttgtctgctttgttgggtctttttcttcttctgactcttaactgtggcagttttctaaggggtaaggcagtgtagtgaagtgggaagaacatgggytttggatccaggcagggctgggttcaaatatatgttttttgtgtgtgtgcgtgtgtgtggagaacggtctcgctatattgcccaggcaggtctcgaactcctgggctcaaactatcttcccgcctctgcagagctccctgagagctgggattacaggcgtgagccactgcgcctggctcaaatctgtgtttctayatttatcagctgagtgacctggggcaagttactcacttttcctgagcctcagttttttcatctgtaaaatggggataataatatcttccatataaaattatgaggattaaacagagtagtataagtaaattttcttattgcctgattgatyggttgatcgtagagatgggggtctctgtgtgttgtacaggctggtctgaaactcctgggctcaagtgatccatccccttggcctcctaaagtgctgggattacaggtgtgagccactgtgcccagcccaaactcagtattttcraaccaagcttaaatttggcttttctatcctagtccccattttttgacagttgaaytcacattcttccagtctctgagattagaaaccttgcagacatctgttaactcttttctcttcatcaaccccattttcaatctgtcattgagttcttttgttcttcagagtttctcttaaatttgtctttttctccccattctctattccatgactctagtccagtcacttatcactttgtacctgaattacagcaaccgcctcatattttgttttctgtgtcctgtttctctcttcagttaacaccgaagtagcagctactttcctagtatttcctattactgaaagtctaaatttgttacaaagaccttttatggctggacctggtggcccatgcctgtaatcccagcacttttggaggctgaggcagaaggattgcttgaggtcaggagtctgagaccaggctaggcaacatagggaaactgtgtctctacaagaaaaaaacatttttttttaagtagccagacctggtggygtgtgcctgtagtcccagctactcaggaggatgaagtgggaggattgcttgaagcccaggaggtccaggctgcagtgagccatgaccctgtcactgcactgtagcttggggacagagcaagaccctgtctcaaaaaaaaaaaaaaaaagacattttatgctctcatccccttcctacttaaccaggcttatctcacttattttcctagaacacaccttcagttccacacaaaccctgttcctcattgtgtcttatcctccctcattcattctctctccttgccctttctttctttctttcttttttttttttttttgagactggagtctcgctctgttgcccaggctggagtgcagtgacgtgatctcggctcactgcaagctccacctcccaggttcacgccattctcctgcctcagcctcccgagtagctgggactacaggcacctgccaccatgcccagctaatttttttttttttgtattttttagtagagatggggtttcaccttgttagccaggatgktctcgatctcctgaccttgtgatccgcccgcctctgcctcccaaagtgctgagattacaggcgtgagccaccgtgcccagcctctccttrccctttagttctctttacctggaatgcccttsttctttatacttaactgaaatctgtctattccttcaagtttcacttcaggtctttcttctgatgaagacttctctgattatcgtagtccaagttgatgtatcactttcccaagctagttttatctrtctattgaaatggtaagcttttttgagagaactgttttatagacatttctattattcccacggtgcctcgctcatgcctagmcaagtttaaatgctccttacagagcacttataaaatgtggtgaccaaagccaatcactctttcattcgacaaatgtgtatgagcacctaccatgtgtgctgtgctctgcactgggatcccagcaataaacaacacagaaacaagacaggttatactgtagagaaggagacactagacaaatatttgttggtcaacagaatttgtggaagccaggcaggactctaagtgaggacaaatgacaagaagagggagaatttagaaaataagatatcagtgaaacgactattataggaaaaaggtgtttaatggattcattcagcaggtaatttattgaatatccactgatacaaatgtattcccaggtattagggatataycagtaaataaagcaaagtcctttcccttgtaragcttatattctatcatttagaggcatttttgaaaagcaaagcacctaatattggatgaagcccatctgtgggaggacagcagtgaaggagttaaaatgcttctagggctccaggctttgttgaaacagatggtttctttgcactagggaatgtttttaagagggattagaggactgggctgaggaaggcctgagacctctttccctcacgccatagcacacacacctgctgttctggcgcctggtagctatgtaacttgtcccccacttggtaggcacttgtttgcaggcttgtgattgtgactgtagggctggctctaagcttctgacatttttattttcctttcgtgatttttatttgtggtccaacagcaatgaagtcccatttgaatttaacagacgttgggacttgtctgcgttcctttctggtccatatttacttttacataattgtaatctttctgtttgtgtgtgtgtgtgtgtgtgtgtgtgtrtgtgtgtgtgtatttttctcccgatccagttttattgtggtaaaatacacatgacaaaaaattgatcattgtaagtactttaaagtgtacagttcattgacattaagtacattcacaatattgtacaaacaccatgactattgaattgcagaactttttcatgatcccaaatggaaatcccatatccattaagcagtaattccccttctccccaacccctggcaaccactaatcagctttgtgacttgcctgccctggatttgctcattctggatattttatataaatttagtcatgtggccttttgtctctggcttctttcacttagcatatgcacatatttacatgccttttccatgtaacattataaggattttttaagtgtttcgttacagacattatarttttcttttttggacacagtctcgctctgtcgcccaagctggagtgcagtggtgctatcgcggctcactgcaacctctgcctctcgggttcacgccattctcctgcctcagcttcccgagtagctgggactacaggcacccgccaccacgcccggctaatttttttgtatttttagtagagacggggtttcaccatgttagctaggatggtctcgatctcctgacctcgtgatccgcccgcctcagcctctcaaagtgctgggattataggcgtgagccaccacgcccggcccagacattataattttaagttatcttgttgataatggcttcatttagccattcatttattgttgaatatttggattgtttcaagttgctattattttttaaaatgctacggtggaaacctccctgagtgtgctctgccatctttcaggggactctgaatgttgcacatcagctgcagaagagccattgtgcttgatttaggatagtgtggactgttatccagctctgtgggaggacagtcaagtaatgaattttatatagaagggagcattattctttgcaaaataagaccatgttatccagggagtggcagggaaaagttttttttccccactgcctagaattctctgataatccctctatccctttggctgtaggaaagaattgattatagcagttgaagatgaaatgttttattcatttattcattcaacaaatatttgagagcctactatatgccagacatttgaaacttgctcatgggttgagcttggctaaacagtgcctttcactccctgggcctttcatacctgcctgggaacaagaataggacctacttccagagtaatcagagaggatccagaggtcagagccatgtggggccttattacctcatggtttaactcctcaagatttggtaccattatagatactaatcacacattaatttgtctgctcactctggggatttcaaggccaggctgccacttttcatacgtggctgttcttgttcaccactctaacagagtcctggctgctaggagatgagccatcaggcctgtgccctcttagtagttttgttcactatatcctgggcaaggcagcaaggagaaggtgcttactgactgagtataaaagcttcagagactttattatagtaacgttactgtgttcatgcaaggggtgaggttggcatgtcacagattctgagttagcccagatatacttgggttagtgctgctggggccttcttgccttctggcagacagccctcctcccttttttgtccttgctgacccatttaacagaatacttttaatttctctctaccttgctaggaaaataaagaccacttaggaccattcagggccacacactgcttacaaaacccagtgtggagtagaaaaagcactggaggccgggcgcggtggctytgcctataatcccagcactttgggaggccgaagcgggtggatcacarggtcaggagatcgagagcatcctggccaacatggtgaaatcccgtctctactaaaatgcaaaaaattaactggatgtggtggcgcatgcctgtagtcccagctattcgggaggctgaggcaggggaatcacttgaacctgggaggcggaggttgcggtgaccagagattgcaccactgaactccagcctggtgatggagccagactccatctcaaaaaaaaaaaaaaaagaaagaaagaaagaaagaaaaagcactggaaacaattgctagatcttaaacattcacttaggaaatgccaaacctgtagatttggagtaagaagcagagaggctagtgagagagttcagggtttaggcctgatttctatcctcttccacctaccacttgttgcatttccttcactgtcagaatttgattgttctgtgtctgtatcttcagatgtgtttttcctagtgtatttgaaaaactgttgaacagtcccctctgggcagggagggaagagggttagacaatcaggagtagagactctgttatttctctctccagacctagaccctggagttaactgaaggtccagagttactgaggggcggctgtgtttgtttttcagtaggctggctttactgagtgggatacaagagcccaaagcacaggccattcccagaagcctaacattttcatatttctttctctgccaaagaatctttggttagggttaagaataactagtctgtctgtggaaataccaaggccttttgtttgccagaagaaaagcgcttttgattaaggctgccttttctctctctcttttttttttcttaagctgttgtgggaagacttcagagcctctgaaggtgcygtatttaaggggtgtaggggaaggaatgatagctaaatagaactaagggagacttaatcgtgctttaccgcacatttgtgcagagattaamaacagcaacaaaatctacccagtttttggtcattgcttctactagcctttctttcttcctgtcttttatgaaatctacccaaaacagtagttcccaaaggacctgctgtactgatctgaccttgaatcatactctatcacttagtgtgatttggggcatgttacttaacttttctctttaggctagagttttgcaactataaaatggggattatagtagaccattttcatagggttataatgagaattgaatgagttaatatgtggaaaatacttaggacagtgcctggcacatagtaagagcttatcccagtaaatattactgctactgtgtatggcaaatgctgagtgtagctttattttttcgattagtaattccaaatgtggctttctagggttagcaaagtcagggctttttttttatagaatgaaaaggaagcagacattcccattaggcattaactttttatcagtcagaggcaaagggaaagatttattctctgtgtggacgcatcatagaggctcagtgtcttcttagttgaatgtcaacaagggaatcaatttcatcatgaagaactactctttggcaaaagcaagggcgagggttgggttgtgtactttcgtagtctttgtctgagagtagtgatgtttcttgtgccccaggaaagcttgaaccaaggtatagagaaagggcccctgatcctccaaatttacagtagtaagagaagcaagaaatatcttagtaggaaaaggggaaaccctcagggctgggtctcgtcccagtgactctactaccaggtctggagaatgtcactagtggaggctctgggcaagtgcctggccactgcatttccctggccatagtaagagatgtgcagaatgacctgccctaagtctctgggctgtttgttttataaactgctaccttcttccccaaattgctgggagtggctaaggaagtggcacagaaatttagatttttgtgtctttcttgcccttttctgtattgtctttagtttttagaaggactttcttggctgccttctccctcccccaccttgctccatcctctcttgcaaagtaaaatctcatcttcctgcaggaggttaggttgtaaagtttacacataaagtgaggattccaaataatcaaaattatcatggaaaatatctcaaatgacccagaaattaaagtatataaacatggttttgtgtatatgccagaacaaagttggaataccatatgaaatagttggcctgtaattaggagacattttatatgaaaaaataagtattctcaaaaactagaatcatgtacagcattcagaatgctcacaatgtgaagaggcacaccggacttagacatgctaaagtctcagattcaagtcctctcatctcatgctcatgttcatcctggtaaataacttcactttggtgtaaaacctcattgagtggaattgtgagcaaacttttgtactgtttatttttctcttcctggtcaagtttgcatagttaaatgcaagtatgttgtgattgtattttatccttcttttctgctttctgtttttctaatttcttcttcccttttaaaaatcctcactgccgggggcagtggctcacacctataatcccagcactttgggaggctgaggcaggcgaatcacttgaggccaggagtttgaaaccagcctggccaacgtggtgaaagcctctctctactaaaaatacaaaaattagccgggtgtggccaggtgcagtggctcacgcctgtaatcccagcactttgggaggccaaggagggyggatcacaaggtcaggagatcaagaccatcctggctaacatggtgaaaccctgtctctactaaaaatmcmaaaaaaaaaaaaaaaaattagccaggtgtggtgacgggcacctgtagtcccagctactcgggaggctgaggcaggagaatgtcatgaacccgggaggcggagcttgcagtgagctgagattgcgccactgtactccagcctgggcgacagagcgagactccttctcaaaaaaaaaaaaaaaaaaaaaaaaaaaaaaaaaaagccaggtgtggtggcaggygcctgtaatcccagctactcaggagggaggctagtgcaggagaatcacttgaacccgggagacccaggttgcagtgagccgagatcacacctctgcactccagtctgagtggcagagtgagactctgtctccaaaaaaaaaaaaaaattctcactttcttcttctaaatccattttatagcacacaacaattcttctcttacccagaatgcttatttgtgtgttagcttgtcscatttcttagtcattttcgttattcaaaattatttaaaggagaattgagagtaggaagggaagacttctaatagtcctcttcgtttaaattctgtaatcatagcttccactctcctccttttaggtcctctaacttttgattcttataccttgcatatgaggctctttccttctttttccccccattttagtcatttttctgtagaaaatttctgcttatgcttggggagctagatatgaattcttgttatacttactaagcatcactggttctatctctagatgtttaatagtcaggtttttagatcaataggtttttagatcaatcccaaattcatagtgtcatgaaaagatagatgaggaactgagcccacctggagaagtcaaaggatacttgggccaagtgatataactagttattgacaagcttaaaccatgacccagggttctgatgtacagttgaatgcctttcctccaaatcacattgcttgctgttgaagccttggctaggagtaatctttagtaagatccttgaattgtgactttttttcttttgtttaattttattacagttccttcctttaacaaaaatgctaagtaatataagctttaagagggttaaaattagtccggtttcaaagatatatttgagaattatgtagtatctcttgagatagtctagagatcttagagctacgttggggcctaaggactgagaatcgctgtcatcagactagaggtttgagaaaaggagatttttatttatttatttttgagacctagtttcgctcttgttgcccaggctggagtgcaatggcgcaatcttggttcgccacaacccccgcctcccaggttcaagcgattctcctgcctcagcctcctgagtagcatgtgccaccacgcccagctaattttgtatttttagtagagacggagtttctccgtgttggtcaggccggtttcaaactcctgacctcatgtgatccacccgcctcggcctcccaaagtgctggcattacaggcgtgagccacctttcccggcctaactactgtttctatagaaggagttttccagattgatgcctaatgtacaaataactgcatcatcagtccctggctgtcatcattttgctgtgcaaaaagggaacatcagagaggggtccaggagccactccacatatcattcgtaaatgttattgctaatggagagagggatgatggtgggggcaggcgtatttgtgttcatagaggaaggtaggactgtaatctccatgcctagtttctgattggcattgataatataaccatctttcagagagtcagctccaagaggtaactgggaaacatctcagttttgctccgggcactatttcctttgccatctataccagaagctgtggtgaatgggaaagcyattgctttctgaagtgcccttaggcctttctcagtgactcttaagttttaagaatcatttgggtgagcataatgctgaaatcctgtagctatgaaagctgcactgccatggcaataaaactccccattgaataagtaaaatggcaatttccaggaatctgggtggtagttatttcaatcaagttgagaaatgggatcaccgagagggggatttccgcagaatctgggctgtcagggaaatctttaggytgtcagggaaatctttattccccattgtcttctccttacaaattccaggagaggagtatgaggttatatttgtgtcctcagtaagcccataaaggtcagccagtgtgctaccttacattgtaattttccttttcaacattctttttttttttttttttggttaaattttactttaagttctgggatacatgtgcagaatgtgcaggtttgttacataggtatacatgtgccatggtggttttcattcgtttatgtactgaacataatcttagtacctcacagacagtgcacatgtactaacacctttcctgaaaccttaaaatataagaaatatagaaatacaggtagtttgtaartctttgctcttggggaagccaattttggatttcctttgtctttttgtcctatcatactccttgaaaggggtagtaaaagcatttttctctttttccytctctgtagttcaccccagtggggcacatagttgctggattcagcaacgttctttcccaaatgattcttaaggcatgcgggtcactgaggtttatttttaaatccataacccagggttcagcagttgtccttactgaattcccgtgtggaggctttcagctgcccagacacccccacrtctttactgggcacattccagcagtcctaaagtcctgaccctcaggagtgaaattctggtctggtgtctcactcctggaattccttcatgaggcatggctatggcatgaatcaggtgtcagattggaaagccaagagatcaggtggcttgtgatcataatataaaaaatttctaactggtaaaatggttttggagacttaatgcgtattgaaagtttctttctgctttattgtcagccttagccgcctcttgatggtctctttagttcctttcctggattgtctaggagcatgctggaggcagtcagaacataaggagttaaattgcagtgaacttatggagaatgattaaacagtgattaagtgatattttaacttctgtttacaggggagaaatggatgtcatcaggaaaagggtttgtttgcagttttgactgaagtcatcttatcttagccagggctgcctgcccttattcaatttcatttttagctgcaaggtgaactcccccacacacttattttctgatgtccatctttgtctttgctcatattccaccccttcctttctttccccagaccccgtgttgctctaggaaaacttgctccactcagaacagagttggggtgggacttagctgcccttctgcatcttctgtttctggaagtctttgggatgaaccatacatgggagagtcaggatactggaatgccattgaactagtggaaaaagcactagataggcaattgaagaggcctgggtttgaattccagctctgctacttattagctatgtgatcttggacaaattacttaatctctgtaagtcttagtttcctgttctgtaaaatggaggtgataatttctacctgaaagaataggaattagagaggattagagttatatatgtaaagagcattgcctgacacacacacagtaggcattcaattatgtgtgatcaaagaggtcagagttgatggtagaatttagactgtctcggttagccttttgcctgtttttcccagtgctaattgtatagtttatatattatagtttaaagttatgctgccaggcgcggtggctcatgtctgtaatcccagccctttgggaggccgaggcaggtggatcacttgaggtcaggagttcgagaccagcctggccaacatggtgaaaccccgtctctactaaaaatacaaaaattagccaggtgtggtggcacacacttgtaatcccagctactcacgaggctgaggcaggagaatcacttgaacctgggaggtggaggttacagtgagctgagatcacaccactgcacttctgcttgggtgacagagcaagactctgtttcaaaaatgaaattttaaaaaaatgaagttatgctctcctttgcttttattacagtctagtaaggagcttggagggcttttagacccccataatctccatcaccctcctcaaagctgctctaaataaacaaatttaagtaaaaagtatttgttatataaatgcaggatgaagacttattatgatggcttttcctctttcaaccagattgcaagatacaagcctatttttaataaaatttctggttccctactctggtactaatgcaaagatttatttttcttagggatgagttgtggccaattgatataaaaggagatataggccaggcatggtggctcgtatctgtaatcccagcactttgggaggctgaggcaggtggatcacttggggtcaggagttcaaggccagcctggccaacatggtgaaaccccatctctactaaaaatacaaaaattagcagggcgtggtggctcatgcctgtaattccagctaccggggaggctgagacaggagaatcgcttgaatctgggaggcagaggtttcagtgagccgagattgcgccactagactccagcctgggcaacagagcgatactccacctcacacgcacacacacaaagaagatgtactttcttcttttgatacttttttacatatttgacgcatttgtgatagagaaatggattatgattattctatccttcttccttttactaaggtagaatgagccaaggtcagtggggcctgacggatctcagggcctttgctgttcctctcatccctggctatggttggctaagtctctttttcttaggtctcagggtgttcagctgttttgggaacttgttgaaaattgttgytttgcagtacaaaagacactctgttactttttaatcaatatctttttttttgagacagggtctggctctgttgcccaggctcgactacagtagcccatctctgttcactgcagcctctgcctcccgggttcaagtgattcttgtgccacagcctcctgagcagctgggactacaggcgcgtgctaccatgcccagctaatatttttgtatttttagtagagatgggattttgccaygttgtccaggctggcttcgaactcctggcctcaagcggtacacccgccttggccttccaaagtgctgggattataggcgtgagccactgcgctgggccagtaatcagtatctttttagcatattacttattttggggggatcctccaaatcaggggtctccagtgtgctaaatatttgatagagcatagggaaatttgagtattttagtttccgagtattagtaaagagtggctcacattgccttttactttatacrttcatgcattggaagacttaatattgttaagatggcagcactccccaaactgatctatagattcaatgcaatccctgtcagaatcccagtggggttttttcttcttctttcttctcctcctcctcctcttcctcttattcttygtcttcctcttcctcctcctcctcttcttccagaaattggcaagctgctcctgaaattcatgtgaaaatgcaagggacccagaatagtcaaaacaatcttgaaaaagaacaaaattggaggactcacacttccagatttgaaaacttactacaaagctacagtaattaagacaggatggtactggcatagggatagacatatagatcaatggaatagaattgagagtctaaaaataaacccttacatttatggtaaattgatttgtgataaaggtgccaagacaattcaatgtagaaagaattgtcttttcaacaaattatactgggacaactggatatccatatacaaaagaatgaaattggccaggcgttgtggctcacgcccataatcccagcactttagcaggcagaggtaggtggatcacgagatcaggagttcgagaccagcctggccaacattgtgaaaccccatttctactaaaaatacaaaaattagctggatgtggtggcgggcrcctgtaatcccagctactcgggaggctgaggcaggagaatcgcttgaacccgggaggcagaggttgcagtgagctgagatgaygccattgcactccagcctgggcaacagagcaagactccaccttaaaaaaaaaaaaaaaaagaatttaaaccctgacctcacacaacatataaaacttaactcaaagtggaacatagacctacatataagagctaaaattacaaaactattagaagaaaacttaggggtaaatctttgtgaccttggattaggtagtggtttcttgtagctaacactgaaagtatacacaaaaaagaaaaaaatagagaaattatacttgatcaaaatgtaaaacctttgtgcttcaaaggacactacctagaaatgaagacacctcacagaatgggagaaaatatttgcaaatcatatatctaataagggacttatatccaaaatatataaagaattctttgaactcaacagtaaaaagaaaacccaataaaaaaatgggcaaaggatttatatagccatttcttcaaagaagatatacaaatggctaataagcacatgaaaagatgcttagatgcttaacatcattagttattatggaaatgctaatcaagatcacaatgagataccacttcatacccactagaatggctttaataaaaaagagagtgaggatgtggagaaattggaacacccccaacattgctggtgggaatataaaatggtgcacytgctttagaaaacagtttggtggttcttcaaaaagtagagttgccacatgacccagcaattccaaagtatatatccaaaagaaatattatattcatagaatatagaaaacatatattcatagaaaactcgtacataaatgttcatagcagcattattcatagtagccccaaagcagaaacagctgaaacatctatcaactgatgaatggataaacacactgtggcatatccatacaacagaatattatttgtcagtgaaaaggaatgaagtactgattgatgctaacatggatcaaccttgagaacattagactaagtgaaagaagccagacacaaaaggcttgtatgattccatttataccatttatacataataggcaaatccatagagaccataagtagattagtggttgctaggggttgaggaggggcgaatgggaagtgactgctaattgatatagggtttcttcagggggtgatggaatgttctaaagttagataatggtgatggttgaacaactctgtgaacatactgatacttaaatatccattgaattgtttacctaaaaagggtgaatttatgttaaccaaatctcagtgaagctgttataaaaatattaggctgatttgtaggtatgaatagtatttgtctgtttgtattgggccccttattgctgccactgagaatcttgaagttgtcttgaatattttgcttcagaactgtcactgtcttgagcaggcaagttactgttgccccaaatcttcaaggtgagaaacaggtttgcaatcatttttttgcaggagaatacatgatggcactttatatcaggaagcgaacttttaaggtgagcactctgaagttgaagcatttccaagttttaagtgggactgtgccctaccttagttcttacttcatcctttaaactgtgtgtcacactggagtaggcagtttcccagccccatacccagctccaccaagatcctcacttctttcatcatttgcccatttttccccaggctatgtttgatcttgctctgaggccttctttcttgggaggtatarcgagagtagctgcagaaacctctgggtggcaccctgcccccacaggattaccaaagaatgacatgtgtggaagaggctcaggcctgtgttggcaggaagaagtgactcatttttcatcaaaggaatttcaaagaacatataatgacaggatgatgtcacaggagcaggtggagacaggaaccttgattgagctgctggaagatattaaatggtgtggctgcctgggcagtcagaatgattgaccagcataaatcacaggaaacatcrcctgttttttagttcctatttcatgagcsctggtgtgggcagtgctgttcatgtgccctcagagcatatggttgagtctatgcatgtcttgggtatactgtgtttgtatctgggtgagatggctcacaacatcctgtgctagtcatggacttctttttcatgcagggcggcgtgtgtgggttcctgcactgtgtgcctcagttctatagctagcagggtctgtgtcttggaaatgagcctcacatggtcatactggctggtttgaaggcatgacatttcctctgacatatttagagaggggaacttgccttgacatcagaaggtcagatctcagaattttttaccttattgccaaaagtaccctagttccatctagtattttggcaagagctagatctttgctcaaagcccagttaagtcttgtggtggtggtgtttttcttctttgagtagagggccctccaatggtgttgtatggttgaagctgataaggtgaggcggagtgtggtggcgggatggagagtttcagtcaggataagtcttagtatcttttcatatcgcaaagcagtaaagttggttaggttattcaggctgttatttatattaagattgtgaaagagtgctcctggtcatcatcatgcacctaccagagtctgtgtgattatgaggttggaggctaaattagccatttacacaaagataaaagagaggctagcattgataatattctgcctcaggtttcaggcctctcaaggaaggtcttaggagagatggcttagcaatatcaattgctgcctttgtgcttataactcgttcatctgaagatggcctggaaaaagggacttttaggctgcataggacaccaccaaaaaagtagaagatactacctctctttaagatgtatcagggctggtgctgggcgtggtggcacacgcctgtaatcccagcactttgggaggccgaggcaggtggatcacgaggtcaggagatcgagaccatcctggctaacacggtgaaaccccatctctactaaaaatacaaaaaaattagctgggcgtggtggcgggtgcctgtagtcccagctacacgggaggctgaggcaggagaatggcatgtacctgggwggtggagcttgcagtgagccgacatggcaccactgcactccagcctgggcgacagagcgagactccgtctcaaaaaaaaaaaaacaaaaaaggaaaaagaaaagaaaaagatatatcagaagagctgggcatggtagctcacacctgtagttctagctactcgggaggctaaggcaggaggattgcttgagcccaggagttcaaggctatagaatagtgccatgattgtgcctgtgtagtcactgtactccagcctggacagcatagaggcccagtttctttaaaaaaaaaaattttttttttaaataaacccaagatatatcagaagcaagaaggaaaagttaaaaaacaacaactataatttgaaagggaggaaggaaagctttatttatttcttgacacagtctttaattgttasgttcttctggctgatcatgagttttgtttttagacaatattactaggtacactgtaggatgtaaacagatctttggagtaggataagaaggaaatgagtcagataacttacttcttagagaagggtgctggactttccgggggcttagttagcaatattcctcctccctgctagcagccatctccctgtatctcttcatgaaataacaaatcattagaagagatttttaacctgaagtgctgaaggacccagggaagaaagttccctagggtgtatttgatttgggagccccctgagggtaatctgtggtgatgctgtttcagaagtcaccacctgactcrttgtcagatgagtctgagcccaagactcgtacctgccacataatatatacaggtcctctctccctttggttatgagctaaaggcctttaatcatgaggtagaggagtggataagggagaaatatctgaaacccaattaaccagattccagaatgttaagggaatccatgtgggggctgggattctgaacatctctctctctctctctctctctctctctctctgtgtgtgtatgtgtgtgtgtgtgtgtgtgtgtgttttggtggggggtgaaatgacttttttttttttttaattkgagacagagtctcactctgtcaccaggctggagtgccgtggcatgctcggctcactgcaaccaccaactccctggttcaaatgattctcctgcctcagcctcccgagtagctgggattacaggcacgcgccaccacgcccggcctagaaatgacttttttaggggctcacctataggataaaatccaaactcatcttgtcatttaagatctttcataatccagtccaactttctataacattaaatcaaaattatacatgttcttactttaaaaggttaaaatattactataaggcatatgacaaaaataatctgtattttccactatttttttttaagagacagggtctcactcttccacccaggctggagtgcagtggtgtgatcatggctcactgcacccttgaactcctgggctcaagggatcttcccacctcagcttcctgagtagcttagactataggtgtgyaccactgcgcctggctaatttttttttctttttgtagagttgggggtcttgttttgttctccaggctagtctcaaactcctggcctcaaatgatgctcctaccttggcctcccagagtgctgggattgcaggtgtgggcccccacacctgggccacatttctgtttcttttttttctgcacacacaaacagccagaatatatttctttctcttttactagtgattcttgatttttttttttttttggttttgaacattatctgttgatattctactacagaaaattagggtttagtttttttattcttacccccttaacgtacacactttctcttmccccttcttcccaaagtcacacgttattgccgttatattcagtgttcagattattgtgattatataaatattgcttaaaggtgagctatgtaatatactatgattacatttcctttttggaccaacttttaatttttcctggaattaataattgccatattttgtcacttgtttactgatctatgtacataccttcagactctctcatgggactctaagacttctctctcagtatgttgaaacatatcaaataatcttttagttcaatagtctatttggagacatcccccaggagctttctcttattcactctggatgggttgctcttaaagcctttagtaaagctgtcatcctggcacttcccttcactatcatacggggaaattccctcacctgtcttccctgttggatttcatgtttcccagagctgatgtcgtatttcatgatgtactccattttttcattgtggtatatcctagcttcctgagaaaggatacaagggaggtaaatgtttttgagactttgcttatctgaaaatgtcttattctacttttcatttgattaagagtttgagtatagagttctaggttgcaaatcactttctagcagattttttaaaaaattatttaaaatttttttgtagaaatgagatctcgctatgttgcccaagctggcctcaaactcctggcttcaagcaattgtctggctaatactgccttttaagtctctctaaggatattaattagaggctgtctttctctctctctctctctgtctctctctctctctgtctctctctctctctstctcctctctccttccttccttccttctttcccctttcccttcccttcccttcccttccctcccctcctctcccctcctctcccctcccctcccctccccttcccttccctttcttttcttttttcctctgcatccagcattgtctctgtttcttctgagctccttctatttattttggtctctgtctttcatgttagaagttctcttaaaatgtctgatgtttcttggtgatcttcacatttaagacttgggccctggccaggcacagtggctcacacctataatcccagcactttgggaggccgaggcaggtggattgcttgagcccaggagttcaagactagcctgggcaaccccatctgtacaaaaaattacaaaaatgagctggatgtggtggcgcatggaggctgaggtgggcagatygcttgagccccggaggttgaagctgtagtaagctgagactgcgccactacactccagcttgggcaacagagtgagaccctgtctccaaaaataaaaaaagaaagagctgggccctaaaatgctgattggtgggactcgttaactggtatactcctaatgaataaccaggtagaggaggttggtttccccaggaaagactggccagtctcccatctgggggccaattctggtagctagagctctgggccaagtggagcaattggccagtctggaagggcctcatcgttcattgtcaaagtttattgattgattgattgattgattgagacggagtctcaccctgtcactcaggctggagtgcaacctctgcctcccaggttcaagcaattctcctgccacagcctcccaagtagctgggattacaggtgtttgccaccatgcctggctaattttgtatttttagtagaggcggggtttcaccatgttggccaggctggtctcgaactcctgagctcaggtgatccacctgtttctgcctcccaaagtactaggattacaggtgcgtgccaccacacccagctaattttgtatttttagtagaggcggggtttcaccatgttggccaggctggtctcgaactcttgagctcaggtgatccacctgcttcrgcctcccaaagtgttaggattataggcgtgagccaycatgcccggcccattgtcagatttcatttaatatccctgttttcactgagacacctggctcctgacctcacacgggcctgaagacttccaaccaatcttgttttcagccttactctgcagcatgccttctcctaccaagtcttcagaggttcctggtgcttccaatttctgagcctttctgggattctgcagtacaatttaccttgtttcttattgttgcccatttcctgcaggcacttagcagagagaaagaaagctgacatttaagttttcgaccatttgtttatccacactccagtgtatcaaacttttgttgctatttcttattcttattttctgtgggtttgtgccattttaattctcttactgtcacttttctgaggtttctgaaagggagctaaatgtgcttattaaatttgtgatggataccccaaagttggcagaagttaatcttcccaatttacttacctctctctgagcctcctcaaccccaacccaaatacacaaaccctgtggttcattctagtgtcacttgtactttctgtttttcattctcttcctcatgctatctctcctcctggagtgtttactcttcttatttcagactgttgaaatcctatacattcttctagtcccaggttatatttcttatctatggaagccttttttttgacttccccaacaggaaatgaccatttcattgactgaatttctgaagttccattcactgagttcttatagtcttgccctcctgacacagcctgtactgctttatgttaagactatctgtatacatatttctccagttagattgtaagctcttaaaggatagtagcataagactggctttgtaattttttttgttattgataacaatcaacatagtacctaggcaactaaatatttcacagaaccacagaattttagagctggaaaagaatttagagatctagaatgtgaactcattttatgaatgrgtaaacmgatccagtgtagttaaacgatcctgaagtcatttaataagccaagaacagaactggacctataatcgtctctagttctgtaatgtctaaatgcattgataaaatctgatatgtgcttatttagatattctggtttatcaaaggttaaccagagagtgctttttgtttcattcttgttgaaaatttttgtcaatatctttttggttttagtaattaggtatgccataggtaatttcttttcttttctccctccttcgctgcctctctctcttctttctttcttttttcctcccctccccgcccctctcctctctcttcctttctcttttcttgtcttttctttctttctttctcttcttttstgtgtgtgtgtgtgtgtgtgtttgttttttttttttttttttttttttttgayggaatcttgctttgtcacccaggttgaagtgtagtggcgtgagtagctgggactacagatgtgcatccccacacccagctaacttattgtattttttcataacaacagggttttgccatgttgcccagggtggtctcgaactcctgggctcaagaaatctgccctctcggcctcccaaagtactgcgattacagacgtgagccaccgccttgtgctgtctctctttttctctttctctctctttttgataaaaatcaggatcttgagtattctggattttgtcaaaaactgagctggaggtggtgcggtggcctgtaattccagcactttgggaggccgaggcaggtggatcacttgaggccaggagtttgagactgggttggccaacatggcgaaaccccgtctctactaaaaatacaaaaattagccgggcgtggtggtgtgcctgtaatcccagctacttgggaggctgaggcacgagaatcgcttgaacctgggaggtggagtttgcaktgagctgagatcgcaccactgcactccagcctgagtgacagagtgagactgtgtctcaaaaacaaacaaacaaaaaaaccccaaaacaacaacaacaaaaactaagctggataatagttttcttcccaggcatatatgagcatcagagacccaaggattataggtagggaaaaaatgtaggcaactgtattgaaggtgctctgatttttaagaaaattttaaaaattcactggatatgatgtatttggggtgattctttctttcttttttttttttttttttaacctagcagtaaagtacaggcccagttgggtcctacttaaagttttcctgtttgacaatttatcaggaattattattgcttaagatagctttgaagtaaattgtctgtgtcaaagaccttcctccacttctctcacttacctagctcttggcagctgtttccaaaatgtttgcactaactccatagattcatgtctgaaggattagatactccaggaacatctattgggagaaagtttaactacaactgttgtccatttttcaattaatgtgccagtcactaatcaaaaaaacagatgctgtcgttttcctcatccactacttgggacacctaaggatggatggacagatacttaagaggctgcctccttcttctgagattgggcttttcatcagggctgtgccacagggtgtgatgctgtgtgatagcagatggctctgcttcatgcccattactttttgttttatccaaagyagaagctgtggtccccagattttagagagtaagggcttaatcatactcattggcttttctgcctttgcctgtttctgcattgccacctggctgccattagagggaattcattacaactctgagtccctgcagggagctgagaggagctatccttgtgtttaggatgggacatgtgttcttaaaactgggccaggcacggtggctcccagcactttgggaggccgaagcaggtggatcacttgaggccaggagttcgagaccagcctggccaacatggtgaaactccgtttctattaaacatacaaaaattagctgggtgtggtggtgtatgcctgtaatcccagctactcaggagactgaggcacaagaattgcttgaacctgggaagtggagattgcagtgagccgatatctcaccactgcactccagcctgggcgacacagcaagactctgtctcaaaaaaagaaaaaaacaaaaaacttaaaaatggttacccagatttccttttatgacttgttcagtcagaggcagctgggaggatgcacgctggggaaagcattactcaccaggcacacatagtggccctgactgctggcaagtagtctgggctgtgttaagagtgagtcacctcggggaatggaaaaattgcaaggtactgaggggtaggagttgtgtgccagtgactgctccttttctgtctgctattttctctataaggactcatcacaaaaccataaatactgacgatcctgttgaggcagccgtgaagccaaccaactttatggtgataatgtttcccataaaaggaatgagctgactggacatagcattgttgccttctatgttacaggtgtatatagattttgacacaagcttgaacttgtataatgaaagttccatgtgtgagaatttcatcagaataaaagcaacacagttttctttgttgtttaaaaactyagtcttctgtgtctatctatctttgtccagtaggggtcactgagggttaggctctcaataagagaaacactaatctagtgataaatgagctggattccttgtctattgtgacatctttgtatattcagtactatgttttttaaaatattagagcagaaacaaaaggcgtgaacttgtattaagaactttatgggcgaagcgcagtggctcatgcctgtaacccgaggcgggtggatatcacctgaggtcaggagttcgagaccagcctggccaacatggtgaaaccccgtctctaccaaaaatacaaaaaaattagacgggcatggtggcgcatgcctgtaatcccagctacttgggaggctgaggcaggagaattgcttaaacccgggaggcagaggttgcagtgaaccgagattgtgccattgcactacagtctgggcaacaagagtgaaattccatctcaaaaattaaaaaaaaaaagaatatttctggacaaaaataacaatcctgggcaagattctggaacagtccccatagacagggcttcttttcttcgtatcatttttttctccatttctttaagatgttggctaccagagtttcctggaaaaagcttactagatagatattatttcattggggaaaagggtcaaaatkccagagagagagattacttaaaatggtaatatggctgttgaggttgactagatattcttgtcctttccctttttgaagcaatgctgtcgaagcctaatttgacttagtcattgagctgttcaataccacacattactttcacttaccttcttgcatttgccactgaggatgacttgatgccctgctaggaggtctcttgtgtggtaatcataataacaagagttggcattaatgagtcaatgtttaatgctttttaaatagttaatgcttactgtgtgccaaatatattatgcattttctcacttaatcctcactgtaacactgtgaagaggtaattttattatccctttttgacatgagataactatggattaaagagattaagtaattggttcatagatacacaactagagattgtgaaatcagaatttgaatataggtttggctcacaaattatatttacagccctggtaagagagagagggagagagagagagagagaggcaggcacttgggtttaagagtgagttttcttttttctttttttctttttttgagacagtttcgctgttgttgcccaggctggggtgcagtggcatgatctcagctcactgcaacctccacttcctgggttcaggcaattctcttgcctcagcctcccaagtagctgggattacaggcactcctgggtaattttgtatttttaatagagatggggtttcaccatattggtcaggctggtctcgaactcctgacctcaggtgatccaaccacctcgtcctcccaaagtgctgggattacaggcatgcgccaccacacctggccaagagtgagttttctaagtgctgtaccagagcatctctcactttattttctgcccctcctctttagtgttactttcccttttctttcttaagggtaagaccttcagttgctgagcttgataggaaggccatctagagttagatcctgggcagaatccatatccggagggatttccagaagtggaatttcttttcttttcttttcttttcttttttttttttttttttttgtgatagagtcttgttctgtttcccaagctggagtgcagtggcgcgatctcagctcactgcagcctccacctcccgggctcaagggattcttctgactcagcctcccaggtagctgagactacaggcacatgccaccatgcccggctaatttttgtaattttagtagagacgggtggccaggctggtcttgaactcctgaccttaggtgatccaccccgcctcagccttttaatgtgctgggattacaggcgtgagccaccatgcccagccaaaagtggaatttctttctccctgccttcctctcccctcccctcccctcccctcccctcccttcccttctctattgtcttgctctgctgtctaggctggagtgcagtggtgtgatcatagctcactgtggcctgaaactcctgggctggagtgattctcctgcctcagcctcccaagtagctagaactacaggtgtgtaaccactgggcctggctaagtgttattatgttttggagagatggggtcttgctatgttgcccagggtggtcttaaactcctgtcctcaggcagtcctcctgcctcagcttctcaaagcrctgggattacaggggtgagccactgctcccagccaagcagtttaatttctgaattaataaactatcttccttccagctccaaggaaaagcaaaacttacacttgtgttcttggagacacttttttsttttaaattcccaggtagatttggaagttcactgttaaagrtggttcgacacccttgttagtgtatgttacctactaggcctctctagargagcattttgagttatttctgccataagatgaatggttttccaggcacttgttctcggttgtatgtttttgtggtcaaaaaagatgcattaccagaagaaatgtttatattttgggagtattcataattcactgggcccagctttgccctttctagtgtgcacccgcccccattcttgctcttaagcagttctcagatcctctcattcatttattaatttgctcattccacaaatagttatttagtgactaagattttataaaggagagcagacatttatctagcttcaaaaacagtctagtgagggagtaacaatatgtgctcagctgtattataaagcacaaagtgctaaactttatgagagaaacagataaagtataataaaagctcaagggagggagaagtttacttctcactgggatggagggaggaactggagataattctgtggaagtactggctttaagctggtctatagaaataggagtttaatatctggagatgggaaggaaaaacgtgccaggataatgagggaaatattgtgaagccagagagttttggatttaatttgctgatagggagaaatgtaaagttttacagtgaagttataaataaacatttattaagcatttaaaatgtgccaatcattatacatgcttcaaggagattactgttgtggtgaacgagggcagggttggtaagttggagactgagattagacagattaggtaatttaggtgaggtawgttatcagttgccaaggtttcgtacagtctgagcaatattcatagtctttgtggtcagatgtagtttgtttgctgctcctccaaataatgacaattataatcagcaattattgagcaggtattgagcacctgaaacacattaactcattcatccttactacaactctgagacagatgctattattatcatcattttacagatgaggaaattgaggttccatgaagttaagtaacttgcccaaagatgctaaatgtgatgtatacatagtagtatggatttaaacccaggcagactgggcttataatttccatgctactataatactcatggcatctatgtatacggagcaataaatatggagattttccttactttattgtattcaatgacacttttgtatgtagaatgttctttgtagacattctgggcctttgcaagttgtctcaataccacattgccaaaccttagaggcagagtcatggatgtctcctaattaagttatctgaagcccacatcctctgcctgtcttcagttagatgcctagtgtactcatgggaggggacagatgacaagagtttcagggccaggctttgatgtctgcatcgtgccatttccagaaacccaaggttttcagtcctatcggttatgtgctattccctctaccaaatttataatcttaggtatatttattgtattttttaaaagacttctctctttgtaagcattatttttctagatttggcttttttagttacggtgtaacgtaaatttttagtctgaatctgctaaagttatgatgcttgtggatatcaattattttgagaccaagtaaatctcaatgacatttgaataaaatgtccagcatacctttgcacaggcttgttttgcttgcaaacattaaagtaattctggggtgttgccttgtgttgagatttcttgtgggtaacagttaggggagaccatcccaaattcctgtgggtaatcccaaagagaggcagatctaaaatcttaatgaagttctgagtctgtcttctacaaggcttctttcatggtttggggycctgcccgttggctgttagtaagggatatcctggggggtgctaaatgtgactttaaaaagactgttctttgtatgataaatgatctcttaaaaagaaaactagtcactccctcctgccagcctctaaccacttcctgtaaatgacagcacacagatcttagtttcaccaagtgaaaaaattattttattttcatgaaagcagttcccctctgcttcttccttccaacatacatatatataataaatataaatataaatatatacacacacacacacacaagctgcagataggcaggctttttacctgtaatatcaaggtataaaatgacatgtttttatgatcttatgagaataaattactttggttatctttcattgtcttctctaataataaatgtaggttcagaacatatcttggtatttgagtactttggattttttcccccaaatttcctaggtgtttttgaatgacacaaacatggtatatgattttctaattactgatgccagaagctcctataacagctttatgatggcttcaggtagcaaatagggcagggaaatggctttcactttgggaaacgaaaatatggtgaaggtatttgtaagactgtgaaaagacggttgtggtggctcatgcctgtaatcccagcactttgggaggcagaggcgggagggtcactcttaaggccaggagtttgagaccagcctggactacatagtgagaccccatcttcaaaaaaaattaaaaaattatagccagcatggtgatgcatgtttatagtcccagctcctcaggaggctaaaccaggaggattgcttgagcctaggagttcaaggctgtagtgagctatgatcacaccactgcattctggcctgggcgacagagcgagaccatgtttcgaaaaagatggttgagaaatggtggacagatgccaagtggagtggctcatgtctataatccctgcactttggtaggctgaggcaggcagatcacttgagcccaggagttcgagaccagcctgggaaacatggcaaaaccccatctctgcaaaaaacacaaaaattagccagacgtggtggcacatgcctgtagtcccagctactcgggaggcagaggtgggaggattacttgagcccggtagtttgaggctgcagcgagctatgattgtgccactgcattccagcttggactacagagtaagaccctgtctcaagaaayggtgatagaaacagcactagcaggctgggcgcggtggctcatgcctataatcccagcagtttgggaggcccaggcggatggatcacctgaggtcaggagttggagaccagcctggccaacatggtgaaactctgactctactaaaaatacaaaaattagctgggcgtgccgggcgcggtggctcactcctgtaatcccagcactttgggaggctgaggcgggtggatcatgaggtcaggagttcgagaccagmctaaccaatgtgatgaaaccccgtctctactaaaaatacaaaaattagccgggtgtggtggtgtgtgcctgtaatcccagctactcaggaggctgaggcaggagaattgcttggagccgggagacggaggttgcastgagctgagatcacgccattgcactccagcctaggcaacagagcaagagcgaaactccgtctcaaaaaaaaaaaaaaaaaaattagctgggcgtggtggcacacacctgtagtcacagctactggggaggctgaggcaggagaattgcttgaacccaggagatagaggttgcagagatcggagcatcactgcactctccagcctaggcaacagagcaagactctgtctcaagaaagaaataaaagggaagaaacagcactagcaattaatatatactgttgttgagattcttttcttaaagccaggtggaactattatataaataagtcttgtaacgaggaagtataaacacctcaagttgcttaccctaaagttagtgtacttattttgacagaatttttttcttttttgagatgragtctcgctctgtcgcccaggctggagtgcagtggcgcgatctcggctcactgcaagctctgcctaccaggttcacaccattctcctgcctcagcctcccaagtagctgggactacaggcgcccaccaccacggctggctaattttttgtatttttagtagagatggggtttcacygtgttagccaggatggtctcgatctcctgacctcatgatccgcccgcctcggcctcccaaagtgytgggattacaggcgtgagccactgtgcctggcctgttgtgacagaattttttaacaaagggataaaatatatttatttggaatcaggcataataaaagttcagacatgggccagacacagtggctcacgcctgtaatcccaacattttgggaggcctaggcaggaggattgcttgattccatgagtttgagaccaacctgggctgtaacatagtaagatcctgtctctacagaaaaaaagacagaaaaagctcaggtgtcagctcatcctctttcttggatgaccttggcaaaataacttgaatttctggagcctcaagtgcttgatttataaaatgrggtaataatatatagttcccagggatattacagggatcaaatgaaataacagatgtaaagatgctttatagtagctgcttaataaattttagtttcccttccaagcaagtccatcttcttcgaccatcacagcccaggagcttcttcacttctccacagcaaggggtgtgtcatagtcatcttggtgtccatggtatctggcacaatgctctgcatcttttaatgaaatgaatgaagtgctttgtttcagaagagagggagctccagcttagtctccactggactatgtcatcaatttttcctttctaattcttattcccttcagcaaacactattacatttcacatatcaagaattctctattgaccctacattgctctctctgctcctgtttacagcaaagttccttgaaggagttgtttttccctgtccttgattattcttctcccattcattagttcttgaatcgctccagtcaggctttttctctaccatgccatcaaaactgcacttgttagagtcaccagtgacctccagaatgctaaattcaatggtcagttctcaatcctcaacttgacatattaatagctcttgcatggttaattgctactttttagaacgctttcacctggcttctgggatagcttactcttttgggtctccctctaatccactgaatcctcttttttagccccttttggttgttcttgctcttccctagataatgttgaaaggcttccaggacttagtccttgaacttgatctcttctctatgtttactcactaaataatgccatctagtctcctggctttaaaattccagcctgggccaggcacagtggctcacacctgtaatcccagcactttgggaggccgaggcaggtggatcacctgagatcaggagttcgagaccagcctgcccaacatggcaaaaccgtgtctctactaaaaatacaaaaattagccgggcgtggtggtgggyacctgtaatcccagcttcttgggaggctgaggcaggagaatcacttgaacccggtaggtggaggttgcagtgagccaagatagtgccactgcactgcagcttgggtgacagagctagactccatctcagagaaaaaaaaaaaaagaaaaaaattccaggccaggtctctccctgaactctagattcatatattcaattgtctattcaaagttccacttgaggggtgggcatggtggctcaagcctgtaatcccagcactttaggaggccaaggaaggaggatcacatgaggccaggagtttgagaccagcctgggcaacatggcgaaacccggtttctaccaaaagaaacaacaaggaagtttcacttgaatgtctttaggcatttcaaacctaatgttattcaaaaggacatttctaccctgcccccccaaaaaacagacagccacagccaccaatgaatcccaaaccctctgcatctctggtatcagtcttccccatctcaggaaatagcagttctatcctttcaatttctcaggccaacattttggagttattttttattctttccctgctcattccacaaccaatctataagcaaatccagatgattccttctttgtaattacagaatttgaacacatcttaccacctctgtggccacactctggctctacccatcattttgtagccaccaattttcacttgaattattatactggcattatagctggtttccctgtacccactcttatctctcagtagtatgatctcaacataggaacaagaatgatccttttttttttgagatagagtttcgttctgtcacccaggctggagtggcgcgattttggctcactgcaacctccgcctcctggattcaagcgattcttctgcctcagcctcctgagtagctgggactacaggcgcgtgccaccacgcccggcttatttttagtatttttagtagagacggggtttcactgtgttagtcaggatggtctcgatctcttgacctcatgatccacctgcctcggcctcccaaagtgctgggattacaggcgtgattcaccgygccaggctgagcaatccttttaaaacctaagttaaatcgtgttactgtctcacacaaagccctccaatggcttcccgtttcacctagaataaaagccaaaggctttacaatgatctgtacagccataggtgatctgacctcgtctctggcctcctcttctgatactctttcctttcctctttcaggtccagccattctaggttctttggtgttccctgaacataagaaacgtaattctgcctcagggactttgcacttgttctttggcttatccattctccagatagccacatgacttgtttgctcatattctttttttttttttttttttttttttttttgagatgcactctcactctgtctcccaggctggagtgcagtggcgcaatctcggctcactgcaagctctgcctcccgggttcaaaccattctcctgcctcagcctcccaagtagctgggattacaggcgaccatcaccacgcccagctaagtttttgtaattttagtagagatggggtttcacggtgttagccatgatggtctcagtctcctgacctcatgatccacccgcctccgcctcccaaagtgctgggattacaggcgtgagccaccacgcccggcctcatattctttatctgctcagatgtcaccttattagacgagccttctctgaccatcctatatataaaaccgtaaacttggctaggtgctggccgggcgcagtggctcacacctgtaatcccagcactttgggaggccaaggcagttggatcacgaggtcaggagttcgagaccagcctggccaatgcggtgaaaccccatctctactaaaaatagaaaaattagctaggtgtagtggcacgtgcctgtagtcccagctgctcaggaggctgaggcaggagaatcgcttgaagccgggaggcacaggttgcagtgagccaagatcatgccactgcactccagcctgggcaacagagcaagrstctgtctcaaaaaaaaaaaaagtaaactwtcccccattgacattgacactccatctcctcttcgtctcctttagtattctccatagcatttatgtgacaagctatgtatttacctgtttatatttcttttctttcttctcctactagtatgtaagttctgtgagagcaaggtctttgttttgtttactgctattgtttctggtacctggaacatgacctggcacataatatgaagtaaatatttgatgaatgaaatgtaggttagcacaaaattgtagatgatcctattgccagatttaaaagttcccattgtattagtggtcccgtcaaggcccctttattatttttctgggtagtaggttatgcacatctaaaactctttccttttgcttcaacaagctctagaaaaaagcaaaaggaaaataaataaataaataaagatttcacatagaaaaaaaagtaaaacccttccctattattagaaaaaaataaacttgacagatatataaagcaattttcattttttaaagcttgtgagactatagcatcttcatctatatcatagtgtaataggtactttagaagtaagtaaacagggtctcactttgtctcaaataaaaaggctgtagtgcagtggcatgatcatggcttgctgcagccttgattcctgggctcaagccatcttcccacctcagcctccccagtagctgggactatacacacataccatctcatctggctaaattttaaaatttttttgtagaaatggggtcccactgtgttactcagtctggtcctgaactcctgggctcaagtgatcctcctgcctcagcctcctgaagtgcagggattacaagcatgagccactgcatctggcctgatttagtgagtttggacaaatgtatacagtcatggaaccaccaccacaatcaacaaaaggaacatttccatcctcttacagttattttgtgatccttttagtcaatttccttccctcattctcagcctcttccatttctagttgtatagttttgcttttctagaaagttatataaatggaatcatatggtatgtagccttttgtgtttggctttttttatgtagcataatagttttgagaatcatctgtgtcgtcgtatgtatcagtagttttattctattttattgcagaataggtagtccattatatggatgcacaatttgtttatacatttaccagttgatggacatttgggttgtttccagttttttatattatgaataatgctgctgcaaacattcatatacaggtctttgtgtggatatacgtttctctttttcttggatagatacctaggagtgagattgctgggtcctctggtctaaggccgggcacagtggcacatgcctgtaatcccagcacctttggaggcagaggcgggaggattgcttgaggtcaggagttcgagaccagcttggccaacatggtgaaaccccatctctactaaaaatataaaaattagctgggtgcggtggcatscacctgtaatcccagctactcaggaggctgaggcaggagaattgcttcaaccctagaggcggaggttgcagtgaactgatatcgtgccttccaaagtgctgggattacagccatgaaccactgcgcccagccagacggatttttttaacccttgagaagtaccccctaaatgagcagtttgctctcctcgctgatcttcatcacacctagatgtcaggtctgcttcatgggagcttgctctgtatgtatcctccctggactgatgttcaggctccttgcttctcctcccgggttgtgggtatggagggtttgccctctgacaactccagggtacttgtggtgctcatacatcctcatgtactttgctttctccccgcaagaggttccctaatgcttctgtgacttttttcttctggctacatcctgaagtctggccttgcaggcaggctgggaatggaaagttaagagtgtgacgtcctctgacaccctcccttcttgtagaagggtctgaggtttgtttatttaagctgagcagaggatgccaaagatagaggtttgagtcagcttgacactggcttaggcgctccttttcactctccttgttccttcttccctttcccctcccccgctggccagttgtttcctgggctttgtctgagatacactgtacagttttagtcccagtctactagcgcctgctgaaaaacagtcagaagtgagatggaggagaagctgccaggaagtttctgacaacactaagctccggcctctgcctctgctgatagtacaggacaacagtaacctcaggagaaaggcatccagaggcctgcgctgagcttgtggctaactcaagggaggagaaaggacgggcctggaaatgcccctcttagattcatcttatttaccaccaaccatctttattttgactcacgttcttggagttgctggtgttctatactggaagaggcatgccagaggtagagcaggtaactaactggtacccagttattctttaaatctactgtggggcttttgagggtggggtgaatgatggaggtcttcccagttgctttccttaaagggccagtacgtccttcagctggggtgctgtcagacttaagagtgtgtgtgtgtgagtataatgaagaagctggtctgccctggggccactttgggatgggggtggtgctcttttctgttctgtgagtctgtctggagagtgctggttagatgaggtgatgactgggctcaaaactgaagggaagtggctgctgtgctgacttagtctttcctcagagaactgagctctttctttctcaatctcagagtggtttcttggaaccttgtttttaactgaaaacatacagtaactcttttaccctcctccaggtatagatttgggttggagaagtttctgttaacttggtgtgttttggggtgagaaaaggcagaggaggaagggtcagtcagtggaaggggtcgtgcgatgtccttgccgaggggcatcctggaacactgggtgtctgtgttctctttgatatcattgatactgttcctacacagtttggctatgtgtatccaaatcatcttgttcaatgcaaggaagttaatccctctcttccctagggaatcaggctttgataattaaaaaaaaatttttttttgtaatggcamcagaaccctcattcttcccatattgctattagttatattctgttgacttctaaacactcagagcagggatcagccctgagtttggctgattctgagtctccatggttgaggattcatatggtctaacttttactggagtgtatacccttgggtctcattgccttcagtactctcattgtgatgggctcactaccttcaaacttaggtatgtagacactttttatagtgtatcttacaagttaaggtggggatttgatggcttattatttagctttctattaaaagttcacaaacgcctgacagaattagaattagattcaatcattccccagtgtcctttccagtamgtcccagaaaagcttttgactaaatattcagatcctagtgtgcatctatagcagcggaaacaaagacagacattttagaagtgtgtttgattgtgtggtggtgtttttaaaaaagccacctcaaagtggctttcctgtatttgaacttagaaagaaagagataggcaggcttaagttgtttggtcctatttactatttcacatgtaatgagaaaataaatacaatatcatttaggtagaggctgctgcttttctttccttgtgcattatggtaatgtcatttttaaacattaaataactaattagttgttaatatttttaaagtttatcttcagtataggactttaatggaacttaagagctatcactgtattttaagtgctttcttttttatgtttagaaatgttaatttcataaacagccataaagtaattgaaataaaaagatacattgtaaaagctttttatttctatgaaacaactttgattctaataccaaatagttatatcgggaatgtgctacgtttgctttatctgtaaaatgagagatgtcatttttcaattggaggctatggattccaaatcttccatggagttacttacgagattctgtacccattttattataattgcaattttaagatgcatttcatttatttaaaaatgtatttttaaaaataatatgtacactctaattacctgccagttggacatcacagaataaagtttttccaccatctctgtgtatatatttgtactattaataaatgtacacttgattaaaaacacaaagatcgcttcttctgatgtagtcttttttttttttttaattggagttacatacagtattgcagaacaaactatagcacataggtcttgtgcctaataatagtaataataatgattcaggcagagctcagttgtatgagctcaggtgttaactgaactattataatagtgaagtgggtaattaattcatctctatgtagtaatactgtattactggtttagtatgtgtaccagaagtttctgttcttttgtctcacttttctatttgtgtttacatattatgaggaatgttcatagttgtttttttctttctttctttctttctttyttttttttttttggagacggagttttgctcttgttatccaggctggagtacaatggagcacaatcctggctcaccgcaagctccgcctcccgggttcaagtgattctcctgcctcagtctcctgagtagctggtaatacaggcatgtgccaccacagccggctgattttgtatttttagtagagayggggtttctccatgttggtcaggctggtctcgaactcctgacctcaggtgatccacctgcctcggcctcccaaagtgctgggattataggtgtgagccaccgtgcctggctgaagaatgttcatagttttaaacactgaaggtaactggctttgaaacaaatatttgtgctattctttcaggctctcgtctcaatttatttgaataatgtcctgagattattaggcaaacagtgaagctgttattatttgtttctatttatttgtgtgaatcagttcttaaaaattgattcttgtctacggccataccaccccaaacatgcccaatatcatctaaaaattgattctctgcaataaaacacaacatagaaataaaccagatgctggctgggcgtggtggctcacacctgtaattccagcactttgggaggctgaggcaggtggatcacctgaggtcaggaattcgagaccagcctggtcaacatggtgaaaccccatctctactaaaaatacaaaaattagctggtgtgatggcaggtgcctgtaatcccagctactcgggaggctgaggcaggagaacagcttgaactcaggaggtggaggttgcagtgagctgcgatcacaccactgtattccagcctgggcagcagaatgagagtccgtctcaaaaaaaaaaaaaaagaaaagaaatataaaagggtttttttttttttaattaaatctactccgttcctgtttcactggttttatttcctatcttggccttataagcatccaggactccagcatcttttaaaaactcacagctctactaatggatgcttgtcctttagggtaagtagttaactgcctctggaaagccttccttgactgaaatacgagttcctattctgtgctgcagtagcaccctgttaacactacttattcaaacctgtattgtcatcttacttaacttgcccttctctccttactaattaaaaacagggactcttttttttttctttctgaaaccgagtctcactttgtcacccaggctggagtacagtggtacgatgttggttcactgcaaattctgccatccgggttcaagcgattctcatgactcaacctcccgagtagctgagactacaggcgcctgccaccacgcctgactaattttttatttatttatttttttgagacagagtcttgccctgtcgcccaggctggcgtgcagtggtgcaatctcagctcactgcaacccccgcctcccgggttcaagcgattctcctgcctcagcctcctgagtagctgggattacaggcgcacgccaccacaccctgctaatttttgtatttttagtagagacggggtttcatcatgttggtcaggctggtctcgaactcttgaccttgtaatctgcccacttctaccttccaaagtgctgggattacaggcgaaaacagggactattactcatctcagtatctgcagtgtctgaggcaaaacagatgtcagtaaatatggccgtgcgcagtggctcacacctgtaatcccagcactttgggaggctgaggcgggtggatcacctgaggtcaggagttcgagaccagcctgaccaacatggagaaaccctgtctctactaaaaaatacaaaattagcaggatgtagtggcacatacctgtaatcccagctactggggaggcggaggttgcagtgagccgagatctcaccattccactccagcctgggcaacaagagtgaaactccatctaaaaaaaaaaaaaatcagtaaatattaacttgaataaaaaattaaagatggcactagctgtaaactgtagcaggaaccatsccctgttcatttgtctattaagagggtttggttgagtttaatgtgtgatctaaggtaggatgctcagtataggttaattagatgatacagagttgccctgtgttttattttattaaatctcacattgtgatagtgtaaacaggaaaagagctttatggtttttttcctctctagggtcttgttttccttacctgtaaagtgaaggagttgrataatatgatcttttaaagttctctccgttttcagcatcccactaggaggaacagccataatccctggatccaaactatatgaaatacagtctaagattgtattccatcacctccccatcctgggttttttttatttaaagcagttccctttatcatactattgggttatattaaacctaagatcaattataaaatggccaaaccttgtacatgaattgttgttgtctcccttctagtcgctgctatgcccttggttttcttgaacttcagcataagacttataggtatcctagagccaggcatggtggttcacgcctgtaatcctagcactttgggaggtcaaggcatggggatcacttgaggtcaggaatttgagaccagcttggccaacatggtgaaaccccatctctaccaaaaaataaaaaaattagctgggtgtggtggtgtgcgcctgtaatcccagctacttgggaggctgaggtgggagaatcacttgaacccaggaggcagaggttgcagtgagccaagattgcacccctgcattccagcctgggcaacagagtgagactccatctcaggagaaaaaaaaaaaaaagacttacaggtattctagttaaattttgtcctgtgagatttggtgcaggcttctaaccttttgagatttctttgagctttaattcttccatttatggcaataactgtgtgtcctccatttgtgtcatctacaaactagttaagtgcataaaaggaactcagatatttgaataaatggtcatatatctaacatatctttgctcaaatagctaaagcattagaatgtttaatcaaggtagagtctttgtcttttccattcctttcctttttttaaaaaaaaaaaagagacgaggttttgctatgttgcccatcctgaacttgaatttcaagcstcctccyaccttagcctcccaagtagctgggactataggcaccctctaccatgcctggctctttttctttcctttgcattttttttttcttaaagatttgtatggtgtagtagaaaaaccacttaacttggaatcagaagatctaggctctaagctcttgctcttctgcttacatgttggactggtcacttacttcctctggtcttcaaatttctaggctgtttgagaagaaaaaagactaaggtctctaactttctgtgattctgattcagttcgatcatctggcctgttcttggaagtcatatggaattgtggttgagagcaggttgagagtctggagtcagattgcctatgtttttatcctagttctgccactactggctgagtgacattagtttatctgggcctctgttttcctcatctgcaaaatgggtttaattatgctgcttggttgttttgacttagttgttttcccctctctccctccctccctccctctctctttcccttctttccctccttccctccctccctcgctcccttttttgatggagtcttgctttgtcgcccaggctggagtgcagtggcataatctcagctcactgcaacctctgcctcctgggttcaagtgattctcctgcctcagcctcccgagtagctgggattacaggtgtctgccaccacacccagtttaatttttgtatttttagtagaagtggggttttaccatgttggccaggctgaacttgaactcctgacctcaagtgatccgtccatcttggcctctcagagttctgggattacatgcatgagccaccacgcccagccttgacttagttcttagaacacattctgcatgtggtaaggaatatgtgattatttaccatcattattagaattttttcacataagataacattgaagacatagtgctttcctgtgaactgttgggatgaaacagtaattgtccttattttttaattttttaaatttaaaaaaaatttcatatatagagaccgggtttctccatgttgcccatgctggtctcgaactcctggactcaagcaatcctccacgtcggcctcccaaagtgctgggattacaggcttgagccaccggcacccggcctgtctttatagttagtaattaagaaatgtgacatgccgggcatggtggctcacgcctgtaatcctgacattttgggaggctgaggtgggtggatcatgaggtcaggagctcaaaaccagcctggccaagatggtaaaaccctgtctctactaaaaatacaaaaattagccaggtgctgtggtgggcgcctgtaatcccagctacttgggaagtggaggcaggagaatcgcttgaacccgagaggcagaggttgcagcgagccgagatcaagccactgcactctagcctgggcaacagagcaagactctgtctcaaaaaaaagaaatgtgacagaacccaatacagaggtatataaaaagtaggtgatatattatgatcactgttttatacgttaagaaagatgtttgtgtcttttatatccttaatagtgggtgattttggcattttaggaaagacattaagtatataccttcaattttctttgtttctgtaaraaagccagtagctgtcaattctcarataacttctgaccacatgtggaaatactggcctgaacctcttccctccactcacccttttcaaratctgcaggtagcagccagacttaaactttttcctacctttaacaggaaatgacaaaagttgggaaaaaaagaaggggaatggctcggatgactctactggcccatckcctctggatagttaagagctgactgtcctaatcaaagtcctctcctccattgcagcagaacttgcctctttttgaggctcaggacctcttgggaacttgaagggaaggcctgtctcctgtaggtagactgaccttgtccccaagactctaccctacttttctcagtctgcagtgccgttrggagaaataggttctgcttgagtgccagggaatttaggagatggcagattttggttcactttcctccaacttcacccagtaattattattttgatttttagagactgtgaattcagtatttctagaagttgccacatgtgttcattttggatgtgtcctaaatctctggtcaaccagttaagtattttttattttttattttgagacatagtctcattctgtcgccccggctggagtgcagtggcgcaatctcggctcacagcaacctctgcctctggagttcaagtgattctcgtgcctcagcctcccaggtatctggaattacaggcatgtgccgccatgcccggctaatttttgtatttttttagtagaggtggggtttcgccatgttggccagggtggtctctaactccttacctcaagtgatctgcccaccttggcctcccaaaagtgctggcattataggcgtaagccactgtgcctggccgagttaaatgtttttatttgttacccttcccaagaatatttcaccttcttacatatacaactcctatgcctttgtttgtttattctggtttaggtccttctcagagacagcagggtataacagggagcacagctttggagctggacaaatggacatgtaatcttggtcaagttatttaaccttttaaagtcctagaatttttatctctaaaatggaaatgataatatctttcttggagaattgttgggattaaatgaaatgatatttaaagtttttagcacattaactgtgaactaacagttatagtaaatgttcagttaattttagcttaggttattgagtaccttctaaatgtgatagagatggggttatggagacaaaagagtccctacrctcagataatttatttttttattttttatttttgagagagtctcgctctgtggcccaggctggagtgcagtggcacaatctcggctcactgcaacttctacctcccgggttcaagcagttctcctgcctcagcytctcaagtagctgggattacaggcatgtgccaccacgcccagctaattttttttgtattttagttagagtcggggttttaccgtgttggccccagggtggtctcgaactcctgagctcaggcagtttacccgccttggcctcctaaagtgctaggattacaggcgtgagccactgcactcagtctcactcagggaatttaaatctgataaaggaagaggttactagatatgagtcaggaaatgttcattcctttttttctctcttccctatttcttaygcattccttttcccagtacgaggcaaattctaggaggacccttcatctccaaggctaaaaagagtcttataagagggacaaactgagtacagttgtcacaggttatcagggtgactgagagcttagtctaggcgggataaagtcagctgtgagaacctttattagtaagcagtaacaggattattagcagtttgtaggtgggagggatacccacttgggagtgaagttgtcaagcaactgaggcaggtcatagggcttgtttaaactgaatggtctgctaggraagcttgcatttactttttttcatttgtagtcgtttgggctaatctctggaaacttgctttcctaggtgctgcccctcctccctccctgccttcaggaacaggattgaaagcagcattagcctgaagaagtcgttctatttagggagctagagcagagggccagtgattaggcccttatctgcagcggggcctttttgagtggtgtggggcagggctgcagtgtctgtcctgacacccacagaggctggacttttctgtcccctggttgggttagaactgtgaagaaccaatagaagggctgggccagctgaatgaaaaagcccttcattgtgtttcttcaacattccagtgtctggtacaattagccaagactcggaaaacaagttggacaaacaagcaggcagccttctactgatggatgaaaggatttctggcacagctgagttaagtgcactgactgtaaagacagagtaggaggatctgggaagaagaaggggactttggaatgccattcctggctgtgaggggaaagaatggagcaacaagcaaacggtatttttgaagctgataaaatttgctgtgataatctacctgggaggctggctgaggcgaggctggctgaggtggggctactctgtaaagtaggtggaatcactggggagttactgactcttcccttttggcagctgtaagtgcggggaagggaaactttctttggaatctagggatctgttcacagtggacggtgagtgtatgagcttgctccattatagtctctcccatcatgagaccttctcatttggttaacactatatgtacttctgcctgagaagaggcacacctgaggagcaagttgttgggcaatggatgcactgttcctgacttggcagtaaaccacttagctcaccagctctcctgcaactaagattcaccacattacaagcttctgctctgcaaatggagggtaactcaaagaccagtttcttcctactcaggtttactcacttcataccttgactggacttttgcatatggagctctcccctctgtacgctctattggtctggaaacacagagttggtgctacttttgaacagcatgcagcatgctatatgcctgagacatggacccagtttttggaagtgccctagggaggagcttcctctctgacctcaagggaagaaggaggtcagtaggaagtggtgggtggagccacttctctgttctgctgtctcctctctacacctcacagccctttttgaggagctgcgaagggtgcacaggccagtagctggaggttctttggtaccccctccttttaggtggggtcagcagacacaggggcgccatgtggccgagttaccaagatgaacacgagttcracgcccacctggtttgtcgcatgtgctgtatgggttagtatgtgaagtttttttttttttttgcttgtccgggcctgaggatcccaaatagcccttgctctcattgactcataggaatgcatggacttcgaagccttgtggtgttacaacctttaggcttgttaaaatgtgcagtggaatagattggggtgccctacttcctggggaacttcttaagcttgcagtaactggcagttaagagcccaagctttgggtgtagaactttttttatagagactgaattcatgctcatgcttctgcctgtatcaggaaaccacttttaaggtatgttgcatagtgctgaaagtccagagtgtatttttagcagaagttggttggttacggagtccacctctgagcagactggcgggaggatggggggtgggagggaggagtcatggcctatgtttcctctttggggcttattgctagttcttttacactttactctgccagctgtgacagagagagaaaaagactcaaagatgatctggggtcagggacctaaataagagaggctaggggaagagtcatgttagctgtgacttagatctctcttgataaggcatcattaaataatgattatttaagtaatgtcctgtggccttgaacaagtgacttaacctttttggcmgtaggtttccttggtttcaaaattgtagggtatacagactggtgctagactgagagacatcaattctctgtaaaatgaaaaaagataaagaaaatgtagtgtgtctttcataaagctaaacttaaagaattgtcttttattctgaaattgtctctcctactttctaatgttaaaatatcctttattttatgaaagaattgttattatatggtagtgtgtttttaagatatccctacttagcaaaatgaaaagtgacaacttctgttaggctttctgatttattgtggaacatgtatttgtctatgaaatcttagtttgggaaccactggtttggtaatctactatcttttgattttatactttgagtctctaacaaggagcaaaattgtgacccaaataggcagattttcattaaaattgaagtaactagttgtttgatgaagaggagaccttagaaaaatctcagagaaggagagcaacagaactagggttctgatcagtctcctgactcctaggctagtgcttgcaagtatttaggtgctttttgaggaaaaaaagctgccatagcaataatgcttggggcacagagggggcaattttagtggtctacttttttttttttatctttcctgtatcattgagatttcttccctggaacctagaagaaagaattgcctatatctaaaagtgcttggagataaacgtatagcaaaagggcctttcctgtaaccaacaaagaagtataggaaagtctaaaatctttattgaaagtttcagggcaaaaacgtaatgtagccccatctcccccaatcccacataatcccctaaaggcactgtagactaatagctaagaaaatgggcttggcatcaactgtctacacggggttcctactccaccacttaacaacaaaaccaactggggacattgcttaacctttytctagctcrgttacctcattttttatttttctttttttcatatcaccgtaaaataaaatcacttgtatagggagaatgaatgaagattagcagtggattttcatgttatatacttttcacattatattactactgtaactaccagctagcatttattaacttattatgtgtgagagactaggctaagtgctttcatatcatatactcctcacaatcacttcatgatttagggtctattttattttattttattttattttattttattttattttatttgagacggagtcttactctgttgctcaggctggagtgcagtggtatgatcttggctcactgcagcctccacctcaggggctcaaacgattctcctgcctcagccttccaagtagctggaattacaggcacgcatcaccacacctggctaatttttgtatttttggtagagatggggtttcgccatgttgccttggctggtcttgagttcctsacctcaagtgatccctctcaaaaaaataaaaataaataaaattactattcaaacctcattgcttaaaaaagggattaaaacagactctaaatcagccgggtgtggtggctcatgcctataatcgcagcactttgggaggccaaggagggcggatcagttgaggtcaagagttcaagaccagcctgagcaatatggtgaaaccccatctctaccaaaaatacaagttagcagggtgtggtggcgtgcgcctatagtcccagctactgggggtggggttgggggcgcggctgaggagggaagatcgcttgagcctgggaggcagagatttcagtgagccgggatccactccagcctgggtgatagagcaagaccctgtctcaaaaaaaaaaaaaaaaagaggtcggtcacagtggctcatgcctgtaatcccagcactttgggaggccgaggcgggcggatcacgaggtcaggagatcgagaccatcctggctgacacggtgaaaccctgtctgtactaaaaatacaaaaaattagctgggcatggtggcgggtgcttgtagtcctagctactcgggaggctgaggcaggagaatggcgtaaacccaggaggtggaggttgcagtgagccgagatcacaccagtgcactccagcctgggcgacagagcgagactccgtctcaaaaaaaaaaaaaaaaaaaaaagcttcccagatgattttgagatggctggtttacagactgatatttagsaactattggcctaactcctcattttatttgcagagttggagataaaaataaaattttaaaaataacaaaggacaaatgcctaattttatagatgaaactcaggctcaaagaagggaaatgaatgtcatgcaaaggtatgaaccatagactagacaccaggaaatccaagttatagacctagttctgcccctgtgtgaccttgtctaaattatttaatctctctgggccttggtttcttcatctttaagatgatttttgaggactcttaaaactctctctttgtatttatgaaatgcttcgtttttctgactgtgatattcccgtgaattctctaagaactattgagcttttcttcctcttgtgttcttatatgtgcctccctctcactgtggctctcttcttttgttaccgtgcttacccctggatttctttatcttacttctttcctttattctgtgattcttaatagtccaaagaattatcattataatattaggttttcctaagaaataaggtaaatttttgttttgttttgttttttgagacagagtcctgctttgctctgttgtccaggctggagtgcaatggggcgatctcggctcactgcaacctctgcttcccaggtycaagtgattctcctgcctcagcctcccaagtagctgggattacaggcgtgtgccaccacacctggctgatttttgtacttttagtggagacggggtttcaccatgttggccaggttggtctcgagctcctgacctcaagtgatccacccatctcagcctcccaaagtgctgggattacaggcatgagccatcacacccggcagaaataaggtagaattttaattttgcattgaagcttctacagttgtcacttccttaaaaccccaaatctcaatcctcattggtactttctcagcctacaccagtcattggtgataaatgcctttcatgaatccctattatagttagtacttttcctttaacttgattatataggactgcattgtattgtcttctaataaatttatggaggttaaaagtctatgatctgacagacttggatttgaatctcaattctgctgtatactgcgtgactttgggaagattactaacaagtctttctgagcatgaatttgctgaaccatgaataagcatacttgagagagttgtgaggattgtcaaatactaaatgagataagcctcaaacagcacctgatacataataaacacaataaatatcgagctccaccttatctcccaaagtagacttttgtagccttctgaggatagcaatcatttataatgtttgtgccattatacattattgctgaacacattttaattgcttgacctccaatttcaccaatttcctttgcgcttacattgggaacattaagtggttcaaaatccccaggatcaagatgtggcaaggagaatttaggaaagctgaatctgtagagggaatatctgagtgggagtacctgctccctgctgaaaagcagtctttttttgagatggagtctcactctgtcacccaggctggattgcagtggtgccatctcagctcactgcaacctctgccgcccgggtccaagcagttttcctgcctcagcctcccgagtagctgggattacaggcttgtgccaccactcccagctcatttttgtatttttagtagagacggggttttgccatgttggccaggctagtctcgaactcctgacctcaggtgatctgcccacctcagcctcccaaagtgctgggatggcaggcgtgagagccacagtgcctggcctgaaaataccatcttaatgtgtcttgtagctataaccttgacacctagaggactgtgattatatatttgttaaatgaatatttttcaatacctatggttgtcctaaatgttggatatttaatgaaaaaaaaatttttttttgagatggagtcttgctctattgcccaggctggagtgcagtggcacaatctcagctcgcaacctctgcctcccaggttcaagccattttcctacctcagcctcctgagtagctgggattacaggagcrcaccaccttgcctggctaatttttgtatttttagtagagatggggtttcaccatattggccaggctggtctcgaactcctgacctcaagtgatctgcccacctcagcctcccaaaatgctgggattacaggtgtgagccactgcttctggcctttaatgaatttttttttttttttttttttaagacagaatcttactctgccacccaggcgggagtgcagtggcrcaatctcagctcactgcagcctctgcctcccgagttcaagcgattctcctgcgtcagcctcccgagtagctgggattacatgcgtgcaccaccacacctggctaatttttgtctttttttgggtagagtcgaggttccccatattggccaggctggtcttgaactccggacctcaagtgatccacccacctcggcctcccaaagttctgggattacaggtgtgagccactgcccctggctggcctttaatgaagtttaaagcatggatcttgacttgaaagagctcaattcagatacagaaatggacttagatacagagctttctaatgataggttttatatgcttagtgctaagtaaattgaagaaactttaaagtgccataggcatccaaaggtggctgacatgtccggaaaggtgtaacagaagcaagacttcagctggactttgaaaggaggttctaagttagacaagccccaagagaagagggtagatattccagttgggggaaaggttgctcctagtagagtaggacagatgcgaaaggtatgtttggaaacagtaagaagatcggaatggttgcagttgagtcatgcaggggagagtgaaaggtagatagattgtaaatttcttcaggtcagagaccagttctttatcttcttgaaccaccgaaaacgtagtgaataaaaactgcaattgaattttatagggttgtagagagctttgaattctaaaactaaagtgatcaaatccrtaaaggattttgaatagagagagaggtgatgtgggctaagtggtgattaggaagatttgtcgaaataggctgtttgctctctatttgccacagctatcaatttttaactccaattccttatcttcagttctgactgctcttctgaactctagaccaaagattccaactgtctgtgagaagatcctcctaacacctcactctttgtcttctcctttacccaatgtaccctcaccaaatcggtaacctctttctgttttcattatcttgaagttctactctcctcccagttgctgtggctagaagcatgagaattgtcttgaactctgccattccttacccgccaccacatctaaaggctatttaaaaggctatttaaaatagctaaaggctattgtttctacctctacattgcatgacaacgtagaggtacctgccctcttctttactttcctgctgcctctgccctaattcatgctatttcaagatgtttctcctggtctgtcactggagacttctaactggttcttctgcctcttagtgtctttctggtataatgtggccttcagtccaaagccagattagtcttcccaaaacatactgtgggtcagaaaatttcagtggttctgctttgtctacttaattaagtacgtactccttactctagctttctgggtcctttgtgatgtcagctagctgttctgttagcctggttgctcatcacactgctaactgcatggtatggtcatgcatgtaatagccatactgttccctaaaacacatcctgtatacttamatgtctccaaatcactacttgtgctttgtaaattaaaaaaaaaaaatttctttttgagacagggtcttgctgtcacccaggctggagggcagtgacacaatcttggctcactgcaacctctgcctyctgggctcaagtgaccctcccacctcagccacccaagtagctgggaccacaggcgcaagccaccatgcctggcttatttttgtattttttgtagagacagagttttgtcatattgcccaggctggtcttgaactcctgagctcaagtgatccacacaccttaacctctgaaagtgcagggattatagrcatgagccaccatgcccagcctacttgtgctttttttaagtttggaatcctttgactcctttttgggctgccagaatcctactcgttatccaaggtttagttcagacaccgttcacttcgtagccttttgtctaagatcaggtatagttctatcacgccttccatgracacctcctacctctctgtgaggattaatcaactctatgcttgtgctatagtgtcattttgtgcagcttgtgtctggtgtgttatttgcttggtgttattgttaattatttacatgttgttctccaccactagattgtaaacttcatgcggtcacaaaacaggactattccaactctacttcccttctgtgtcagctgtggtatatcctttttagawttccaggtggttggtgtttctgggcttcttgaagcacttgtcatttttctgtggcctttggaaacaggagaggctcttctctcacttgttttktgaatggttcgtaatgtactgggactatgtgggtaggctatgttggatcagaacatagaattttgcccctcaaatgcaggctttcatttgacgtcaggcctactctcaaatttctcctagtagagtaggacagataaacaagtaaacagtgataccatgcaataagcacacaaactagtgtgtgtaagagatgggaaaagctcctggaggaggggatagttgagttgaaggctgaagaatgagtagtcagagaaggggagagctatattcacagagtatgtgcaaaggcatggaactgagagaaaacctgccccatttgcaggaaattttttaaacaaggctggaagtttttatggaaaggtagagggatgagtggaaggtaggcattccatcataatggatcttagctcccaagctaaaaagtttgactgttatcccaaatggaagcatcaggctttggaactgggtagagctgggttcaagtttgacttcatgacttaccttgtgatcttgggcaagctgcttcatctgtctggactttatttttctggctawcttacagagttgttgagcattagaaagaatagatacaaggtgcttagcacctaagtaggtgctgaataaatgctrtttaattttttttttttttttaagacagaatctcactgtcayctaggcaggaggagttcagtggtgccatcttggctcactgtgacctccgcctcctgggttcaagtgatcctcgtgccttggccaaccaagtagctggtattttacaggtgcctgccaccacgtctggctaatttttgtatttttagtagagacaggggttcaccaagtaggccgggctggttttgaactcctgacctccagtgatctgcccgcttctgcctcccaaagtgctgggattacaggtgggagccactgcacccagcctaaatgtcaactattaataatattgggagaataagggctcactgaaggattttaagttacaagattaaccttgccagaaaggttgctgacaccattgagaaggatggattacagcagggatatctgtcagaagcaaggagaaaagaagagttcagttttagacaagttgagtttgagatgagcatggaagttttaggaggccattggatatatgagagtggtaaaggcctgagctaaagatacagatttggaaattatcattgtataggtcacagctgaaactatggatgttcattaaatcattaagggagaatgtaaagaacagctatttttaatttttattgaaaagctatggacatccccctactcccccccatacacacatgacacaaaacattttgcatgtaattttaggtggttcctgaacactccctctccaaaacccattagtggactcttgggtccttggacatctgaagaagctataatacagaatgaaaagaaaagagggctaaggatgagtaatgtttaagggatgaacagaagagaagaaacaaccaaagaagaaggcagaaaactagggtagaatggaatctcagattcaagagagagagtcaatttaaaaggtgaaggaatgatcaccagtgtcttctgctacagagagtttaagtgagatagaactcaaaactatccattgggttggcaattaggtgactgtggggagagcaatttcagtgaatttgtggggctggaatccaggtcacatagaataaataggaggtggggaagtgaagtctgagtgttgtcatcatacttgttcagaagccaacaggagagaaccaggagagagagagagcagttgaagatatacagactagggagtattgttggattaagtttcctatggagaagagcagcaaagagatccagattttaggtagaaggactgacttagattctgaaaagggacaactctggcaatgaaactaaaataaaattaggataggtattgatagcatgatgctcagagacccttgttgacgaagatcagtaaagttggaaacaagtattaaatccttctaattaggccggatacagtggctcatgtctgtaatcccagcgttttgggaggctgaggtgggaggatcacatgaggccaggagtttgagatcagcctggacaacatactgacaccctgtctctacaaaaagtttaaaaatagccacacatgatggcatgcacctgcagtcctagatacttgggaggctgaagcaggaggattgcttgagcctaggggttcaagattatagtgaactatgatcatgctgctgcattccagcctgggaaacagaatgagaccctgtctcaaaacaacaacaaatagcaaatttttcttttttyttttttttttttttttttgagacggagtctcgctctgtcgcccaggccggactgcggactgcagtggcgcaatctyggctcactgcaagctccgcttcccgggttcacgccattctcctgcctcagcctcccgagtagctgggactacaggcgcccgccaccgcgcccggctaattttttgtatttttagtagagacagggtttcaccttgttagccaggatggtctcgatctcctgacctcatgatccacccgcctcggcctcccaaagtgctgggattacaggcgtgagccaccacgcccggccatagcaaatttttctaatttaagccttctaattcagtaacccccaagtaattaataaggtttaaagtgttaaatctgaaacttagatggacagtagggttctctgcttctgtagagatgctggtggtggggagtgggctctctcttgtttgtttatagcctttggkggggckgarattataaagaacattaaaatgaatattgccttttckttgcccgttttcctctcacataagggtactttctgagacttttacctcagttttatctttctgcctaaccttcaatgttagtcagaaagatctttgctaggcctgggttaaactagggatttatgtgcaaggagccaatataaaacttattaaatagtttgagagtctgagctattattctgaaggtcagcataattcttaaggttgcttcttggatttccttgctaaaaattaagatattaaactccaggcactgtaatattcttttatcctgaagtttaaaccaggaaagaactttcatgtaattgatgggcataccaacataggatcctaaaaaatgatcttccagctcttaggggcaaaggaattctataaaacccttttctgaggagcttatggctcagctctaagcaggctagctagtcttgggaagggcttgtaatcatgttgcctttaatgattatattcacaataagtacttaaacgtctttctcctgagcttaaagtcagctttttagcttttggaagcatgattggtatgaggccatcaggtttccttagtacattaccgttatggaagggcttggtagatgaacagaataatttatggatagtattttttttttttttttgagatggagtcttgcgctgttgcccgagctggaatgcagtggcacgatctcagctcactgcaacctccgcctcccaggttgaagcagttctcctgcgtcagccttccgagtagctgggattacaggcgtgtgccaccacgcccagctaatttttgtatttttagtagagacggggttttactatgttggtcaggctggtctcgaacgcctgacctcgtgatccacccgcctcagcctcccaaagtgctgggattacaggtgtgagccaccgcgcctggcctatggatagtaaaattaaaaagaatcatgctactcacatattcaggtctaaatgaaatgaggcagtggactaaaaggaaaccgaatgaattccacctcctttaaatacttactagtttaaaagaaaatctgttaaytttttcctttttcatctgtgtgttgtttgacctattacagcaaacatacatagcttttataaaaaaaagaaattataaaaaaaagaaaaaacacttctatctttagagtgagaatttttaaaattagaatcagactgtttttggctatgaaggtaatgaatatagtgaagcacagtgggcctgatatcgtgtgaaaatgtaatggacacaactttagttagctctgatttttccaccctgccttcttatctcagcacacaagtgatactggcgtgttgtgattttgttttttcaggcagggtctcagtctgttgtccctgctagagtgcagtggcacaatgatagcttgctgcagcctcaaactcccaggctcaagtgatccttctgcctcggcctcccaaagtgctaggattacaggcataagccaccttgcctggcatggttttgaggtttttagatattgaactggattcttgtaggtaactcagttctgayttcattttgtgtgtttcttttaccaatcttctaatcatacttggccaattgagaacgctctccggtggttttatgttttagttcttactatgtagaactttaggtgttgcaagttgtgggaaatacaaaaaagtaaatcatgttctcttcaaggagttaatgatctccctggtaatataagaataagcatattaaaagttcagaacactatataattatataagtgctgattgagtgattagcccagtaagtaacatagatatttggaggacacagagactgttgagaactggagttgtcagaaaaggcagccaaaatttttcttaaacacaaatctgagcatgtcattctccaatttaaaatctttcaatgcttccccttacctataggataaagttcgggttccttaagcttgtcatgaaaggtcttgatttggcccataccatcctatctcgccactacctagttgtctttcagctattcctaattatgtgcagttctttgaacataagctttttcttgtctccatgaatttgcattagctataactttatgtagcaactttattccttcccttctctttctggcttatactcatcttttaaggttagatagagtcactcctccttgaaacttcattaagtcccccatatttcctgtccctacccaggtaggcttaacctcttatgttcatgagcactctgtgcttacctgttatagcacttaatcaacctgttttgaagttgtttctcttatttaaagaataaatgaggccaggtgcctgtaatcccagcattttgggaggccaacgcgggtggatcacctgaggtcaggagtttgagaacagcctggcccatatggtgaaaccctgtctctactaaaaataaaaaattagccggacgtggtgggtgggcacctgtaatcgcagctactctggaggctgaggcaggagaatcgctggaacccagggggcagagttgcactgagccgagatcgcaccattgcactccagcctgggtgacaaaagcgaaactctgtctcaaaaacagacaaaaaaagggaatgaacgaggtggattttaaagaataaataccatttggagagatgaagaggaagagaagtagccagtcatgaagggaaaataagtagtatgagcaaagagtcagtgatttcgatgagactatagttggaagctgattctgattcagtctgcagatgacacgggcttggaaaggttgatgaagatgttggataactgaatcagcatctaaaaagatcaaaatatgttggaatgacagtgatcaaatctaatgagaatcctggctttagatactttcaagactccattaagtgaaagatggattaaacttttaagtctaataataatacttttttatttttttgagatggagtcttgccctcttgccaggctggagtgcaatggcacgatctcagctcactgcaacctccgcctcctgggttcaagcgattctcctgcctcagcctcccgagtagctgggattgcaggcatgcgccaccatgtccagctaatttttgtatttttrgtagagacggggtttcaccatgttggtcaggctggtcttgaactccccacttcagctgatctgcccacctcagcctcccaaagtgctgggattacaggcgtgagccaccacacccagcctaataataatacttctaacagtcccaaatgagagtcaataggcagaagttacaaggaaagcagattatgacattttatagaattattacattggtactttgtcttatgaattagtgaattctctattatcctaaattttaaacatcaagaatattgtagatttatgggagatttggagagacctttcaatgtgaacttatgattctttgttgttgaagggatttgtgtgtcagcagagaattagactatataatttctaaggtccataccttagtgctgtagtttatagtaggaagaaaattgttccttgcaaagcaagaaaggattcaaggccgaaaagaaggatgtgaggataaaaccagagaccaagataagaaagtacttattgaatggctataaactcaaaaaaaataaatagataaatatattcacctgggatgtagaacaagcattgacattgtttggaatggcagtatgttggcttttcctaggggatcaataagaagaaaataactgggcttggggagagracctggctgaagcttgtatgaattactagtgaaccagatttatatacctctgcaactttcttccgaaatgttctctgtcttggaaaagatatggaagagtcaagcagcgggcagttatggtaatttaggtttgcagattgtcatggtgaatgtagtagtaggcagttaggcagggggagttcctggggtattagtgagggcagctttgaattgcataaccatgttgtctagcatggactgggataatcttagatgttctttttctttttatgagattgtgtcttactctgtcacccaggctggagtgcagtggtgtaatcacggctcactgcaacgtccacctcccaggttcaagtgatcctcccaccctcccacctcagcctcttgagtagctaggactacaggtgcacaccaccacctggccaatttttgtatttttagcagaggtggggttttaccatgttggccaggctggtctccaactcttgagctcaagtgatccaccggcctcagcctcccaaactgctgggattacaaggcatgagccactgcaatatgtgtgtcccaaatgccaaggcctggctgtagatgtccttaatgaatagggtaaaataagaatggagtgattgaaggttgagaatgattaggagagggtatgagagactgataatggtaagtgctaaataggtatgtttggggaaggaataaggcccaaaatgtggcagtgtggtggctggacatgaattggagatgagtgccagtggagccaagtaggcacagatgcattgtcacatatatcttcacgtatatgtagagatgataaatgaaccaagtcatcggggaaggctaaggtagatttgccatgtggaaggggataggccacggagcatggtcaatgacagtgaggatgatttgaacaagaggttatatgggatggtgtgggctttcagaaatagaaaaggaccaggactgatggctcactggtctagaaatggctctggggaattggcaggagtcggagaaagtaagtcctttacaggataaggcctctgtggagcagtcattgtcaagcattgacagtcatgtttttgttaaagaggtaaaaaaaaaaaaacctggagaaaaaaggagtttgctgctgtgacaggagaaggtagagagggaagagatgtgcagtgggggtaagctgggcagctttgagagtttgattgttttgataatggctggtaaagaaattggaatgaaggaattcctggggtaggagagggagggagttgggcattcctcaggcagatcagcacatgaagagtgaaatttaaccactgcaatatgtgtgtcccaaatgccaaggccaccctgtctgttggtggtatcacggctttggctttttgaagcttgttgtgagggaagtggggaatcagtctgctccctgctctgctcaaattattgtgctaaggagactttgccatggtwtgatttttgaggcacrtgrtgattctgtctgatttgtaaactgacaacgtgatcagggccaaagaggaagttcagctaggccaaaccttmctaagaagaagtcactgtcccacagttatgtgggtaagttgttctagagaaacagagatgtgggcagggcagcagcgtgggaacctgttacctgggtagcactaagccagtgccttctctgtgtttcctttacagatgaacgggaccgggttcagaagaaaacgttcaccaagtgggtcaacaagcacttaatgaaggtaggaccctttcatatatatgctgccccagcacctctcactgctctcatctggatctgtcattccttctttcagatggtttagattgcttgctgtgtgctcaagtctatgaagatacacatgtgacttttcttttctcttcttttcttttttaatagagaaggggtcttgccatgttgctcaggctgttctcaaactcctgggctcaagcaatcctactgcctcagcctccaaagkgctgggattacaggcatgagccaccatgcccagctttttgaaaactaatatagtcataatggcatggaaacttgtattaatctgcttcttggtgaagacattattacctaccattacatcaggaggcagaggctgaagataccatgggatgattttaaaaattcgaagaacagtttattcctagctttatacattgctttataagcctgtttctttttttttttaatttattaatttattttaaaatagacacagggtctcactatgttgcccactctggtatcaaactcctgggctaaagcgatcctcctacctctgcctcccaaagtgttaggattacaggcgtgagccactacacccagtgtatttttattttttaatctgaatactatggaaggatgatagagggggattttctctctttctcttaaagtgcatgaatcttaaatgtttaacttgatgaatttttacatgaattttaccaccaggtagtctaaaatacagaatatttccagaatggttagggctgaatgaagattattattatcattattattattttaaatagaggagaaaccataacagaggcatgttaagactcacctaaagataataataataattgttatatattagatatataaaatataataataatatattattatggtattattattttaaataaaagagaaaccaaaacagaggcatgttaagactcacctaaagataaacagtatgactactgtggcagttagaatctgaaaacaaagtttttgaattataataataattagtgcttctctgggaaagggaaaggtcaccagtgatcccttaattgccctatccagtagcctagttttatcttcctcttatttgatttctctgtagcatttgatactgtcgtctactccttaaaaccctctcttacaatgacttctagaacattgctttttcctgaattacctctttcctctatgaatgcctttttttctgcctgtttcactggcttttcttcctctgtctgactcttccatgatggtgttccccaggatcctaaccttggccattttttggttttgttctctgtattctttttgggcagtctcatccattgtagctgctgggattgttttgttgcatgggatgcaaagaaacataagtagaaatggatatgggatgatctcacagaatctgatgtctagatgcagctgggctttatgaaaactaaacagttatcagaaaactactctcatactctctttgttttttttttttttttttttttgtttgtttgtttctttgtttgtttgtttttttgagacagagtcttaccctgttgcccaggctggagtacattgggaagatcacagctcactgcagccctaacctcctgggcttgagtgattctcccacctcatcctcctgagtagctggaactacaggcatgcactaccacacccggctaatttttaaatttttttgtagagatgggttctcactgtgctgcccaggtctttcttgtttttgttgttgttgttgttgttgttgtgttttgttttttgttttttgagatggagtttcactcttgttgcccaggctggagtgcagtggcacgatctcggctcactgcaacctccgcctcctgggttcaagcaatactcctgcctcagcctcccgagtagctgggattacaggcatgcaccaccacgcccggctaattttgtacttttagtagagatggggtttctccacgttagtcaggctggtctcgaactcccaacctcaggtgatccacccacctaagtctcccaaagtgctgggattataggcgtgagccactgtgcctggccaacccaggtctttcttgtttatggggccttgtgttctttcattttacttctgtgtgcctcctatattcatttctctgcttttcgtttattgctacgagtgagccatggyggctgtgcctcaaacagtgacgtaaacccctgaggccacatgattctggatgcacaaacacagaaagtytgatgggcttaggtcttcttttcctccatgggccaattgtccatctatagttcagtaaacygtgggtaaggaggtggttacataaatcacacatgtcttcttagggccacttgtttagtgggtactgcaggtgagcatgattttaacactgcaagatctggataaggaggcagtgatagagccttttcttggattcttgcctaagccaaaggcaagtgtcatggtgtattttacacattcatctgtatgttacctagccatagctttttttttttttttttttttwtttwtttttwattgataattcttgggtgtttctcacagagggggatttggcagggtcataggacaatagtggagggaaggtcagcagatacacaagtgaacaaaggtctctggttttcctaggcagaggaccctgcggccttccgcagtgtttgtgtccctgggtacttgagattagggagtggtgatgactcttaacgagcatgctgccttcaagcatctgtttaacaaagcacatcttgcaccgcccttaatccatttaaccctgagtggacacagcacatgtttcagagagcacagggttgggggtaaggtcacagatcaacaggatcccaaggcagaagaatttttcttagtacagaacaaaatgaaaagtctcccatgtctacttctttctacacagacacggcaaccatccgatttctcaatcttttccccacctctccctcctttctattccacaaagccgccattgtcatcctggcccgttctcaatgagctgttgggcacacctcccagacggggtggtggccgggcagaggggctcctcacttcccagtaggggcggccgggcagaggcgcccctcaccttccgggcggggcggctggccgggcagggggctgacccccccacctccctcccggacggggcggctggcctggcagaggagctcctcacttcccagtaggggcagccgggcagaggtgcccctcacctcccggacggggcggctggcctggcggggggctgacccccccacctccctcccrgacggggcggctggccgggcggggggctgacccccccacctccctcccggacggggcggctggccgggcggggggctgacccccccacctccctcccggacggggcggctggccgggcggggggctgacccccccacctccctcccggacggggcggctggcctggcggggggctgaccgccccacctccctcccggacggggcggctggccgggcagggggctgacccccccgcctgcctcccggacggggcggctggccgggcagaggggctcctcacttcccagtaggggcggccgggcagaggcgcccctcacctcccggacgaggcggctggctgggccgggggctgccccccccacctccctcccagacggggtggctgtcgggcggagacgctcctcacttcccagatggggcggctgccgggcggaggggctcctcacttctcagacggggcggttgccaggcagagggtctcctcacttctcagacggggcggccgggcagagatgctcctcacctcccagacggggtcgcggctgggcagaggtgctcctcacatcccagacggggcggcggggcagaggcgctccccacatctcagacgataggyggccgggcagagacgctcctcacttcctagatgtgatggcggcagggaagaggtgctcctcacttcctaggtgggatggcggccgggcggagacgctcctcactttccagactgggcagccaggcagaggggctcctcacatcccagatgatgggcggccaggcagagacgctcctcacttcccagacggggtggcggccgggcagaggctgcaatctcggcactttgggaggccaaggcaggcggctgggaggtggaggttgtagcgagccgagatcacgccactgcactccagcctgggcaccattgagcactgagtgaacgagactccgtctgcaatcccggcaccttgggaggycgaggctggtggatcacttgcggttaggggctggagactggcctggccaacagagcgaaaccccgtctccaccaaaaccagtcaggcgtggtggcgcgagcctgcaatcgcaggcactcggcaggctgagtcaggagaatcaggcagggaggttgcagtgctagccatagcttttatttaacacaccctaaattgttaagtattttcactcatgtagccagttgttcaagttaggaacctatttgattcagtactgcctataatctctcccttgttaccaagtccagttaatcacttgtagctcagaaagattgcatgcatctgtcttctcttctccatctccatatcgctgcttttgttcagggcctctgtgtctgttgccttgaccattataatagtttcctaataaagttttctataataacaatggtagtaatagtatcttgaagacttcctgtaaatcagacgtattctctctctgtgtgtgtgacagggtttactctgttgccaggctagagtgcggtggtacaatcatagctcactacagcctccaactccygggctcaagtgatcctcccaccacagcctcccaaatagctaggtttataggcacatgccactgtgcctggctaatttttgtgtgtgtgtttgtagagatggggtcttggtatgttgcccaggcttgtcttctactcctgacctcaagtagtcctcccaccttggcctcccagtgtcttggaattacaggcatgagccaccatgcctagtctaaatcagacattctgtataytaagtcctttacatggattatttcatttaatccttcagtgatcttatgctgtgggttctgttaatatccccattttataaattacttagagagggtaagtaatttgttcaagatcatgctgctagaaaaaggcagaactgaaattttaaaattcaggcaacctaaagtctagaaaccgtgctcttaacccatgcagaactggctctggttgctgcctacctttccaggctcatagcaccaagtttccctcataccttgagttcttgctgaactatgtgccatgctattttatgactctgtatctttgttcattctgctccctgtgcttggaatatctttcccaagtttgttctgcctggataacacaaacttaacacctcttcagtaagtattttcctgacttctctgatgtggaactgactagcctttctttgtgcccctgactatactccttatgtgcttttgttaaagcatccagagtgtttatatacatggtgtatctttcagctatattatcactggagggcaaatattgtgtcttattgtttatagtgttaggacaaagaagaaagagagagaagtaaggagaaaagaaattgtaatttccttttttttctttttggagatggagtcttgctttgttgcccggctggagtgcagtggcgcaatctcagctcactgcaacctctgcctcctgggttcaagcgactctcctgcctcagcctcctgagtagctggaactacaagcatgtgccaccaaagcctggctaatttttgtatttttagtagagacagggttataccatattggccaggctgctctcctgggcttgtgatctgcctgcctcggccttccaaagtgatgagattacaggcatgagccaccgcgtccagccgtgatttccttttgtaaatttcttccatggctactagttgcctctagagtttgatgtcacctaactctktcctgatgtagagcactttgcagcgtttccaacccacctgtctagcttcatttctaagcactctgttttttgtagcttgcgctatagccacatgagacaactcactgccccctaaacactgtgtactttcacacctccttgcttatttatttctctccctagaatgcacgtcccagcctcctctgcctgaccatcacccacttcaccttctaggcccagctccagtatcaccttcctgagattctgacctctgttcctcagattaaatcaattgcaactccatctgtatttcatactgccttgaagagatgcctgtgtgttcactcatcgatgttctctgttacagtactcattgaggactgggattgtattatgctactttctctgttaagtgctgcacatagcacatgagaagtatmcaataagtacttgttaccttgagtaactaatatttcaatagtgttatagcgtatgaagcacattcttatctgtcttaatccttaaaataaccctgaagtaagtaaaggtgttttatccccttaattttaacagctagggaaaatgagaattagaggagtgaagtgactttgccaaaacgatacagctagtgagggatggagctaaggatcaatcaatcatgaatcttctgatcaaaattacttgttcttcctgctaactatgcccccagctgattctttttttttttttagacaatactgatattaattaaacgtaaggtaaactccaggcatccgtcatctttcagcctaaaaattagcaaaaactgttgaaacaaggcagttttttccccattatttcttacgttgtggctccagttacaaaaaaattttaatgaaaacgttaaacataaaaatagaagtttgagattttaaaaaagtatataaaaagccccacaaaacttgtcaatgttgttccttattctacaaaatagcaccagtaagaagagtaaaaggtgttaaaaaccattacgacagcatttctgaaatacagcttgtctcaactcccgttctccctaaaaacgacttctcatggaataaaaaaggatttaaaaattgccagagggagcaccgagctttgactgcagttttccctgtcatctcttaratgaagggaaggtgtgagaaatgtgcgtctgtccctgactgctgtcaccgcttctgagtttagtaaaaagatgagaaatgaaggtagcagacttctcatctggggacctgtgcctgtggagggtaggtctcttggagagggaatgggtttgaggggttgtcttatctaagctccttccttcacacttgtctcctagggaagagggagatacagaggagccaaatatatgacagcttatattatagaacttagcacaccccttcctgagctccccagagggttctattgcagtcactgggagggatttagctaagagtggcccctgcccttgggtttggcccctagctgattgtttcatactttgtctctaaccgttggaggaactgaatcaatcctaccttgagcttgtcccctgaactttgtagttgaattccagtgctctggctccttgctgcctgtttgtagctgatgctgcctgttggacctctgcctcagtgctgtgtgatgacaggaagctcagggagggagaagctagaggaacacatcatagcattgttagaaattggaggccagccaaagcttttcttaaatccttggtgatttttcatctcttcccaggcccccagccttacagtttcaataacatttgctcatcttgggatatttcagagagagattcactgctaatcagagttattgctctaaattggaattatttgattttgggctgagaattagggattgagatttttttttgcgactcaagcatcctttgctttgctccccaagtacaccccagattaatgccatctttggcaggtagaccaacgtaaggacaaaaccaaccaggtggctaggcatggtggttcatgcctgtaatcccagcactctgggagaccgagggggtggatcacttgaggtcaggagttcgagaccagccaggccaacatggtgaaaccccatctctactaaaaatacaaaaattagctgggagtggtggctggcgcctataatcccagctatttgggaggctgaggcaggagaatcgcttgaacacgggagatggaggttgcagtgagctgagatcgtgccaccgcactccagcgtgggtgacagagcgagactctgtctcaaaaaaacaaacaaacaaacaaacaaacaaaaaacaccacaaaccaggtctcccaacttctagatttagttgatcttggaatctcttggattccctgataaccttttgggaaacagcttactttgggataagcaaattaattcctccttattgagaacacttctgatccaatcttaaaagagatttgttaaggatataagcatctgaaataaacaacctaatttagaatgtaaacatacatatgtaagggttctgcttatataccagaaccatcaaaaagagaaatctaggtttctaaatgaggtcttatttaaattatctatgccatatctctgggtgctgttagctgataaagtgtatccccctaaagagaacatgaaagtatgaactccttaggagggagaaaaatgctttttctggtcagttcctgttgacttcacaggttagtagttagaaaggaaaagcccagtatttaatctagcagatagagcagttctttccmtttttgtatatgcaatctagaagcccctggctttcctggaattttagataaaatttccatatataccagcaaaagttttcaaatttttaataatgcttacaaccaacccttccttccttccttccgtccgtccgtctttctgtctttctgttttaagagacaagttatccctatgttccctaggctggtctcaaactcctgtgctcaaggaatctttggccttcccragtgctaggattacaggcatgagccaccacacctggcccacttacactttctctatttctgtttgagactctctagttgaatatggggtagcactgattccaggtattctgtcctatacagcctctgttttggccacatgagtcaattcactggctccctaatcactgggtggaacttcatactttttrcgtattcatgtctatgggaaataccagaatgagacgggcagtggagtttaatttaagaaattgacaaagtagtgctggttagatgctaaggaaaggagtgttacctttgttgcctacatgtgaytatatggtartggtttgtggctgtctttgcctggacctgattttttagggcttaatttcactctaaatgcttctcaggtctacatatgggcctatatttggacttgggctttactctggattttctattccctgtgcttaagtgcctgcctatcaaagtaaagctacattttgtggattttatttttttaagatggagtttcactcttgttgcccaggctggcatgcaatggtgcgatcttggctcactgcagcctccgccacccgggttcaagcgattctcctgcctcagcctcccgagtagctgggattacaggcatgtgccaccacgcctggctaattttgtatttttagtagagaacagggtttcttcatgttggtcaggctggtctcgaacttctgatctcaggtgatctgcccatcttggcctcctaaagtgctgggattacaggcgtgagccactgcacccagcctgtggattttagaatcatccacattcttagagaatctgttaatccgggttgaccggtaccactgttaaatttctcacaatttagggaattctcaaaacagagatatgataaaattcttatatgcaaagaacctcacactttgttcccctcccacccccgctctccaacagggattcccagctgctacttttattccctgcatttaagcatagttctttccagagtaaagaagtctaggacaactataatctgttttttttttttttttttagtgttgggcttttccttgaagacaaatttggccaatgaatcaatatcggtttctgtttttacaatttggagatctgccattcagaaatctatctgaaattactaggctcactttccctttccctgtatcttttaataagtgtaggagagagtaaataacattacttttctctttaaaactttctcctctgccctatatattgctcttcaacatagtttgrgtcaaggaaattgggctgcttacgtttccttttaattgtttagaggaaagatttctagatcaagttttcggcaggtgtcaatactacgaggccaggcatggtggctcacgccagtaatgtcagcactttgggaggccaaggtgggtgaatcacttgaggtcaggcgttcgggaccagccttaccaacatggtgaaaccccgtctctactaaaaatacaaaaattagccgggtgtggtgatgcatgcctgtaataccaactacttgggaggctgaggcaggagaatcgcttgaaccctggaggcagaggttgtagtgagctgagatcacaccactgcattccggcctgggtgacagagcgagactccatctcaaaaaaaaaaaaaaaaaaaaaaagagtactacgtgacaatccttgctcttttttgtgtatgtatggcggggaggggggactcttattatttaaaattgataatctgtcattttgaccctccaagcatcatagaagccttgttaagagagtcaggagacaatgatctggacccagctctgatactttccagctaagtgatcttatacaagttatttagcttctctaggcaatggttttctcatctgtaaactgagggtattagaattaagtaatctttaaagtccctttgggctaagattaggattccaagcacgtaagtgtaacttactccttttgttaaagccactgagaaattgagggaagctgtttattttttcatagctttaagctaatctttaaaaaatggaggccgggtgcagtgctcacgcctgtaatcccagcactttgggaggctgaggcgggtggatcacttgagaccaggagttcaagaccagcctggccaacatggcgaaaccttgtctctattaaaaatacaaaaaaattagctgggcgtagcagcgcatgcctgtagtcccagctactcgggaggctgaggcaggagaatcacttgaatccaggaggcggatactgtaatgagccgagatagcaccactgcacgccagcctgagcaacagagtgagactctgcctcaaaaaaaaaaaaaaagcagacagcagacccctccttgacttattaatgcttgggcactggggaggattggacttggtctctcaaaatctaattattcactaattttaagaaatcactatatggctgggtgtgatggatcaagcctgtaatcccagcacttcaggagggtgaggctggtggcttgaggccaggagttcgagactagcttgggcaacatggcaaaaccccatctctacaaagaatagaaaaaactagccaagcatggttgtatgcgccttgggagactgaggtgagaggatcacctgagcccaggaagtcgaggctatagtgagctgtgatcgcgccactgcactctagcctgggtgatggaagtgagaccctatctccaaaaaaraaaaaaaaaaaaaactttatggccagcacagtggcccacacctgtaatcccaacactttgggaggctgaggtgagatgatctcttgaggccaggagtttgagaccagcctgggtaacatactgaracaccatcttgcccccgcaacccctgtctctatgaacattcatttacaagtttttgtctggacgtatgttttcagttctctttaattacatacctaggggcagaactgctgggtcgtatggtaacttgtgtttaacctgttagtaaccatcacattattttcgaaagcaactgcaccattttacatcctcaccagcagtgtatgagggttctagattctctgcttttttgctaacacttatctgtcttttataatatagacatcctagacagcgctaatcactgyggttttgatttatgttttccttatggctaatgatgttgagcatcttttcatgtgtttattagccatttatatatcttctctggacacatttactaattttgacaatgattttctcagggagtgcaaacaggcaaggccctgaattgcagttttttactcatttgttgacagaatggtataattatttgttagaaagaagcatccttattgatgattcctgaacagtcttgcttcagttggctgcttctaaaactttttctttttttgagacaggatctcactctgttgtccaggctggagtgcagtggtgtgataatagctccctgcagcttcagtcggctgggctcaagcaaccctcccacctcagactcctgagtagctgggattgtaggcatgcaccaccacacctggctgacttttaaaattttttgtagagatggagtctcactgtgttgccctgactrgtctcaaacycctgggctcaagtaatcttcctgtcttggcctcccaaagtgctgcaataacatgcttgagccaccgcacctggccttctaaattttgatgcttagtccactggtcattttcctaagagatttgtggaaaacttcacaggcaaactagtatgagcagaagagatgaggattttaggatggatagatctggatttgatcagcctggcaatttagtagatgtgtgattttggggatgttaattgagccctccaaatccgatctctgtgtctgaaaaattcctgacacagaagcacccagtaaatgttagctagttctttactcttctttaggtagagctgtgtctagtatgcttcagaaacagactgctgttttctttattgacagttttccaggcaaggaaaaaaaaatctctttgcattctcctctcccattacctctctctgtatctctttgatagttttatttatttattttttattaaaaattttttttgggggggacagagtctcactctgttgctcaggctggagtgcagtggcacaatctcggctcactgcaacgtctccctcctgggttcaagcagttctcctttctcagcctcctgagtagctggaatgtaaggcgygccccaccacgccccgctaatttttgtatttttatttatttattttttgaggtggagtcgtgcactgtcacccaggttggagtgcagtgtcgtgatctcggttcactgcaacttctgcctccgaggttcaagtgattttcctgccttagcctcctaagtagctgggattacaggtgcctgccaccacacccagctaattttttgtatttttagtagagacgggatttcactatgttggccaggctgatctcgaactcctgacctcatgatccacccgccttggcctcccaaagtgctaggattacaggtgtgagccactgcacccagccatttttttttttttttgaaatggagtctcgctctgttgcccaggctgaagtgcagtggygccatcttggctcactgccacccctgcctcctgggttcaagcaaattctcctgcctcatcctccccagtagctaggattataggcgtgtgccaccatgcccagctaatttttgtatttttagtagataaaaggttttgtcatgttcactaggctggtctcaaactcctgacctcaggtgatccatctgcctcggcttcccaaagtgctgggattacaggcgtgagccaccaccctggccaatttttgtatattcagtagagcgggggttttgctgtgttggtcagggtggtctccaactcctgatctcaggtgatctgcccacctcgacctcccaaagtgatgggattacaggcatgagccaccgtgcttggccagtagttttatttttatagttatttggttactatagtcagacaaagattgagaggcataataagctagttctcatctaaatttcttataatatgtacaagttttgctaccacaggtataacacataaccagaattttgagaaagaaacattagggccttggtgtgaaattaactttacatttcaagttgcctcctttgtcttttcagtactctgtagtgtttaatatctgttgataagatgacctcacttggtcctcaagaccaactgcaatttatttttattattattatttttgagatggagtcttgctctgtcacccaggctggaatgcagtggtgcgatcttggctcactgcaaccccctccagcgcgattctcgtgtctcagcctcctgagtagctgggactacaggcatgtgccgccatgcacaacttttttgtatttttagtggagacagggttttgtcatgttggccaggcttgtcttaaactcccaacctcaggtgatctcccagcatcagcctcccaaattggtggtattacaggtgtgagccactgcgcctggcaacagcaatttatttaaatatttattcaggttgggagtggtagctcacacctgtaatcccaacactttgggaggctgaagtgggaggattgtttgtacccaggagttcgagactagcctgggcaatatggcaagactgtgtctcaatcaatcaagcaatatttattcattcatttatttattcattcattcattcagtgtcctcctgatttttattccctatgttcagatcttatctatcaaaaataaatccctcatttaacttagttctcttcttaatccttaatgtcaagtatgtaatattttctgactttttaaaaaacctaccattaatttataatctgattttcactctaccactctcttgagaaatagtctcacaaaagcactcttacttatttgtaggaaagttaaaaaactttcttagtctttatcctccttgacttctgctgtagtatttgataccggtgatcattcctatcttgattacactttcttgtatttttgcttacctctttcactgttattgttttgttttgtctttttcttctgtcctttgttgattgcttttccatctcctgccttctaattttggctgttccctgaggctcagtccttagcactctgctcttctatcttactcctaatccagaaagcccatttccatgtctttagctagcacctctgtgcatgtgacttctaaagttctcagctgacccaaactgaattctggtatttccagctgcttcaagaacattttcatttgtaacttctttgctgccattttaaattcaacatatttaaaattgaatttatcaaatccactgcccttttaacaaaccttatgacctgcctatttctgttaatggtccactactgttgttccacactgcaaacttgaaaccttgggtctatttgagggaggggtttttgtttttgtttttgagacaaagtttcactcctgttgcccgggctggagtacaatggtgtgatcttggctcactgcaacctctgccttccgggttcaagcgattctcctgcctcagccttctgagtagctggaattacaggcgcccacgaccacacccggctaattttttgtatttttagtagacacggggtttcaccatattggccagactggtctcgaactcctgacctcaggtgatccacccacctcaggctcccaaagtgctgagattacaggtgtgagagggaggggttttgaaatcttggagcccctggtatgctggagccagcttatggactcatgagagccaagtgttaaattttcagcaattttgtgagctggttgctaaacatagcttttttttttttttgagacagtcttgctctgttgcccaagctggagtgcaatggtgtgatcttggctcactgcaacctctgtctctgaggttcaagggattctcctgtctcagcctctcgagtagctgggattacaggtgcataccaccatgcccggctaatttttttttttttttttttttttgagacggagtttcgctctgtygcccaggctggagtgcagtggcgcgatctcgactcactgcaagctccgcctcccgagttcacgccattctcctgcctcagcctcccgtgtagctgggactacaggcgcgcgccaccatgcccggctaatttttgtatttttagtagagacggggtttcactgtgttagccaggatggtctcgatctcctgacctcgtgatccgcccgtctcggcctcccaaagtgctgggattacaggtgtgagccactgcgcccagccacagctattattaaaaattaaattatgtaaacatacaattaaataaattatatttaaagtaaatgtaatayatcctcaaagctgttcatttcataattgttttgctgcatgttagtattgtctgtactcttgaggttatgtctgttgtgtctctgtgatggaaatactgtacataatggtgtgctactgtatatttcttcccaacattgcatttagtgatattatattagtagcttgaaattggttgtattgggaatatttacatcatggaaatcagcaaattctacaagtttgagttagatgtcttgttttgtttattgtttagacttaagaaagtgatggggaaaatgttaatattgcagattaaatttaaaagtgtgggccgggtgtggtggctcacgcctgtaatcccagcacttggggaggytgaggcgggtggatcacaaggtcgggagattgaggccaacatggtgaaaccccgtctctactaaaaatacaaaaattagctgattgtggtggtgcgcacctgtaatcccagctactcgggaggctgaggcaggagaatcacttgaactcgggaggcagaggttgccgtgagccaagattgtgccactgcactccagcctagtgacagagcaagactctgtctcaaaaaatgtatatattctttcagtttttaaagctattttccagttcatcatgaaccatcttccccagttgtataacgtacctgtcaccttcttatttctttacacacatacatacacacataccttgcatatgtccatctctatgccaagtcttatgtggtttttccgtcttctttctactaaaacatttgctaatcctccaagtcccgtttcttcgaggaagtctttacgtatgtttccattctttatcttgtccagtttccattcttatcctactttctttttttttattatttttttcagacagggttaaaaaagaaacccctcattacaaaagggtcttggtttgtcactcaggctggagtgcattggtgcaatgataccttactgcagccttgagccttaaactcctgggctaaagcagtcctcctgtctcagcctcccaaagcactggtattacaggtgtgagccattgcacctggcctcctsctctactttcagagctactttgaatattataattggaaaggacttcagttttccacwcaaatgtaaaaatccccaaatccccagcctctactcaaaaaattatagtaactaaaattctactacttctgaaagtagccctttctagcgttgtctggaaaattaatatattaaaaatcaatcttccttataattttcacaagtcttcccattctgtgttgtgaacatcaccttttttttcgagacagagtcttgttctgtcgcctatgctggagtatggtggtgtgatcatagctcacttgcagccttgatttcctgggctcaagtgatcctcccacctcagcctcctgagtagctgggaccataagcatataccaccatgcctggcttttttttttgttttgtagagaagggggtctccccacattgcccaggctgatctcgaactcctaggcttatctcaaactcctagggtcaagggatcctcctgccttggcctcctaaagtactgggattgcaggcagaagccactgcacctggcaatgagtatcacttaatgaagtcgtcactasactgggactgaatcagaaatccarttgccacttaacttatagctaagtgaccataacatctcagaacctcagcttccttggtttctttgatggaatggtggtaataagtaaacttcacaaggtaattgtttggattaaataaatagaatgagatgatggctgattataaagcatagtagttaatggcaaagactaaaatcagatgaaactgaggccggtttttccacttggtgaccttgggcaatttacttaacctctttgtgccttatttcctcatgtgtaaaatagaaataataatactacttaccttagagatgtgagagatagataacatattaaacatttagtaccatgtttgatattaaccacactttctcccaaagtgagatctgtttttccatagttccaattttaaagttaattggaatttcccacaaagaaaattattctgaaattcgctattagaaatatttggtgtaagagaagggttaaattggaaatacaccccaggaaacactgggtgcctagcatttagtttcctttgcagcactctagaaggcttttctgactctggctggactcatctacccatcattcgccatgctattacattttggctcatagtaactcctaagrtgtctcaggataattaagactccccatcttcttgtccaaactttctaggacgttgttgcatgttggttagagtgtgtaatagatctggcatcaatttaaaaaacacacacgtttctggtaaagtattatcatttcacatgtattttattccaatctgaaacttcctgaattttattatttaattgttgcttccacttttaaattctttaatttgtgtttacctagaaccagagatttttatgtggatagtataataattcaatatcaaataaaaatctgtctgtttcactctcattcacaggtccgcaagcacatcaatgatctttatgaagatctgcgggatggccataacctgatctctctgttggaggtcctctcaggcatcaaactggtgagcttctcctaatgaatggcctcacaattgtggccctacaaatgacatattggtccatctcattgagtgcaagggcagcagccatcactgtttcatctattagaggggaggaagaagtagaaggaaatgttgggggactttatttctaactcagacttagaatttacaaattatataatttaaattgatgtattatatgttctcatttcttgatgaaatgagaaattagttataatcctttttatatctgcatgtttttgcattactttttctttattttctagatactaatatttyagaaacagtagattcatgtttaaaggtttttttgaattaggtgtatttttcttcctagagctctagtctatatagacgcctctcattttccaatctattgtgaatttttaaaattttatgtattcagctaaagacctgaagtttacatttaaaagcccaggtgtatgaagttatttttttttccaaatcatctcactttctcccttctgtgattcattgagtcttacagatttggagagctgccaaagttgtctgagcatagccttggatatagaacatctgggctccttgattaattaatatgcctgcttcttcccaaaatgttctaacattgattatgggaaacacctacatatctgagggcaaatcctgtctgagcttcttgccttgccaaatgatagttcttctacttgctttgagggatggaaatcacccacttgtaggcctactgttttctatatttgagcctaatgggagcaggtgattccatatggttcatactctttctctcatgccatagacaacataattttcatttagaaaagtccagggttgaatactggaaatatctgtggagaaatagagaaccaaagagatgtatagctcaagtagtctgtgaagaccagcccactcactgcctttcttagtcattgtttgttgtgtttaagtaacagaatttggcacatttgattttactgcctaagtgatattcagctccttctaggattggggcttggcttccctgggtcctttgttttggtttcgtatctttttttttgccttgcaatagaattaattatatattttttaatggcctaaaattgacagaagcttttattarcatagccggcacatttaatttctagttcttgctctctggctcgtgtttataagtctaataagtaatcagaattttactttcattgtgctggactttattcttcaccactcacacagttacattttgggcaatgtgtctggtacatttaatgaatttgtaatgattttatattgaaaagtgatcttttttggttgtattgcttacgtaataagttgaaactatgtcaatctaatttcttttcctaacctttgaaaacctttaagtgtttgtggagatactgataggatatcatctcttcaccaaaaaccatccagatatctctttgacagttattctcacsatgttttttccccatagttgacttagaaaagcagagagggtaggaggctaaggagaattgaagatgtgtttcatcataagaagtgttcaatgtaaccatctgctctggttttgatttagttttgtatctttttcggaggtgggagggtattttcatatttgtttttccttttttttaagtgttgcattcatttcctttccatctttttattgtgaatttcttgttcctctattgtgtctttgccttggttggtggccaaaggagccagcagggctgaagaccctccgtctggtgagcatgccctcctggygccatacaaacaacgaggagcaggcggaggaagatgatgatgatgtagtaggtcctcctggggatgccagcatcccagctggcactgctggcactgcagggccatcagagtctgaggttctccaggtctcgaagtagttcagttactatttgccaccttctcatttcaactgggaatttgggtcccaaagaaagtagttaaaactaattgtgccttttgtcactgttaggtgctcatggactgggaattgtttttcttagctgagaagggttggcacaaaaagaataatggtttttggaggtgtcaagttctcttctgacctggagacccatagctttctggtggccttgctgtgttttctgagtccagattgcagaattgtggaaaatttagttgacagcatgacaattaattgctcacaactccacagtctagactaactggtactctccacctctctggcctctaggttatcatcatacaccccgtcatttgttttcaaaacagcctgtttgcaaactyactgcatggagatactctggctttgctcaataatatctagttgctatagaggacagagatttaacttgcatgttcttagggtatttatttttggtgaggggtacatatgagtaaagattagagtataagaggagtgtattctgcctgcaggccctaaattatagtccaaaatctttttccagaaacaaggattaggcaatatcctcattctctgtcctcttaaaatcattttaaaaatatcatttgtctcccttctcattgccttagaatcttccattttataggcactatcatcttctaagccatattcacaattaatttagctgaaatgactgagaaaaggttcttgctaaaaagatttttcctaaacctttgactgaagaagttatcctgtgcccagagaggccttgacatctctgtgwacagattctcctatttgagaagtgttgcttagaagtgttggagagtgcccagaagatgcttccatccttatctctccatgtgttagggtactttttgcccattttaatttggagcaatgttgttctctgcagacacccgcaacagagctaycttatattttatcagcctttaattagtgtcaatttgacacttayaaaagaagtgggtataatctagtgagagtgatatttctctccaaattttagtaaaatataagcaacgttagaaagtaagcagaagaaaatgttctaggggtagatatccctttctgtgatactcagtaggcaaagagactgcattcactttccaactggtaatagttgagccttggacggggtaccagaggcactgggtagagatggggttctctccagtgggttgtatgacatctgrgattgagtgactggcataactttctcaggagtaattatgttgacagccctacactatcaaagttttgtttgctgtgggtatttcatgctggagtaaagggtgcccttccttcagtggcagctatgttcytgggaaactggttgcttcctaatttttgcctcccattttggattttttcacttgtttcttgagcatatgtaacttctcatttcctatggttaaaaatcagctatctgtatttttttttttttttttttttttgaggkggagtctcactccatctcccaggctggtgtacggtggcatgatcttggctcactgcaacttccacctcctagatttaagctattcttgtgcttcagcctcccagatatctgtgattacaggcatgtgccaccacgccyggctaatttttgaggagccaatgaagggacgggatttcaccatgttggtcagggttgtctctaactcctgggctcaagcaatcctcctgcctcggcctcccaaagtgttggaattataggcgtgagccactgcacttggccaaaaattggctatcttgagctccttttgccatgtttgtaataaagttggctccatctactactatgcaatatgtaattaggactttccaccctttctctacgatagcatttaactgtgattttaggagtcatagagccaaagtctgttcccattaacctcacatccagaatcaagttctgccacatgtgactgcagatgaacctgaacagaagctgtggcattgattcggcattagtggtcaaacagtattctgtgtttgcgagatgcgtagtggtacacaagacatttggggacctcagagagcctggtcgaaacacgtacagrcctggtcttagggggtgctttgtgtaatgctcccaggcctggcttctactgtaaggaattcttgtgtggtcctttagtcctggaaataaaagagaaagggtctgtatggttaaattgtgtagccagaattaacatccctttttttgtttgtttgcagccccgggagaagggcaggatgcgttttcataggctgcagaatgtgcagattgccctggacttcctaaagcagcgacaggtaagaccatcacatgccttccccattcttccaggctgtgttggcattggggccctattcagagatgtttttagtgcccctagtaagctctcagtaaatgctaaatctgattgacccagttctgagtcttaacttgctagtgagcaattgtattctggttagagaaatcattcagtactcacacagaacttgtgacctccttgagaggaagaatgttcacggagaagaacatgatgataaagatggaattttgtggatgcaccttaggtgggggtcaaaatgaagatgaaaaataaactagaaaagagatggaaaaaaggtgtggcatccaggaagagagagaaccagattgctatatcaaggtgaaaatgagataagggggtagtgtggattgtggaatgccacatcagatctgagaaaaaggtctaagttgttaagcactgataacttaagtgagcagtttaatacaggagaaagatatttagagtatagtagagctagatataggaagggagaaagaagcttttccttccctggatgaggaagacaacaacccatttttagacataggaagaggagccaatgaagagagtaagaatgaaaatgagcatgaggaggagtattggtagtcatagaacgtttcaccgagaagataccctaatgttgtactagtccagtttcttattatagataaagaaactgagacctggacaggtaaatgacctgcctcaaatcacaagtcagagcaaagctgagactttaactcaggccttytgacatgcagtttagtgcaccttccactatccatgctgctttctacacagcacccttcctcctttgcttcctaactgaaggaaccaaatccagggattgatggatgagaagcagagcacaagtggtgtggccatctttgaaaaagaaaagaaaaatacctcttttgagagacaaggagaatgacagagggaggggtgaagatacagagatggtttgtggtagaaagaagatggatgagggagtcaaagagttcatctgcttagagtgagccatatggaaaatatttgggatatctagggttgccaagcaacaacagggtcaacgtgacattaaatggtatgcatatttttggagtcagttcatttttgacactcatatcagtaattctcattaacttctaaaattctctgtttgctctcataacaatttacttctggtataacatttcttattttcttgttatttctctgtttgctccaatgcattataggctccgtgaggacggggaataagatcttaacatttcaccttcatctctcataatgaatggtcctcagttggcacttaataaatatttgctgaaataaattgataaataaaagtggtagaagtggaggttgctgaagtgtttagggtactggagaaagcagcattgaaatgcctgtgtgtggagctagaggaagctggggtgggggccttactggcagggtttatgagaagaattgattagctagaagtctaaatcaggacaaaaagtggctttggttactatgatagaatgaaaacgtggacaggtaagaacagtggattcaaagaagggcagggagattactagagccgttcttggtaacggtaaagtccaagatgtagctgtgcagatggccaaggtagggaaaaacgaaagtcatcagaattcaaaaggcaggcaatttgtgcagatagtgtaatatttgggatatcaatataaatgctaaatttccaggaaaggtgatgatgaggcaggaaaagagaataggagctaggtagtgaggtcattgagaaaaaggttagcagagattggaaggtggtttggccaagggaggtagacttcacaatgaaaggggaaggctgacagaggtaggactgaggaatgtggacttggctggtactggtaacccaccaactgtcaactgttagtgattagaaaaattgaattctcggggaggggacaggttttcccacttgcatcctactcccaccgtatagaagaggagaccaagatacagaaaagggaaagaacttgcccagatgaatgtcattgtaagggagaaatgaggcctccatttgagaaggtcactagggtcctctggagacacacaagtttcagttcagtagaagagataaagggaggacrgctgaaggacactgtgtcgcaggactctgagggtatgattgaggaggctaacagaggtgaagtagaagtagggtggtttgcccaggacactcccagttttaaagttccacgtcccaggaaattcctccgttcccagcacactggggcagtaagtcagcctgggaagagggtgtgtcagggcacattgagttgttgggatgagattttaggagtaaagcaggtgctgcgggaggcatggcaggtatggatatctgtgacaaagatgggataatggaggtgagagcaggccaaagactggtgagggaagagaggcatctctcttttctgtctttctctctcagaaccttaagaaaaaaaaaaaaaaggcaaagaagaaagaaatcttggccctgatggcaataaaaaagtgacccacaataccttgtgcttgcgaggttgcttttctggtgagaaagcaaaatggcgtagctactctgatgacttcttataaagctaatcatatatcatataacccagcaatcccactcctaggaatataccctaaagaaattactgtgctcacacaaaaacctgcacatgaatattcataattgccaaaatctagaaataattcacatatccttcgatggatgaatgggtgaacaaagagtagcatatctctataatggaatactactcagcgatcaaaaggagcaaactgttgattcatgcaacagcttggatagggatctcaagggcattatgccgagtgaaataaaaagacagtttcttttttttttgagacggagtctcactctgtcgcccaggctggagtgcagtggcacaatctctgctcactgcaagctctacctcccaggttcaygccattctcctgcctcagcctactgagtagctgggactacaggcacccgccaccatgcccggctaattttttgtatttttagcagagacggggtttcaccgtgttagccaggatggtctcgatctcctgacctcgtgatccgcctgtctcagcctcccaaagtgctgggattacaggcgtgagccatcgcgtctggccggcagtttcaaaatcttgcatgytgcatgatcccatttatccaacactctggaaaaagcaaaacaaggaatcaggatcagatcagtggttgtcaggaattaggggtgagagtagggtttgattacaaggagggggccagcacaagggacctttttggggtgatgaaactgttttgtggtggtagttgcatgaatctatacatgtgttaaaactcatagaactgtacaccaaaaaagaaatcagtttaactgtaaatcaataatgaagtgatgcaaaaatttaatcaaaacaaaaagtcctagagctctgagccgtrcttttatttctttttcaggtgaaactagtgaatattcgcaatgatgacatcacagatggcaaccccaagttgaccctgggtctgatctggaccattattttgcatttccaggtagggcatgtgaagtttggaattcctgttgctttgtttggacatggcctagaaagttgcactgccttccacagacagcattgagccttccttctctctatttgtcagtgaacaaaggtggatgggagttggaaaggaaaattaagattgatctgcagacaagctgttgtatcgtaaacgcaaaacttcctaattatttgcttaattaaatggagggayttttttacccatttgtggtttggccctgtcctcagcagtctggttattagaggtctgtttgctcagctgaatcaaaatgaggctcttgaaggactcagaatatgagggttgagaaaagctgttggtgttgatgctttagaatggtggagtgaaggttcatagtcctgctctaatgtagactttttctcatctctaataacctttaaacaagcctcgttaattagaatactttagtatctgggtttgtatatgtgctggcaagcacaaccttgcagcggccatcacacccaagagcatcttgaagaatattcacatggtcacatggccttcctcttcctaagaaggcaaatcctttttagatctgaattgctattggaaaagtacagccctatttttataaaaaggctgttcttttacatcccttttaggtcagccaaacaaagctatttctcagacagctctctctgatacacagttgctgcacatgaggctgatggattagaggctgatagctagtgggaatagaaggcagggtgccgacttcagggatgaggccaaggtgacatcctagctggggagttggcgctacctgctggttaaagatagaacaacaggtgtccccgaattcctgagagaaaaatctgagtgcttaggcttgtttcttgaggctctagtttggaagcaatgctggcagtcaccagcatggacagggctaggattgtgtggtggtaatgtatttttgtggaaccacagggtatcctcaggcaagctttgggcatagggataaccaggaacatgaacttggtaggtgtgctctgtctggcaggatgggaaactttgttgagctttcatggaggactacagttatccctttggaactcttaygaacagaggagcttttagagaaatttgtttgttttttggtcacaaacctgccctcactgtgagtgcccaatgtttgtctcataggtgggaggtaaggagaatttattcactgtctctattcaccccaactactacaactaaattaatttcctttttttttgaccgagtttygctcttggattgcaatgatgtgttcttggctcactgcaacctccgcctcctgggttcaagagattctcctgcctcagcctcccaagtagctgggattacaggcacctgccaacatgcctggctaatttatatgtttttagtagagatagagtttcaccatgttggccaggctagtctcgaactcctgctctcaggtgatccacccacctcggtctcccaaagtgttgggattacaggcgtgagccaccgtaccaggccataacaaatgtttaaatagagaaaacattttcttttcttttttctttttctttttctttctttctttttttgttttttgagacggaatttcgctcttgttgcccgggctagagtgcaatggtgcaatctccgttcaccrcaacctctgcctcccgggttcaagagattctcctgcttcagccttccgagtaactgggattactggcatgcaccactacacccggctaattttgtatttttagtacagggtttctccatgttggtcaggctggtctcaaacttccaacctcaggtgatccacctgcctcagcctcccaaagtgttggattacaggcgtgagccaccgtgcccggccagaagaaacatttccttgaagcatttaaaaatttcatttctttctgtttactagttttcagaataattagttggttcgctaagattctccaaaggtgaccaataatagttcctttgttcaccattttttttttagtatcactgtgacttgtggatttttaagcagacttaatgttccaatcaaatacagttattattctttttaataaaatcaaatagctccatctttggctgtaaagaggctttcaagttgactctgagtcctttggcatgaccacagtggtctttgataatttcctttatttcttgtgcgatgaggtattccagactctttttttatattttctgtcccaggcctgaaattcttaatctcccctaggaactggttctctatttattgaccacagtctgaatgctcctaggttgcccattatttctttctttttcttttctttttttttttttttgaagcagatttcgctcttgttgcacaggctggagtgcaatggcaccatctcggcttaccaaaacctctgcctcccaggttcaagcgattctcctgcctcagcctcccaagtagctgggattacaggcrtgtgccaccacgctcagctaatttttttattattagtagagacagggttgttggccaggctggtctcgagctcctgacctcaggtgatccacctgcctcagcttctcaaagtgctgggattacaggcgtgagccaccacacgcggctggttgcccatcatttctaggctttttctgtgggcagagctaggcaatacttgtattatctctaaaaacaacaacaacaacaacaaacaaacaaaaaaccccatgaatttttactgatatttctaattcaaatttaggattgcagggttttgtttaacctctttgactttatatcattttttttcttatactgaaaatcttgatcttaacaacagtaatgtggttacttactcttttcctacacacacagagatctgtaaaatcatatatattatttgtaatatatatgaatccaagtgacaatatgaatgttattgttagcagtatgattactttgaagtcacttgaaataatttctctctattgttgttaagccacaaattcaatacacarttaaggttcatttgtttttatttgctttcagttttggggggttgcttttttcctttcaattttaccttacattatgtagatcatttatattgttccaaagggaaattttaaaaagttaaatacaaattgtgttcagagaggtctagcttccatctctgctccctccattctgtatcttcccattctctgtagttagctaaatgttttaaaacacctttttggttataatttctattgtttgtttattttaggaaaatgcattcataaaaaaaactttactgaggtgtaatttacataccatcaaatcaactaatttaatgatttttatgagttgtacaatcatcaccataatctagtttggggacattttcatcatccaaataagatccttcttgttcatttacagttactgcacattttcatcaccagcctcaggcagccactaatttattttctatcttgatagatttgcttattctggacatttcatataaatggaatcctatgatagatggtcttttgtatctggcttttttcacttaacataatattttttggttcatccatgttgtggcacatatcagtacgtcattcttttttattgctgaatattctgttgtatggatatatcatgtattttgtttaaatattaagccagttgatagacatttgagtggttttcactttttcactgttataaataaagttatttgcataccagtctgtgtgggtttatgttttcatttctcttgtgtatacatgtatatacctaggaatgggatttcttaattgtacagtaagcatgtttagcttttaaagaaactgccaaattgtcttgcaaaatggtgtatcattttacattcctaccagcaatgtatgtggtttcctgtgtctttacatcctcaccagtatttattgtctgttttagattatagctatcacagtgagtgtgaaattgtatctctttgtggttttagtttgcaggaaaatgtattatttaattgaattccacaaacattgactgggaatgttatgagcaaggtcttagatagagtgtatggaagatacacggctgagtgcaatggctcacacctgtaatcccagcacttcgggaggcctaggtgggcagatcacttgaggtcaggagttcaagaccagcctggctaacatggtaaaaccccatctctactaaaaatacaaaaattagccaggtgtgttggcgcactgtagtcccacctacttgggaggctgcaaagcatgagaatcacttgaacccgggaggtggaggctgcartgagctgaaattgtgccactgcactccagcctgggctacacgagactccatcacaaaaaaaaaaaaaaaaaaaaaaagaatctactacagaagatacaaaattgaactagatacagaccatctagttggactcttattgtttaggagagtgagaacagacataccataaaataacttgacagaggtttagagaatgagagaggtatgggttaggatgatggaacacagtatgaactcaacagtgggcagcagttactagtaacaacttattataattattaattgaccttataacttccagggcttttgacacagcccactgttctttttcctgttaccaattttacagaaaggtaatagcagctttggcctagtctgtcttctgcatgcatattggctgcctgcttttctctgttatttcagcacagccaaatgcctatttatttgtcttcttgtaggtgggagcmccgctcccagaatattttctcagttttaactatggattccttttctttgccgttctgagggcttggtatttgcctatactagctaagtgttctggtgtgtggggaaaggttctctgcttgtgaagcttttgattgactactgaaggatcatgtggagtgcccccccaccccccgcctcgtcttgcatcagatttggcatggtatgtcttttgctagttatctgtcattgtggttttctagtctttcattattgagtatctattagctgttctcaccaagaacatatgctatgtaaagccaaatggaaatgcagagtagaactgttacatgttagggaatcagcaaaattgttattatggtcagtctgtgttattggtgttaatgaagtagaataatgatgtacctgtagacatggatggtagttttcacctcaagggaatattcagttgaaggagaagggagaggctggatccagattaaagrtttgtgactgctgatgaggctggtaatattgataacttcatgcagaggtttatggtttctaaaatgctttaacacattttttttaatgtgctaaatggtagatgttctttttaattttaatttgagtttttagttttgaaaatctcaaatactcggaagagtatataacagatccttatgtgtgtagttgccttcagaatttaacaggtgttccttttgttatatttgcttcagggttttttctctctcttcctctttaaagtaataaaacatctcagatacatccaactttctttgccctctctgctccccaggtaaatattatcctaaagttgatgtgtatcattcccatacatgcttttgtacatttacagcagatgatctattcataaacaatatgtactgttgcttgtatgtctttatatttgacacacatagtatctttggtatatcctttctttcatcttttttcttttttctttttttttttttttttttttttgagacggagtctcactctgtcacccaggctggagtgcagtggcgcgatttcagctcactgcaagctccacctcccaggttcatgccattcttctgcctcagcctcccgagtagctggggctacaggcgcccgccaccacaccckgctaattttttgtatttttagtagagatggggtttcaccgtgttagccaggatggtcttgatcttctgacctcatgatccgcccacctcagcctcccaaagtactgggattacaggcatgagccactgtgcccagcatgatttgttcattttaactaatttaatgtaagtggtgacccctgcagctgtgtaacacatctattatttgtaacgtattatttaattgtatgaataaaacattcattgctacagtgaacatctgtgtatatgcatccttgtgcctatagcaaagagggttttgggattgatacctggactggaattgctgggttatatactttccttcagtttgcctatattttgccaaattgctctcaaaggtactgtatgacttacagtattgtattgggtaacatttactactatttgacatattacatgtttacttgtttatttgctgcctggatgcctgcattagtatgtaagcttaacaatggcagggatttttgtctcttgttcttttctttgcctggcatagaataggcagtcagtaaatatttattaartgaatggattgtttcatgaatttgatcttctcaaagctttggagtaggtagaccaaataaataggctgtaatgtctgttttcttatgcccatttctcagataaggaaactgaaacacagagaccgactgacttttttgggttacacacccagataggatttcttttttttttttttttttttgagacggagtctcgctctgtcgcccaggccggactgcggactgcagtggcacaatctcggctcactgcaagctccgcttcccgggttcacgccattctcctgcctcagcctccccagtagctgggactacaggcgcccgccaccgcgcccggctaattttttgtattttttagtagagacggggtttcaccttgttagccaggatggtctcgatctcctgacctcatgatccacccgcctcggcctcccaaagtgctgggattacaggcgtgagccaccgcgcccggccaggatttcttgtcttttggctttgtccaagcttgttttaaggtataggttaagatttatagttcttctaaaagatactataaactctttataggcagaatctgacaaaactagttttccaaccctcaaatgtttgttaaatactagtgtatgcctagcattttgaaattttcaaaaaatgggaggtcttagctggctagacttgaggtttacagttttgtgcactttatggcacttggtgcttggcatatagatgaggcaccatttgtgtttttggaatgaatgaatgaatgagttcttttgctttggagtctttcactctggctgtctctgtgggagacctgtgggcagtaaacagttatctacaaaaagccaaaggagaaggcataaagaatgtataggcctcaaagtgtgctttcccagaaggcagcaagtcttgtgttaagagaccaggttagatgagaaaaggtcttggggaaaggtctcgtaatcagaattaacttagttgaaaatacatctratatacctactgaaaactatagtttagcctatcttaaatgtattccgaacacttatattagctaaccgttgagcatttggccaaaatcatgtaacacaaagcctgtttgatagtaaagtgttgactagctcatgtaatttattgagtgctgtactgaaagtgaaaaacggaatggttgtgtgagtacttgaagtacagtttctactgaatgcatatggatttctcaccactggaaagtcgaaaaataagctggaccattttaagtcagggaccatctatatcttaggatccccccgggggctggggatgtctcataacttttagttccagtaataaatgggaagaaaagaaatttactgtaggtcaagtactgagccaagtacttyatggacattatctcattaaccttgtctacaatcccagtaagtaggtggtagtatgcacattttacaagtaaggaaactgaaccatctaataaactagttaggttacttaacttatgagctgggaagttgaacctaggtccaccttactgaaatctctgctccttccctagaccagtttttctctggagcagaaggaaatgaaggtctgattggtctgacatatgcagaaattttaaaaaaagaataggctcacagaagtaaattctcagagaaactctacagcagtagtagtcatattaagcagctatttctcttgcctctaagtttattagtttcaggattttggtttgcttgtatgtcattcataaaattcaagtgcatcttaaagttcccatagttccaggtttcttcactggaggagtgaaggcctggtacctgcctagagaacttcatattgtaatgtcagattctttgttaattaaatgatttgcagtagcatgagtttctctcccatgctctctgcttatttcttactatagtttgtgatggccataagatggtgctgcagttttgcagtcagccttaaggataaggcttaggggaagaacacctactgcagttgtgaggcagatgggacatcaggagggtcttagaagggattgtgtaaaagccgttgctttagggcttcttgttgctttccttttgtggtcttttccttttttttttttttttttttttttttcaggtcyccaggaaagatagttaaggctatgctagtgtaagtctttatggcttgcatggaaccaggcaggctactgctttctgctgtgtggcctggatccttttgttgtaraataaataactgcaataggaaagaaacacatatataattttattctccattcacagccctttgggttatagtcttttcccatatagcagatactatactaaaaaaaattggggtggaggaatcttcactgacatcacaaggtgatttttgaatccgacttttacagtctgaaattcasacttcctgccctactgcaatgggagtaaaaaccacctgaacctctttttggcagcttcttctcttactcccaaatggcaacaagtgttatctctttgattgagctcttggtccatgcagtctaattaccaattcaraacagtgggggaacttcttattttacacaactggcaactgagtacagatttccactactgcagtagttagaagagagtagttggggttgaaattaaaagtcttaaagttaacagaagttcatgttctggctttgtcacttactagctgtgtaacctagggctattaatcaactttcttaaacctcagtttcttttttyytttttggagacagagtcttgttctgttggccaggctggagtgcagtgacatgatcttggctcactgcaacctccacctcccagttcaagcaattctcatgcctcagcctcctgaatagctgggactaagggcgcatgccactgtgcccagctaattttttgtattttagtagagacggggtttcaccatgttgcccaggctggtcttaaactcctgagctcaggcaatccgcctgccttggccttctagagtactaggattataataggcgtgagccactgcgcctggccaaacctcagtttctttaccgataaaatataaaataatagttttgacctcatatagtgactgtaagaattaaatgagaaagtccatgtaaataactttacacagtgcttggcacacagcaagtgcaaaaaatatattagatgttagcagtggcagcatcaataattactattgaacatttttgtcaaatattgttcatcagagaccctgttcatctgttgtatttagaagtggtattctttttaccaagcactcatttactgtactcaaaaccaacttccagatttttcctgtckgtgtcattggctggcagaattaacagatctttcttttcttttataggaaaaaggagggaaataaatgctccagaaggctagatctttaaagtctgtgttccttttcttaactgtaagaagaaggctctggtttcttcaggttataatttcattaaaataattttattgttttctgacctgaaaaaattcagaatatgtatatctgcttgatattttcttttgggcatcttggtrcaacacttaaartctatttcattttgtagtttgggagccataattgcagcttcaccaggcttggttcttcttggcccgggcccttcccttcccttgctggttagtaccagccgagctggtttgctttttccctttttgrtactattctcctcctccttcctccacgttaccttctgccacggcctctcttctttttccctccattttcaatttacacttacattttccctcctcctcctggccctccctagtttytcccctcccctggtttctagctcctttttgctttctgtttgtgttactgagggcagtgctccaattacctcatatttggagagaggaagctgcagccaatccggtttctgtctgcttttaggtcaagtgatttctgaactgcagtgagatgctttgaatttgtcttgttgcagctctgagcctgtaagatggctgtctgaatcggcagcggctggaagagacagagagaggcggggagggagggagaaagaattggagggattgccggcatagtgcatgtttttaaatgtgcatcgaatccgatgaggccaaggttgggatttctgtgggatcccaggactggcttagctgcgtttttgctgagattaggagaggaaggaaatgggaaattcactgggctgttttaaggagccgaaagagtcaatagctattcctgagaaggctcccatatctcctaagaaaagggttcggttcaaaaggaggtggagagggaagaaaatccctactccagaggcatctcaccaggaagaaacctcagaaggaactggagtcattgaagagactgaaaccctaacgaagttaacagagagtctccaaaaggaagacggagtgggaggggtagagcatacccccccagatattttgctgcctggggactcagcccccaactcacgggtagtcgatcgggggatgatagtacaggtaaaggagagattccaaggggaggtccagaccgcccaccttttgttagagaatgagtcatcagttgctggaggggtctgggattccctggaagaggggatgactgtcattgctcacctgcttgataacccagcagaaaggaactgcgagaagtcagtgagccaactggtggaatttcctaggacagcatcctgcagcagcagggctgtgttgctgcctttgcaaggagagactgcagtggagaaaggaaatattcagcgtgggtttcggagctgtgctttgcctaggacagactaccccactgataaaggaaatcaagaacaattttcagagggctggagtgtggaggaaggaaccaagagtgtttcaggtgcccctcagacagcttcctggattatagaatgttctgtttcttcattactactggaccagcctggaggccaaagacgcacggagccttcccatgtgggtcaagtgcccccccaggattccagactgcctacttctcagagtgatttgtccatcagtggtgtgactgtgagcattttgccctcctcctctggctatggcagtgatgggccacacatacatgggatccagcctaaagatacagaacctgaaaagagctctacttccttctcagaagaggatggcactctttctctggaggcaagccacaccccatcatggggtctggaagaggtaggtgggcatgttcaagagataatcaaactgctgtttggattcttggccctcaaacatattaaagctgagtgtggtgagcagtgaggatgttggtgcctctcaaacttacccccatgtgggttagtatctgctggagctcagcaagcagaatctatttcaggtctgccccttgatgcttgaaaccaagacttgtctctggggaatccctgattctgagtagccaagtggcgtaattgctcaagctatctggtgggatgatctctcaaggtgcaatgctagatagtacttactctcaggcaggtctgtttaccagcttccctgctacgagaagttgtaatgtagcacaagagacgatggggaagggcctaactgaatctctggaatgaatctctggaataaatgtggaaggggtcaggcagctgttgtcagtgtacttgctcttcctcacaggagagtgatattcttactagagctgatgcaatcccatccctgttgggaaatttctgacggcagcactcattcagtatttgtataggtggagagggctcatccttctttggttcctaattccaggattagaggagagggacagagttatctggggattagttgagagagagagagggaggttagggcaatttgaaggtttaaggctagaaaagtttgttttgtgactggatgtatttagggctttaacatgattttgttttgaggaatatattgaggcatggatggtgctgctggtggtggtggtaatggcagtttctgtgaatgttttaaaggtcaaggagcaagtgagaattcagagatgtgaacactgagataaggactcagcaagaccatgggtagcacagcatctggcatgtaggtgtgtgattgtgtgggtgattgaagttataattcaccaatggctaaagaacttttactgggatgttggcstctgcagcagaagaaataaaaacattaggacttcaaagtgcaaaatttataaaatgaggtagggcactttccttgcctagatgggggccactgatactgtacaggggccctgatgtttgcagagcagggatatggtctacctactggtgccctgcctatcactagcagcataaggctgaggatagatacaaattctgagcaatctgtgcctagaatttcctctttggggatacattttccccacagacagccccatcttagtgccctctgttattagagtttggagactcccaacaggttgaagaaaaagtggccattgaaaaaatatctattttatggatgggcaagaggtttcttgggcctcatataaacatggatatgtgtggtggggagtgtgatagttgtgttatggtaggaaggaaggcagtgaaactactgggatatggggcgcatgaatgtattaagctattcttgcattgctataaataaatacctgagactgggtaatttacaaagtaaagaggtttaattggtatacagttctgcaggctgtacagaaagcatgatgctggcatctgctcagcttctgaagaggcctgaggaaacttacaatcttggtggaaggcagaggagcagtaggcatgtcacttggctacagcaggaacgagaggttgtgggtgggatgtgccacacacttttaaatgaccgaatctcatgaaaacccacctaccctcacgagaacagcaccaaggggatggtgctaaaccattcatgagaaatccactttcatgattcatgatccagtcgtctcccaccaggtcccacttccagtattagggattacaattcaacatgagatttggtagggacacagattgaaaccatatcaacaagtatttgggtttcatcagataaaaaagaatgtcaaagtcaacttttatcttgtaaaagttggaacagatagagtagttgggggtaaaaccagctgtggaactgattgttgtacaactggcattaaaattgaaattgtgtagtcatcataacattataggacacatgcttgtaactgagtgtgagattttcagaaatttggcatataaagttttaggaactcctagtaaaatcaatcctagataatagaccatagatagcaatggcacctttgtatgggctggatctccacactggcaagggaatgttctgcatgagtctgtgaggagtcttaaagaaaagattgttaggagaaacctttggaccatgatctgtagtgtgaccatattggcaacagtatgattcctttgytgttcagtatgattcaaattggtgtgtggcattttctkggtagccaacctctgcatctattccttctaccttttcactgcagacacagtcatactacttatgtatagccaaggctgaaaaactaagtgaccgagtctcagctcagacacctggcatatttccaggttttgtgtccatcatgtgatacagggaccacagactcaccatcctatatgacagataagaagtaacttatcaagataagtgtgacattccttcagaatgaaagtccttaaggccaagaggctgcaactctcactggtcyctgaaggaactgtcttcagggagctgctcccctccctaacaggctgttcacaggcttgaggacagtagcagccagagaaacagagagggcaacgcatactgaaaccrataggcagggcaagagcatctctgctaaagtgggaaagctgggagggcaagggtcagaagagcagctgctgctgttcacacaccaactcctgtctaaacaggagacagctggcagtccaattgagttgttttttgcttgcttttttggtggtggttttgtttttaatatgtcagagtagtaactatcctcagaaaataatttgagttccagccagactgtctcctctgttgattagtccagggcttgttgatgagagtgagaccaggctatggatagacataaacttcaccatgggttttgttgctttttaggatggagagaaatgggaactgattgtgcttcttgctagtgtagggtttagatagtagaatatacatgatctgcttttctattcacctagtacagttaatacttcttttgtcaagaaatagttaacacagaagcaagatgacaagggtcagctgacaaatatgttttcagaatgacaagtagactaggatttggagctggatgggaacaggctaatagcaatcgctctttgatgtcagacaaaggccttcttctctggcccatttcttctctcaggactccctattcccagctgctttcaatatccatactactaatacctggcttatttcaacaaggaacatttttgaaaatcccttcctcctccccatcttgacttctgctgccaagctcctgcccaccttgttagcgaatcccatttaatgaagcatttacctctataccaatttttttttttttttttttttttgacacggagtctggctctgtcaccgaggctgcagtgcagtggtgcgatctcggctcactgcagcctctgcctcccgggttccagctattcgcctgcctcagcctcccgagtaactgggattacaggcgcccgcccccaccacgcccagctatataccagtgttcttgccacaacccttcgagtctctacaattttaggtgaatagtcagataacactggggcctagaaatgrtaagaaagaggttggttggtgtattatcttctgggctcagccttttcagtttacaagtatccctctcccagttttcctttttaattatagggagagttgttttactaatactggctttgtactgaaagaagaaagcaaaattaaccagatgacactattgggggaatgcagaaggtaaagttatagtttagaactttaagaaaggattttgtttctttttctttttttttgagacggagtcttgctctgtcacccaggctggaatgcggtggccctacctcagctcactgaacctctgcctcccgggttcacgccattctcctgcctcagagtagctgggactacaggcgcctgccaccatgcccggctaattttttgtatttttaatagagacagggtttcaccgtgttagccaggatggtctcgatctcctgacctcgtaatccgcccgcctcggcttcccaaagtgctgggattacaggcgtgagccaccgcgcccagccttgtttctttttaaaaaaattttacttaattaaaaatgttactaaagaatcattattttttaggtgtaacaatagtgttgtggttatgttttaaaaaaggccttttacagatacatactgaaatgtttttagagaaaaacaggagatttactttatcataataggggaagggtgaagtgggtgggatgtagatgaaacaagattagctatgagttgataatggttgaaactgggtaataggtacatagggacttattatactattctgtctccttttgtatatatttgaaaatttccatttcaaatagaaaattaagaaaaaaattgtataaaaataaaatgaaattaaaaaataaaattgtataaaaataaaatggaaagttaggcaaaataagttgtataaaaataaaaatgtaataatactggtaaaattatgatataatacatatacagttggctctctgcattgtgggttctgcgtctggggattcaacccataacggatggaaaatattctgaagaaaaacattgcatctgtaatgaacatgtacagacttcattattccctaaacaagataacaactatttactaacatttacattgtattaggaattataagtaatctagagattatttaaagtagctgggaggatgtacacaggttgtatgtgaatactacctcattttgtatctgrgacttgagcatttgtggatttcagtatctgcggattttggtatctgagggaggtcctagaaccaattctccatggatgactactgaaaaggggttactatcctatagataaagtgattaagagcatggagccagattggctaggtttgaatcccaattctgcaacttactagcagtataacttggaacaggttactaaacttctctgtgctacaatttccttatttgtaaatggaagataagaatagcatatgcttggtagggttgttgtgagaataatatgaattaatacaagtaatcacaataaatgctagttaatattattamttaaaagaacaagaaaatgaataagaaaaagacaaacacccttgtagaaaaataggggaaagcccaggaataagcaattcacaaaaaaaggaaatccaaatgcctcatatacataagaagactcctttttactaataaggatatacagatcaaacaacaataagatactttttttttttttttttgagacagagtctcgctctgtcgcccaggctggagtgcagtggcgcgatctcggctcgctgcaagttccatctcccaggttcacgccattctcccgcctcagcctcccgagtagctgggactacaggcgcccgccgccatgcccggttaattttgtttttgtatttttagtagagacggggtttcactgtgttagccaggatggtcttgatctcttgacttcgtgacccgcccgcctctgcctcccaaagtgctggaattacggtgtgagccactgcgcctgtaattttttttaaagagatgaggtctcagctatgttgcccaggctagagagcagtggcgattcacaggtaccatcatagcgcacagtakccataaactcctggactcaagcttgtagctgggactgcaagcacaccaccatgcctagctaagataccattttatacccatcagattggcagaaggtaaaaattctgaaaataccaagtgtaggcgagratgaagagtgatgggaaaacctcttcatagcacttaagtggaagtataatttgctactgttctttagaaagtagtttgacaatattttgtagagttgaaaaatgcccatgttctattacctagggtttccattctaattatattccctagtgagacctccaggactctgaatgtgaatactgaaaggagcactcccttttacctaactctaatattggtaataaacaccttctttatctctgttcctcaccawcatagctgccattagatccctctagctgggcatttgtagaaccactgcattgtgccttcatctgcttcttcttcttcttctttttttttttttgagaaagaatcttgctctgacacctggctggagagcagtggtgcaatcatagctcactgcaaccttgacatcttgggcttaaacgatcctcgtgcctcaacttgccaagtagctggcactacaggggagtaccaccacacccagctaatttttaaattttttgtagagacaatttctcacagtgtttcccaggctcgtcttgaactcctgggctcaagtgatcctcttgcctatgcctcccaaagtggtgggattacaggagtgagccactgcacccagccctcatttgcttcttgaaagttttcaaggtctgatgctttatctttagtgggtgatgaggtcagctagaaacttgaggacatartaatcaagtacttacttgctcagaacaactcgtctcatccactgagagrcttaccaagtccaaactcctcagctgggataagataagataccaagtcgaaactcctcagctgggataaagataagatagattaccagttcctttgtaatctatcttatcttttctatcggttcccaatttaaaccttctcattttaacagatcagtcccttaactactatttctgtttcaccttatctcagtttgtttacatccactttctacgtggaattcctttcttccttggctttcacctgttctgtaacacccttcaaggatgagtttatatggtacttctagaaatcctccagcccacagtaattttccattctgctgagattctgtattggatattactataattattggtcgtttttggctataaatttgtttaactatttcatgtgacctaccatagatatgagatttttttcgtccagaaattaaccttcagaaaagagatattctctttatattttacttcttataaagcatttcttgttattaggcttccagggagcttatagtcagttcatgaaaaagggtgaataaatctatgtcaccatctgctagttcaatcactatcatttttttgtagagatcaactgacataattgatyaaacaaaaaagaggaatgaaaaatctaagaaagttttagttattgttcctgggaatataatctcctaatttgaagtgttgaaagtaattgtatacaagccttaacattaaaatttttttttgaatcactcacattgcatatgaaacatacacatacattatggggatcacaaataaacacagcagaatgaatgaaaaaaaaaaaaccctaatccagtgttatgtaactggactcktgtggtttgaaatgaaatacccagagacaatgtagattcagaaaagtgctgttattaactttaaaatcttagaaaagtagacagtattttctagaaaattcactaaaaagatagctttattgaaggaaaaaacattgatgttaaagatgcatgtgaagtttgaataatacagttttttgaaattacaaaggcagaaaatacattaatactaaatgcttaaatatactgcttaattttaaatatgtgtatatgtgtaaataaatttctaaaagtttgggtattcaggaggactacagagcttcccttcctgtattcctgttttaccttcatacatctgttgttatctgggaaaatatttgggataatcatatgttagttatggcatgtctcaactaagttcttgcaggccaagcatgtcttctttttttgttttccacctttttacctggccaacttctacttattaaaactcagcacagatgttgttgttgctgagcaatcctctggcattgctagtttggattacttgcttacctctgtcacaacattgatctctttgtatagtaaattgtctccctgattaaattgcttgaacttgaggcctgaggctgtgtttttttattttgagatatcaagaatttaagcacagctcctagaatataatggttgctcaaaaaatattaacagtataagtaagtggtgtgtcttttcttgttcttctccatggtgccagtcatagtgctaagatgttgttcagtcaatacttattgaattattaggaaaacattcagcttctgggaatacttcagagaagcaattaaccaagctttgggaagtgtgagwtgaaaggaaattcaagtggaatttgcatattctcaggcatactgttgaggctgttctccctctccaaatggcttcctccttaaaaagcccagatgagggagaaagatctctgaaactaaagctggatttctgcatttgggagattaaggtaaaagcttctgcatagcccagagcacagtactgtgcacacatatcatgtgtgagtatacagaaagarattgatgaaagccaaatttaattactgagatggttgtgatgataatcccatttttctcatccagtttccagtctaggtaatggccctaatccaaacaggtattttatttttctttcccttagggatccaaacatctatctcattacaactatgtttaaaatctgaagtaaagctgttcattgaagtagttttagtgcaatatacagaaatactaagaaatgagagatgttattagaaagattatggctgtaatgaacatacaatatcaattaactaactggaatttcatttttgggtgaagaacccaaatactcagattttgttttgcttattcaagttctgtcttgttttacatcaacaaatctatttcctgttcccaataatgttttactttaatatgtacgtgaagcagctacagtgaaggcagtgggatatatcaatgttgcatttagccagtgaaataggtagctagaaatgttaaggggaactgaaatagaattggtactaggaagaagctgtttataggaagagccgtgatccattattgtgtccttggctctgcagctccatagcttctctccccactaccgcccctcccccagccccaggtagatctggagttgattaatagttttagtaaactgactcacactgatcacatttgcttgagattggtckatgtgaatttrttaatttacaaaataaattttaactgccaagtgattcaagaatttgaattggccacttactgcttttgttgctttagaatatctatatgggaagcaaataataatctgaaggttgtcaggtgaacatgcagtcagagcagagaggtggtgagtagagraatratttgtaggatgggcttattagctggcatcatcaaagtagaatagtctgatttcttctgtagaaatgtacctgtcaagggcataagatcctatgtcccttgaatctgctgggtagggtacagtttcaccttcacaggcatggaggcagtacttcctggcttcccttttctgtactcaatgcaagcttcccatactcttctattctcacggtctttcttcagacatcttagtaatatttagtagcctgcagctttcttttattctaaatatagtgttaaagttcctggcccttttttttttccaattttaaaatatcatctgatatttaatctcatctattatgagtttgtaaattcagacacttggagatgacttattattgacttctcccttgtattgatcacaagggaagctactactttcatggtactgcacctgatagagacgactaagagacaggatgttctattgacatgccggtgttttctctgccccaacacccagaccaaaaattgtgttgggtatgctgtcttattattatgggaagggaatacatgtaccctcggcactatctacatcatcttatttaatccttataatgatcctttgagaaagttattatcctattttaaatatggggaaaattgggccaggaggcttacatggtttgcctgaggtcacatttctagtaaatgccttctttcaaacacatatctgtctgaatgaaaggcttaacatttttccttgttaacaaggattgtttttatactttttattataaaaataaagtgtggtcattactcgaagtctgaaaaaaagaagagtagsaagaaaaactaaagtcattcatagtcccactccagaggagacaaatataaacttgtttactttacacagtgctttgaattagctaagtaacctgtctacagattctaggtgggctttatgccagaatactttttttttttgagacagagtcccgctctgtcacctaggcgggagtggtctcgaactcctgacctcaggtgatccacctgcctcggcctcccaaaatgttgggattataggtgtgagccactgtgcccagcccccaaaatacttttatttgcttatttttattatttcattttatttttattatttcattcataaaccaagttattattaattaaaacatgttaaggtcccaccatacaaccagcacaacactaagtgcaatgggcaatgcaccaaaggactgtgatcaatgattctcagatttggaagttatttcgttcacagcatcttagtttctgcttgacacgtccagtggcgaggagctctcccacatagggtttgctgttcagttttatattgctctggttgttaagatgtggtgccagcccccctcaggaaacgtgcagtctaggggagataagattaaatatatgaaataatagtccataatgcaaaataacatttatttatttatttatttttatgtttttgagacagagtctcactctgtcgcccaggctagggtgcagtggcacaatttcagctcaccacaacctccacctcctgggttcaagcgattctcgtgcctcagcctcccaagtagctaggactacaggtgcgtgccaccatgcctggttaatttttatatttttagtagagatggggtttcaccatgtcggccaggctggtctcaaactcctgacctcaggtgatctgcctgcctcagcctcccaaagagctgggattacaggcgtgagccactgcacacagcccaaaataacatttaattagatgatgatacagactgtcagtgctgtgggagttagacaagtaagaatcgaaggaagaccagccttcaaataaggaagagataagggaacccttatttgttgagcataaccctgagtttgggttaggtgctttaatgtgtaatctcgctgattatcacagcaaccctgaaaaggtggtattagtcccactttgcacacatgagacatgcactttttcctcacctgcattatgatctccctaaaataggtcttgtgctgtattttggagatttcttaaaatagcttttttcttattataaaaatgtacaggatgcagaatatttggaaaatataaaaatcccctgtaatgttactccatagaggtaactatgattattagtttgctgtatttctcacatacgtacagtatttgcacctgtattgcatacataggtgcgtgtgtatgccttgtacatatatatgactgtatacttaaatgtatattttgtatgtcttttatacaaaataatcaagattactatattattttgtttatattctttttcttaaatttggtaatcattgtcctatgtcattaaaattttctttgtaaaacttttttatttacttttttgagatggagtctcactctgtcactcaggctgcagtgttgtggcatgatcatacttcactgcagtcttgatctctcggcttcaagtgatcctcccacctcagcctcatgagtaactgggactacaggcatgagccactgcacctggtgtgaaattttctaaagcataactttttaggtgctacaaagaattctattctgctataattgtgctatgatttataaccagtcaacccctcattagaatttaagctttttataactttttgctaagtcatgtttattatgctttgataaatattcatgcataaaattatttgtttatatttctgatgacttcctatcaagttgtatgtatgttttaagacttgattcaaaactgacatccagagaagttatgccattttatactctcactagtggcggtgtatgatgatacccagttgtagatcttctctccartcgtgaataatatcattaaaaacaaacatttcctagtttgataggtgaaaaattacctctcatggttttaatttgcatttatttgactagcaagagggggaatatatgttggaatagtcctctaaagtgcttccagccttggmccttcrttttactaagagccataatgtatggagaagagaaggctaaaagactttgtcttatttataatgaattattctgtgtcccatcttttggcagatctctgacatctacattagtggagaatcaggggatatgtcagccaaggagaaactactcctgtggacccagaaggtgacagctggttacacaggaatcaaatgcaccaacttttcctcctgctggagtgatgggaagatgttcaatgcactcattcaccgataccggtaagaacagtggaatttctgtgctcctgcagggctttttctcatctcttgtttgtaattagttataatactgtttccatcycctcaatcaaaaatcaaagctttgattcatttgttcatttgaaaaagaaacatttatttaactacttttctaggaactgggtacaagtagcagtgaagaaaacagcgaaagttcttgctctcatggaacttatctttcagtarggagaataggtaataaatgtatgccatcaagcagtggtaaatgcaatggcaggattagaaagtggcagaggtttgtggtactttggacagggtggtcagagatggcctttttggtgagcgtgttaaagcagagccatgagggagtgagtcatccaggcttctggggtcagagtgttccagtcggaagaaatacaaatgcaaagggcctggagtgagggcttgcttagagtggtttagggacagcaggtggctgaagtgaggtgaggamgataggaattctgaatgacaaaaataaaaattgttgagttcttagtggtcataaacatgccccaattttcagttctaaccgacgatatttttcccatgacattcaacaaacctaaactgtatgtttaagtttagcattagggagcactgggcccctggtgtatacttaaaaatggaatttgtactcttctaaacctcctgctttttctctaactcacttagtgtttttcagctctgggaactttcaggaggttttctttgtgtaaactcatgtgtgatgtgtagatggtggcgtttcatgtgccttgctggacttttacagacccgatctagtagacatggagagggtgcaaatccaaagtaaccgagagaatctggaacargcttttgaagtggcagaaagactgggggtcactcgcctgctggatgcagaaggtgagagggagtttactgaacttgagtaaggaacacgtattcagtattccttcttctggcaagttcctttgttctgactaagaaatttcttgtccattctctctcagatgtggatgtgccatctccagatgaaaagtctgtaatcacttatgtgtcttcgatttatgatgccttccctaaagttcctgagggtggagaagggatcagtgctacggtaaaagaacattttcctagaaggccttctgactttgattcatttgggtgaaatgcattggttagacactttcttaagcacttatggtatactcatggtatcaaactatatatccagtatctttatcatacatggacattatccttggccctggaaatgagtctagatattgctaattttgtaacaattagcatagactatttggtgctaaatgccagcaaagaatgtctctttcatccccagctgtaattcaagatgaggaagtgttttatcagtcacttatgtatcagcttgattaggtagatcatggctcttttcagaatatttttagtagcttggtttgtagcctttcttagtgtcaggaaattgaaccccatcctgagagcccttgaggagctttgaagctagtactgtgagcattaaactgagcagcatctaggcaattaaaggaaatggattttatatagtttggagtggcctgagctactttctcttgtgcttgttttggatattgctaatcaggtgtgtgatgtttaccttctggcaataggaagtggactccaggtggcaagaataccaaagccgagtggactccctcattccctggatcaaacagcatacaatactgatgtcagataaaacttttccccaaaaccctgttgaactaaaggtaaagtcaaggacttaaatttttttkgtaaaatctttctagggagtaagtctccaagcttatcactgctggcttctaggtgaggtggtatgaaaaattgggtcctatagtttgtgtccatttattcaccaaatattaattttataggcactttataaccaatatatacacttcaaagaaacagaaattctggccaaggagagagaaaaaggaagaattgaggaattatataaattactagaggtaagtgagcttatcctttgctgagacttggggtttgctggtctgtactgttgttgcttcttgattatagattccttgtattcttttcccaaactgcrttaatagaagtactctcctggtgacaaataatagcaccactctcaggctggtcttaaaatgttgtggtaaaggggcaatgtcagccatctctgttttttaaagggcttattgaaaaatgacatgtatttattcagaaatcttgagttttgtggacaaatttttctgcttctcagagggaagctaaatctttccctagggtggaaagaagagagacttctattcagaatttgattcccagagaatttgaagttgtagaaatgagaatttaaccttgccagaataaaagttattgaggggaaaggaggatttatagaaagtgtaaaaggaatggaatgacttagagtaggtagtccctacattctagaggtgacttttctgctctttaactcaagggtgaagaacctgatacatatttgattgtttttccatgttagacaataggaaaaactgctgaatggctgggtaaagaagcaagaagtgatgtgcaaataataaatcaaaactgggacaagagggcatggctgtgtttttggactgaaagagtatctgtttcaggtgtggattgaatttggccgaattaaactgcctcaaggttatcaccctaatgatgtggaagaagagtggggaaagctcatcatagagatgctggaacgagagaaatcacttcggccggctgtggagaggtgggtccagatcctgagagtggtctgacattatttattgagctgctgtgaaccttgcacatgactatggttttatcttatttcaggctggaattgctgctacagattgcaaacaaaatccagaatggtgctttgaactgtgaagaaaaactgacactagctaagaatacactgcaggctgtaagtctctgactgttttgtccaacatctgtgtcacatgtttcctgcttctcaccctctgctctaattgttgaagttagcaatcgaggaatccagatgtattatttccctttttttttttttttggaattgcagtagacttcttggctccctctgtcctagtgagtggggcaatggaagttttcccactgttattctctcttcctgtctcaggatgctgctcacctggaatcaggacaaccggtacaatgtgagtcagatgtcattatgtacattcaggagtgtgaaggtctcatcaggcagctgcaggtggatctccagatcctgcgggatgagaattactaccagctagaagagctggcttttaggtgaggaacaagggactcaaatggagggcttgcttgcttactgctgaggctcatggatcaagagtwgagcaagagtcaggcacttaatcttttaacctggacatttgaggtcagtgtctcaatggggatactacaggtctcttgggcaggaatgttttgtcagtagaggacagtttccccttattgcagctccatcccactaagtacctataggattacttcaatcattgtggccttttgtaacatcccacatactttattttaattaatcaaagacagggtctcactttcgttgcccaggctggagtgcagtggcacaatcatggctcactgcagcctcgacttcctgggctcaagcgatccttccacctcagcctcccaagtagctaggcctataagtgcaggctgccatgcccagctaatttttgtatttttagtagagacggggttttgccattttgcccaggctgatctcaatctcctgggttcaagcgatcctcctgcctcagcctcccaaagtgctgggattataggcgtgaaccactatatctggcccattctcatatattttagaacgacctgcagggttgggacacaacacaacttctgatttagaaacattggtgatccatcacattctttttataggggggaaaattgagacccacagaagatgaaaattatgtaaagtcatgtggctagttttttttttycccttttttttttgagatggcatcttgctctgtagcccaggatggagtgcagtgacacgatctcggctcactgcaacttctgcctcctgggtccaagaaattctcttgcctcagcctccggagtagctgggagtacaggagtgcaccaccatgcccagctaatttttgtatttttagtagagacggggtttcaccatgttggccaggctggtcttgaattcctgaccttgtgatccacccacctcagcctcccaaggctagttttacagagccaagactaggacccacatctcttgacccctaatccattgtttattatatttgggagttatataaatagtattgttagcttccctccagttaacactgtaatttggcatttgtcttaaaaacaattctgaactagatgaagatgttcataatatcaccttgtattcatataacactttctaaacacttttccttctatgatctcatttttatttttatttttatttttatttttttgagacaaggtcttgctctgtcacccaggctgggacgcagtggtgtgatctcggctcactgcaacctccgcctcctgagttcaagcaattctcctacctcagcctcctgagtagctgggactacaggcatgtgccaccacacccggctaatttttgtatttttagtagagacggggtttcaccatgttgtctaggctggctcatttttatttttatcatatctttgtcaaatggataaggaagattttatttttaaaaactatactatagatttaaatcctttccttttttctcttcttccatttcagggtcatgcgtcttcaggatgagctggtcaccttgcgtctagagtgtacaaacctgtaccggaagggtcatttcacttcacttgaattggttccaccctctactttaaccaccactcatctgaaagcagaacccttaaccaaggcaacccattcttcttctacctcctggttccgaaagcctatgactcgggctgaacttgtggccatcagctcctctgaagatgaaggcaatctccgatttgtgtatgaactactgtcttgggtagaagagatgcaggtgggtgcatatccaaaagcttatgcagtacactgatgtttactggatctggaagcttatctaagaggaccaaattgctttgtgttccctgtgcagattcccttaattattattattmttttatttgagtgatggggtcttgctatgttgcccaggctggactggaactcctgggctgaagtgatcctcctgcctcagtctcttgagtagctgggacaataggtatatgccaccatacctggcttgactttcttaattattgatgctgcctgagacccaagcccccttctccttaaatcttgcatggatgaggttggcacaaattctcacagtcccgtactgaatagcatacagttttctcatttgaaaccctttggaatcttttccctcagctaactgtactctgagtgagagcttggtgaaaattgcaatgtctttacatctgttayctttttttttaattaaaaaaattttttgtgggtacatagaaggtacatatatttatacgatacatgagatattttgatacaggcatgtaatgcataataatcacatcatggaaaatgaggtatccgtcatctcaggaaatttatcctttgtgttacagacaatccagttatactcttttagttatttaaaaatgtataggctgggtgccgggtgcagtggctcacgcctgtattcccagcactttgggaggcctaggcgggtggatcacaagctcaggagatcgagaccatcctggctaacatggtgaaaccccgtctctactaaaaatacaaaaaactagccaggtgtggtggtgggcgcctgtagtcccagctacttgggaggctgaggcaggagaatggcgtgaaccagggaagtgaagcttgcagtgagctgagattgtgccactgcactccagcctgggagatagagtgagactccatctaaaaaaaaaaaaaaaagtacaggctgggcgtggtagctcacacctgtaatcctagcactttgggaggccgaggtgggcggattgtgtgagtccaggagttcaagaccagtctgggcaacatgcgaaatcccatctgtatggaaaactaaccgggaatgatggcgcgcaccggtggtcccagctacttgggaggctgaggtgggaggatcacttgagcttgggaggcagaggttgcaagtgagccaagatcgcaccactgcgctccagcctgggcaacagagcaataccccatctcaaaaataaaacattaaacaaaaaaatgtacaactaaattattttgactatagtcatcctgttgttctatcagatgctaggtattattcattctttatttttttgtacccatgaatcatccccacctccctctgatcccgtaatactcttcccagcctgttttgatttatacatcccacagctaagtgagaacatgcattgtttgtctttctgtgcctagcatatttcacttaacataataacctctagttccatccatattgttgcaaatgacaggttctcattcttttttatggttgaatagtactccattgtgtttaagtaccacattttctttctccattcatctgtgatggacacttaggttgcttccaaattctggctattgtgaatagtggtgcaacaaatgtgggaatgcagatctctttgatacactgatttcctttcttttgagtatatacccagcagtgggattgctggatcatacagtagctctattgttagtgatttgaggaacctccaaactgttctccatagtggttgtactaatttacattcccaccaacagcatacgaggcttccgttttctccatatcctcaccagcatttgtatattgcctgtcttttggataaaagccattttaactggggtgagatgatatcacattgtagttttgagttgcatttctctgataattagtgacgttgagcaccttttcacgtgcctgtttgccatttgtatgtcttcttttgagaaatatctattcaaatcttttactcatttttaattagattattagtttttttccagtagagttgtttgagctccttatatattccagttattaatcccttgtcagataagtagtttgcaaacattttctcccattctgtgggttgtcctttttttttttttttttttttttttttttttttttgagacagagtcttgttctgtctcccaggctggagtgcaatggcgcaatctcggctcactgcaacctttggattctaagcaattctcatgcctcagcctcccaagtagctgggactacaggcacgcgccaccatgcccagctaattttgtatttttagtagagatggggttcaccacattggccaggctggtctcgaactcctgacctcaggtgatccacccgtctcggcctcccaaagtgctgggattacaggcgtgagccaccacacctggcctgtccctttcctttgttgattcactgtgcagaagcttgttaacttgatgtaatcccatttgttcattttagctttggttgcctatgttggtgtggtattattcaagaaactttttcctagactagtgtcttggaaagtatttctggtgttttcttgtagtagtttcatagtttaaggtgtttatccattttgatttgatttttgtgtatgatgacaagggacagggatcaagtttcattcttctacatacagatatccagttttcccagcaccattaattgaagagactgtccttaccccagtgtatgttcttggcacatttgttgaaaatgagttcattgtaggtgtatggatttgtttctgggttctctattctgttccattggtctatgtgtccatttctaggctagtactatgctatttggttactatagctctgcagtataatttgaagtcaggtaatgtgattcctccagttttgttctttttgctcaggatagctttggttattttgggtcttttgtggttccatataaattttagaattttttttttatttctgtgaagaatgtcttgtattttttatagggtaaatctgttttttttttttttattctctcattgacagaggagtttattcttcrtttttcattgttgatgtaacttttttttttttttttttgagatggagtttcactcttgttgcccaaactggagtgcaatggcacgatctcggctcactgcaacctctgcctcccgtgttcaagcgattctcctgtctcagcctccctagtagctgarattacaggcgtgcgccaccacgcccagctaattttttgtatttttttttttagtaraaatggggtttcaccatgttagccaggctggtcttgaactcctgacctcaggtgatccgcccaccttggcctcccaaagtgctgggattacaggagtgagccattatgcccagtctcaacttttttttttgagacagagtctcactccgtcacccaggctggagtgcagtggcgtgatctccagtcactgcaacctctgactcctgggttcaagccaagcaattctcctgcctcagcctctcaagtagctgggattacaggcgcccaccaccatgcctggctgatttttgtatttttagtagagatggggtttcaccatgttggccaggctggtctcgaactcctgacctcaggtgatccacctgcctcagccccccaaagtgctgggattacaggcgtgagccactgcgccyggcaatcgtaactcttaagtttaagcaaggctactgtattccgcagttccaaggggcactatttacatgtgttcaatgatagtggttcaaatttgatattgcccttatctttctaacccttttgttttatattaaattcttcctatgtctgcataatatattccccatgtaacaataaataaaaatatcccaaagtaacctgttttaaaattatcttccattggccagtagttgatgtcatgaaatgaagctaaatattttcagatacttctttgttatatcagttatgattgtgaaatgaaaagactccataaagagaaatgcctaaactgtaaagttaagcattttaagcctgtgaagttccctttcccttttggttgattactccaggaatgtatactaataatgcagcagcaaaaggctgctctgttgtataattggtgggctctgttctcctgcttcttagcggtgatgatggcgtaatttttgtgtaagaggctgtagattgaaggagatggcctggatgtccttttgctcagtcctctaccccttggttccttgtcctaacattggttctgaccattttcctaccaagccagcagtaaattatgtcatatatatattttttctttttcagatgaaactggagcgagcagagtggggcaatgacctgcctagtgtggagttgcagctagaaacacagcagcacatccatacgagtgtagaagagctgggctcaagtgtcaaggaggccaggttgtatgaggtgcgtagccttcagaatccacattacaggagggacgtggttggaacggatgaaaggacagtacacacaataaagctgtattgaaggaggagggtgctctggaaaagaataatgatgatgaagagcggtttatgacaaattcccttttcacatgaagtgtatctgttaatctttgaaataaacttgtgagaaaagtatttttattaacccctttttactaaaatgaaaagtgatactggaagctgaggtcagaattagtaagtagtggatgcagcatccaaactcaggccctctgcctctataaattcaggcactttttacttccccatctgcctgcagttgagcgctggtttagagaaactattcacacagtttcctctctccttcagtcactgttctatcttcccagtttatatttcaactcttcccttcaaaaaagcagttgagtgggaatcaggcattggttttgcttagaagcctaccagaattgctggaaacacaggatagtgaggtctgttgtttgtaattaccctgctcaactgttgctcacttartgctgctccaagttataaaatatgactcagaaatttgttgtctaagcttctgttttcttagagcaaccaatccatatctctatctagacataatatttgcatagttgcaaccataacaygtagtttacttactctttctctaatgtatttttatttcattcttttttaatcagggaaagatgtcccagaatttccataccagctatgctgaaactcttggaaagctggagacacagtattgtaaattgaaggtgagtttctgccgattctcttacattctgctcatagagtctggttccccccartcaactctcttccgtaattcaraaatctcctggtttggccctgttttggttttctgcttattaggttatatcatttactatgcacttattcatatctattataacattttcccaattttctaaatgggtcagaaactactgttcttgaacgttttaaataaatagaacctatcctaggtattgtgcttcaacaaacgtgtggctatatgtgctttgagacaccaaaactaaaagtttgagatttgtagagaggggactttccctctgatctgttgtttttcatccctgtttatcaagattgtccagagtaggacagcccaggaccattctttatccaaggagcaccacaaaggccttatgaattctgttttctacttaggattgaraagagttctgggagtcttatatcaaacttgtacaaaasttgaatccatggggaaaaatccagagattaagagcaaattaatttcctgagttattctctcctttgatgtcaaatgtgctatcttctacagatacaaaggctgccagtctaatcttataatccttgctttgtctaggaaacttctagcttccggatgaggcaccttcagagcctgcataaatttgtttccagagctacagctgagttgatctggttgaatgagaaggaggaggaggaactagcatatgactggagtgacaacaattccaatatctcagccaagagaaattacttctctgtgagtctagcacagtagcaggcctgtcatacttatttaacagcagcagaaggagacagggcctagtctgctgaaagcttgggtggctggagttgcactctgctagatagaaataggggccctactcaatgcatccatgcatgtgagaagtgtaaatggagagagggacagtagaaccctagagttaatttatctagaatgcatttagaaaggcagtgtcttgggtgaatagagcagcaacctgtaaattgagtcatttcagaagcaatacarcattgtggttaagattataggctttggagtgcctaagttcaaattcttattcttctactaactagctctataaccttgggaagtcatttaatctctctggacctccataaaatgagataatagcaccacttcaaagctaccccctcccctaatagcacgtattccccaacggttgcataaaagattaagatttaataagctaatctagacaaagcatttagtctagtattgttcaactgggatatactctggactttccacaaatttctgaattctccttaattcatttattaacttttttgtttcaatctcttcgtttgtaaaaatgggaagggaaatttaacattggacaataggacactgctttttattcttttcaatgaaagatgtagacaagttaggattagtttttgctacttttagtattttcacactcagaagatttttaaagattttgtaaactatgcaaatagggagtttcttgtttttgtttttaacatgcactttagacagtttaattctattgatttagggttcttaaaaaatataggcttcttctgattggagaatggcatatgattctactgaattaaagaaggaagattggatactataatacaataaacaggctgtgtgagaactgaaattaggctataacagagatataaagaaagtgctctgaaagcatagtaaggatcagtatccagcttcacagaagagctatttaaattgagtcctgcagttaatagaatttagagtyagtggaggacattgtaggctgaatagtctaagcaaagccaaccagtcattgatacccatgtcctggtgtgtcatgtactggtgtgggtactgacgtgcaggaactgtccactccagccaagttatctcttgtctctggtccaatgcttattctgtgttcccccattttactcacatctgggtcaggtcccatgtcctttgtgaatcattttccaataattccagtgtttgtgcccttctctgcaatcctctggcatgcactgtttatacatctcattttgccaccaattctatattgtaggttcctttaaaatagggaacacagcttttatttatgctatccgctccccactgccaagagtgcttatgctgtaaaattgaattccattttcaggagttgacaatggaactggaggagaaacaggatgtgtttcgttctctacaagatacagcagaactactttcacttgagaaccacccagccaagcagacagtggaggtgtgtgacttgagaatgtgtgaaggtcaaatgctgagaggttgttgttataaaagtattcaaattagagactttgttccactgaaagacttggaggaagtgtcagggaacatttgycttgggtcttctctcttttcattcctgactgttcctatgtccctcaaaagcctgcaaacatttttgttagtctaaggaaactactaagagaaacaatagaaggggcattggctcacagctttcagaggaaaagtgacttggaccatatttcttcaaataactatccagacagatcctgacttgactcttgttggtgtggtgcctttgccaaaagaagagaaacagtggaagaattccagaggaatttatttatgcctgggttttgctgcctagatcatttacttacaactgagtgtggaagagaccttttctatgtaaccccctctaacaaaaccattttggattaaaggaacacctcttactcgtgggaagcattgagcagatgccagtcaagtatctccacatcttttctgttggcttctctatcattagcagagttgtacttggaaaatagtattgcgcatatatattgagtctgttaaactcaagcccttctgtctgtgtgcttgtttattgcaggcttacagtgctgctgtccagtcccagttgcagtggatgaagcagctgtgcctgtgtgttgagcagcatgtgaaagagaatactgcttattttcaggtgtgatggatttctgtgtttgtgtgtgtgtgtacatatgtatgttaaaggtgaggttacaaacacatctgcgttagtgtgcttttgttgtataaaccaccaccttaaaatttagttgcttaaaacaatagtcatttagatagctcatgattcagtaggtgagcagtttgggcagggctcagctaagtggttcatcttatcttgcctgtcttactcatggctgcagacaggctgggggctggttggtcccaaatggcattgctcatgtctgagagttggctaggtgctgaagcaccaacccatgtgtctctagcatccagcagctttcttcacaaagtggctgtgtttcataagcagcaagagagagcgagtcctagagcacaagtcctttttttctgcttgtgtcacatttattaatgtgcctttggttaaagccagacatgtggctgtgcctggcttcaaggtgaggagaaatagactccacctcttgatgggagkagctgtaaaatattatgaccttttttttcttttttcaatctgtcagaacatgaaagagtgtactgctggccgggcaccatggctcacacctgtagtcttagcactttgggaggctgaggcaggcagatcacctgaggtcaggagttcaagaccagcctggccaacatggtgaaaccccttctctattaaaaatacaaaaattagctgggtgtggtagcacacacctgtagtcccagctacttgggaagctgaggcaggagaattacttgaacctgggaggcagaggttgcagtgagccaagatcacaccactgcactccagcctgggcaacagagcaagtgtctaaataaaaagaaagaaagaaagaaagraaggaaggaaggaaggaaggaaaagaaagaaagaaagaaaggaaggaaggaaaagaaagaaaggaaggaaggaaggaaggaaggaaggaaggaaaagaaagaaagagagaaagaatgtacttcttattttcaggtgaggtgggaggagaaaataagctgttacctctgtttttgccctagatttttttttgagacagagtctcactctgtcgcccaggctggagtgcagtggcacgatctctgctcactgcaaactccgcctcccaggttcatgccattctcctgcctcagcctctcgaatagctgggactacaggcgcccaccaccacgcccggctaatttttttgtatttttttagtagagacggggtttcaccatgttagccaagaaggtctcgatctcctgacctcgtgatctgcccgccttggcctccgaaagtgctgggattacaggcgtgagccaccgcgcctggccttttgcccctaaattaaatagtttccgtgattatttcatagtatgaattgaaacatttgatcactcagccttaggtttttcatgaaatacaccccacagccaaatgctgtacctagccagaagtcaagaggaaagagcagtgatttctgagggggtgaaacaggctaacttttcggtagggtagggtttgkggtagtcagcactaatattttgctgcatggctttttaagcccttcggtttatgtttcagtggtccttgtaataaactgtcactaatgcagtagggtgtaatcagctttgctaagctctgcacagtaaaattgttctttcttagttaatattccrgtgttctaatgttttgagcagaaggcatccttactttgtattcccatagttcttcagtgatgcacgagagctggagtcattcttgaggaacctccaagattccattaaacgaaaatattsctgtgaccacaacaccagcttatcccgccttgaagacctgctccaggactccatggtgggtgttgcctcagtggggatgattacttctgagaaagagagtaaaccatatcagctgctgctgtttatatccttgaaagctccagggcaatgggccattgttgtaataaagtttggcttacattcaaatagagtttaatcgatgttgttctgtctctttcctttttttccttttcttttcttaaataagttgctaataagatttctttgggtatgttattgaagtaaaggcctagtcttctcctctgagccactttgagctcattgtactttctttgcatttttcttattttaatgtaatagttggagccaaggatgaggtgttgagcatgaagaaaaggttgaaggggattagttgatatcaaattcttttttactctcttatgcaaaaaaaaaaccaacaacaacaacaaagaaatacacctgagtcaaaattttcctccttggtagttttcttttggatgataattaaaattgattttaattcaaagaaacattaaaatcttatttagatgtaatatttgtgcagttatttatgaagcaatattaatttttaagaaatagttttacatttagtatttagttcaaatcaattttatattctttttctccaatgaattatttcttcaggagtgctggtaattaaattagcagraagactacttatatttagtgaatgtatattacacagagttggcaagacaaggctcaagctacatctcaaattaaaatagaaatgtatatgcaatagggaacttacttttcctttgtgagaagtaaggggaatctcgcatttcaatagaaaagtctgaataagagaactagaataacccaaaacagttcattttttttgtcggtaaaatttgagcatttgtgaatttaagtttttttatttttatttttttacactttcaggtattgtaaacctatgagtggttttacattcacctgggcaaataatctgttaatttaattaatttggaatgaaggatgaaaacctgacttttcagatgttgtctctaaaatgtctctctcagaggtactgcaagtatgaaggaggaatataatcattggctattatctcctccctcccacagagtaccttctgtcatagggtaactcctctgcagtggttgtcatatcttctcttctcgagggtcgctgctctgttccctcctctccaggtcagggtcatcgggttggcggcgtcatcggggcatggagtcacctgggtctgctcctcagcttgtccgtcaggttcgggagcatctgtcctggcttctggttcttttcagaacttttaccacgctgagcacttggtctctggagcttgagctgtttggctgtgggttagacagaaattgacatcttattgcaaggaaactgaaatgggtagaccagctctcaagtatggaaatgtggctgtctccctgatatattccattcctctttcttaactaataagttaaagttgtatttcttccaatcatgctcccggggacaggcacaggtagtttatttaagcatttctttttctttacttgcatattcttagttctttaatggcatttcctaacattattaactctttactctcatcgcatctacatccatcctaagaaagccctcttctggggagacttttatacctcaaaatgggcttgaaacatccgggttaatggacaaagtttatcttttactctttaatggaattggtaatggtttactaccaattttgttaacaagaagtttattcatttttaagattattggatttgcagagatttgagagtttcaattttgcatgatacttctttctaaccaatcaaatttatatgaatatagcacagcaaatactaagaggtaaaccctaaatcatttgtcatgataccttcaccaacagcattgttggttgaagagctaagatctttctctagaaagcttgactcaatttaggaaaataaaatatttggagtagagcttgggagatataattatttttaaaaatttaaataagtataactagcttctcctaagcagaaagggaagaactggtttctaccagtgagaaattgactaataataatatacctattattgattttaactttcatgttctctgaatcatgtttagatagattttttattagctttgtagctgtatttggaagctagaagtatttgtttttattttgatttttgcatgtgactttatggttcattgaaagtggcacagggagaaagctgcaaagtttgagtgcgaaagcacttggtagaagacagaagcattctctccttttttctttatcattgtctaagtctttaagatggctccaccaaccatccctacttaactgagagatgacattctctgagggagtggagtattcagttttctttgttgacttagtcaccctgagtagcagcattaatgtcattttgtttttcttatcattttgtaggatgaaaaggagcagcttatacagtccaagagttccgttgccagtctcgttgggagatcaaaaaccatcgttcagctaaaaccacgcagtccagaccatgtgttaaagaacaccatttctgtcaaggctgtctgtgactacaggcagatcgaggtgaggrggtagaaagggtayctctgggccacagggggaaggaagaaagaagggaagccttcagttagggttatgatgataaaagatcaaattacagcgtttttaaaattagaatttaaacatgctgaagtctctcctatcatttaaaaaaaaaaaactaaactaaaaacttcaacactataatcttgacctgctccctgcctcagtgattggcatcattatctactcagttgcctaagtgttgacagagatggtactttgtagcacttgggagatatccttgactcccccacccctcttatcctccacagctaataggaccatcaagtttgtactaatttgtaaatatcccttaaacgtactttttctrtccctgctaatattaccctaagagcataagtggctgggtggagaggctcatgcctgtaatcccagcactttaggaggctgaggcacatggatcacttgagctcaggagttcaagaccagcttgcgtctctgcaaaatatacaaaaattagccaggtacagtgacttgcagctatagtctactcgggaggctgagacaggagaatcgcttgagccgaggaagtggaggttgcagtgagccaagatcrcactgtttgcactctagcctgagtgaaactctgtctcaaaaaaaataaaaggcataagtttctttcacttggattattgtgtcagcctccccatttagtgcacaaaggatcctaccaccagcatgttctttttttaattttaattttatttatttatttatttatttgagatgaagtctcgccctgtcgcccaggctggagtgcagtggcacgatctcagctcactgcaagctccgcctcccgggttcatgccattctcctgcctcagcctcccaagtagcggggactacatgtgcccgccaccatgcccgcctaagtttttgtatttttagtagagatggggtttcactgtgttagccaggatggtctcgatctcctgacctcttgatccacccaccttggcctcccaaagtgctgggattacaggcgtgagccaccgcgcccagcctattttattttattttttgagacggagtctcgctctgtggcccaggctggaatgcagtggcgccatctcagctcactgcaacctctgccccctgggttcaagtgattatcctgcctcagcctcccaagtagcagggactacaggtgtatgccatcacgcccagctaattttttgtatttttagtagagacggggtttcactgtgttagccaggatgttctcgatctcctgacctcatgatctgcctgcctcagactcccaaagtgctgggattacaggcataagccactgcgcccagcgtttgtttgttttttttttcctttaaataacaatcctatgcttaaatcttataataattactcattgctcttgggaaaaagccgaaactccttaatgtggctttaagttcttgagtaatctgtctttacctctctagccaagactgggtcatatcctttattgcctggtaaattgcatttgtcacacagtattataactacatacaccaccagaatatgtggaaatacagactatgcttgtctgcttaccactgtacctatttatttatttatttatttatttatgttttgtgacagggtctgactctgtggcccaggctggagtgcagtggcactatcatggcttactgcagccttgacctccctgggctcaggtgaccctcccacctcagcctcccgagtggctgggactacaggcatgcactactatacccggctaatttttgttattttttgtagagatgaggttttactatgttgcctaggctggtcttgaactcctgggctcaagcagcctgcctaccttagccttcagaagtgctgggatyataggtgtgagctgctgtgcctggccaattgtactgtttttatctccagtgtcctagcacatagtagacactcaagaaatatgtattatacaaaagaatgaatgaattaagaaatggaaaaaaaatttaaaaatgggactgtgcttttgtgtgtctcgatatttctgcctgtaagttagggataatagtcttgatcacttgcctctaagagaaagacttgataattccaaaatgcttaaacattttcaggggtttgggtgggatgataggaagtagggagaggaaatatcataaaaacaatgttttgattattcaccttccattagtttttactctagtagatttttgtgctgagatcgctcttgagcctttatagtcttattataactttcatagtctgggttacttgacatgtaacaggtatttaatacatacttatttccttgatttatttggtgtcacagtttttcctgtgttgtagatttatacccattatcttttggcaaaaatcagaagccctcactaagtgatagcagatcttttcttaagcagatttttttcttaaggatttgatagctttgggatgaggcaccaggaaataatgggttgttggtttatccattagcaatcactggtaaatttatctcttcagattactatttgcaaaaatgatgaatgtgtgctagaagataattctcagcggaccaaatggaaagtgatcagccccacagggaacgaggcaatggtgccgtcagtctgcttcctcatccccccacccaataaggatgccattgagatggccagcaggtaacttggctcagctgccactggtacacccacctctgctgttggcctcggtgaaccagtggagggatgagtgtgcatttgtgatgtttttgaacacagtggtaaagttcctcctgggagaggcttctcattggagatatcaagtctcctactaccagccacatagtagatcttcaataaatacttctgttcagctggagtatcttcagtgatatttcttttttaaagaactcctggttataaatagtttactctcagaagattgatttttttaccagcctggtcaacatggtaaaacctcatctatactaaaaatacaaaaattagctggatgtggtggtgcacgcctgtagtcccagctacttgggaggcttaggcatgagaattgcttgaccaaggaggcggagtttgcagtcagctgagattgcgccmctgcactctagctgcctgggcaacagagcgagactctgtctcaaaaaaaaaaaagattgggctgggcacagtggctcatgtctgtaatcccaacactttgggaggccgagggaggcggatcacttgaggtcaggaggtcaagaycagcctggccaacacrgtgaaactccatttctactaaaaatacaaaaaaaaaaaaaaaaatttgccgggcgtgatggcaggcccctgtaatcccagctactcgggaggctgaggcaggagaatcagagaatcgcttgaacctgggaggtcgagtttgcagtgagtcgagccgagattgcaccactgcactccagcctgggcgacaaagggagactccgtctcaaaaaaaaaaaaaggttgatttttttctgggtcattagttatcattagtttattataaaagagatatggaaattatttacatgatgaaagatttcagaacttcagtggaatgggcagcttcacgttgatgccatttctttcttttttttttttttaattatactttaagttctagggcacatgtgcacaatgtgcaggtttgttacatatgtatacatgtgccatgttggtgtgctgcacccattaactcgtcatttacattaggtatatctcctaatgctatccctcccccctccccccaccccatccccccaccccacaacaggccccggtgtgtgatgttccccttcctgtgtccaagtgttctcattgttcaattcccacctatgagtgatgccatttcagtagtgacttatttcactctacgtgctttccaagaatgtcaccgtctctaaataggaaataatccttgtcatctagaactactttggtgcctccatattgtgggagaagaactttatctccaactttcctgctaactggttgaccctctccaccctttcctttagaacctgatccaacagcgactactgttgcttgaaatacttttccttgagatttttctggaagcataatgcctcctttggttacagtttcagcaacactcctttcaaattttcttttctttctttttttttttttcttgagacagagccttgctctgtcgctcaggctggagtgcagtggcactatttcagctcactgcaagctccgcctcctgtgttcacgccattctcctgcctcagcctcctgagtagctgggactacaggcgcccgtcaccatgccctgctaattttttggattttagtagagacggagtttcaccatgttagccaggatggtctcgatctcctgaccttgtgatccacccaccttggcctcccaaagtgctgggattacaggcgtgagccactgtgcccggcctgagtggaagaaactttctaaacgtttgtcctgccatgactgtctctgtctcagactctgaattttttttttttaatggcagctgattttctttaatttttattaaagtaatatatgggccgggcaccatggctcacgcttgtaattccagcactttgagaggctgaggttattggattacttgaggtcaggagttcgagaccagcctgagcaacatggtgaaactccgtctcactaaaaatacagacaattagcctggcgtggtggtgcatgactgtggtcccagctacttaggaggctgaggcaggagaattgcttgaacccagggtgtggaggttgcagtgagctgagatagtgccactgcactccagcctgggtgacagagtgagactctgtctcaaaaaaaaaaaaaaaaagtgtgtgtgtgtatatatatgtatatatgtacatattttagaaagttgggttatactgcaaagtttattataataaaaattagctatcacctctcctttcccaaagttccacattccagagtcaagtgttttcagctgttttagcagattttgctgggttataaatccacatttccaaatgtaattttttcctgctatttccttgtttgttttcaacttcagaaattatctattaacttcttactctaggaaattaacatttagctttctatgcacacatatatgcaaacacttcttccgttttccaaatgtggttatgtcacagtttttgtttaagttgctatttttgttttattagtacatgtgttgtttaaagctgagccacatcttactctaggggactattgtgaggcgactgtgccttacctctctgaactcatcctctgctactctccttgcttgtacttagctgcagtcactctggtctttcctctgtttctcacacacagacagcatattcttgcctcagggcctttggacttcctgcttgcctctgatatttacatgtttcactccctcactttgttcagtttatcttagaaccctcatggaccaccatccccactaactgcatgccactctctgtcttctttactcattttatttttcttcagaactcttaatactgcctaacagattgtgtgtttgtttmttctctcctattagagatttttgtccattttgtttacctctgtatctttagcacttagaaccattcctagcacatagcaggtattcaataaatggttattgaatgaaagaatgaatgagtaggtgagtgaatatatttatgaataaattattttatttactttctttacttttttttttttttggtttgagacggagtctccctctgtcgcccaggctggagtgcagtggtgcaatctgggctcattgcaacctttgcctcccgagtaagtgggattacaggtgtgtgccaccacgactggctaatttttgtatttttagtagagacggggtttcaccatgttggccaggctggtctcgaactcctgacctcaagtgatccacccacctcggcctctcaaagtgttggkattacaggcgtgagccactgcacctggcccctgttttatttactttcttatataatttttgtttccttggagtgggtaattgttttgttttttagtttgcttagttgtcyccaaactctcctacattactgtaaaaggattcccaatatggccaaacaccacaggcaattttcatttttcttttggaaacatttattctggaccattctatctttttttttttttttttagtcyggacctgttctgtaggcctgattcagtcagtactgtctctgtgatacgtggacccactaattactagattccaagtcttatttattagtgtactccctggtttggtggattacactctccaatgccttactgaaaaaggctgagtaggaggtaaattttttgaaacctcttatatctgaaaatgtctgtcttcttcttcctctaactggcaagatacattttttgaaattattattattattattattattattattattgagatagagtcttgctgtgttgcccaggctggagtggagtgcatggtcttagcacatggcagcctccacctcctgggctcaagtgattctcctgcctcagcctgccaagtagctgggatcacaggtgcatgcccccatttccggctaatttttatatttttagtaaagacagggtttcaccatgttggccaggctggtcttgaactcctgacctcaagtagtctgcccgcctcggccttccaaagtgctgggattacaggtgtgagccaccatgcccgcctggaaattatttttactctgaactctgaaatcattgctctattgctttctagctttcaggatttcttgtttagatgtatagtgccattttcattctttctcttttttttttttagatttacataatagtaaaactcatcttttgtcataagcagtactattggttttgacaaaggcttagaattgtttatcgttcaccactatcatgatacggaacagtctgatacttttaccttttgaaagaaatctttatttctctgcaagtgtttaagtgcttctctttgtctctaatctttaaaagggatgctgtacctttgagtctttttgcattcattatgctaatgaacacaaactagaaactcgtctttcaggtctggagaagttttttcttggatgatgatgattattattattattttgagacagtctcgctctgtcgcccaggctggagtgcagtggcgcgatcttggctcagtgcaatctctgcctcctgggttcaggcaattytcctgcctcagcctcccgagtagctrggactacaggcacacaccaccacacccagctaattttttgtacttttagtagagacggggtttcrccatgttggccaggctggtcttgaactcctgacctcgtggttcacctgccttagccttccaaagtgctggaattataggcatgagccaccttgcccagtctggattatttctcttttctttctttctttcttttttttttttttttttttgagatggagtctcgccgtgtcgcccaggctagagtgcagtgacgcaatctcggctcaccgcaagctctgcctcctgggttcactccattctcccgcctcagcctcccgagtagctgggactacaggcatctgccaccacgcctagctaattttttatatttttagtagagacggggtttcaccatgttagccaggatggtctcaatctcttgacctcgtgatctgccctcctcggcctcccaaagtgctgggattacaggcgtgagccaccacgccagccttatttctttaattatttcattctccttgtttttagttcttgcttttaagaattcccatttgttgaatgttggacctcctgaactaattttctaatgttctcttattttctattttttttgttgttgcttttttatatttttattcttctttgggatttcctgaactttgaatttcaactctactgaaattttagtgggagttttggagagagggaagattaaacttacggatttaatgcctcctatttaactgatgtcctggcttctagttttccatcctgttctttatatctcacatttttttctcaacttgaagaaattcaaggtaacgtggtgggtatgtaagagagtgtgtctgtgtatttgtgtatttgtaagtcttcctgaaatcaagattgaattagacatgagatgcttgggaaagaaatctcaaacccttcatacttcagttttcttttttttttttcttgaaatggagttctgctcttgttgcccaggctggagtgcaatggtgcgatcttggctcactgcaacctccacctcccgggttcaagygattctcctgcctcagcctcccaagtagctgagattataggcatctaccaccacacctggctaatttttgtatttttaatagagatggggtttctccttgttggtcaggctggtcttgaactcccgacctcaggtgatctgcccgcctcagcctcccaaagtgctgggattacaggtgtgagccatgcagttttcttttatataccaggtgaatttcttaagctgctattaatttctcaacattttagcatttttgtaaatatttggaacacagcaaatcagtttttaaacattgatataatcctttttcaacaattctggatgggatgttgtttatgcctttccctattattgttctctctggttatttcttctctctggcttgtaatcatcatattatatccaggtaacatttatgagattactaaatatgtgctaacgttaatatgcataatgctgtagcaaatccaagttgaagatctcaattaattaatgtagtttagtttttttttttttttaaatagagatgaggtctcactatgtcgcccaggctgctcttgaactcttgggctcaagcagtcctcccaccttggcctccaaaagttctgtgattacaggcatgagctaccacgcccagcctcaattaatttagttctaaaaattcctgagatgctagtatttgacttgttgcctttctctgctcaacatataagctcaattctgctaaggcaatcacatttttccttagaaggtctctaatgtggagctgaagtcttacaaaggtaatagtcaggttctgtgttatttctagggtcgaacaatcttatcagaaggttatggccctttggcatcagctgcatgttaacaccaaaagccttatctcttggaactatctgcgtaaagaccttgaccttgtacagacctggaacctagaaaaggtaattatgaaaaccttaccccaggcttacattccattggcaagattttttcagaaggagcttttttcattactgtgagacttttccccacccaaatggagtaaagtggactcaggaataccattttagagttcgagacctgaggttcttacaagctagaagcagcaatttgaatggtaaaggaaattcctaattagaataagtaacatctttggtcttcttggcaagggtagaaggttgcaggctttttctcactctgtaagacaatcatgtcttttgcataagaatatgtagtaggtgaatacttgtgaacaattattaagagttatgtccagtggggcacaaagggtggttctggggtgctggtaatgttctgcttcttaatctgaatgctgactaaatggaggaattcarattataaaaatcaacatgtttacgattatggtttatgcactgttttgtatatatgttacttcagtaaaatggaggaaaagaggaagtgttacatttttattctgttgcaatttcttctggctttttctttctagcttcgatcctcagcaccaggggagtgccatcagattatgaagaaccttcaggcccactatgaagactttctgcaggatagtcgtgactctgtgctgttctcagtggctgatcgcttgcgcttggaagaggaggtggaagcttgtaaagcccgcttccagcacctgatgaagtccatggagaatggtgtgtgcactgggaagagggaaagagaatagtagaatgagagcctttcaaggggttgctgtgaaacccttcatataaatgagagagtaacatcaccacttttttccatttgagtagctacgaacttgagatagagaagaacttatagatgaattctcaaaatcagatcatggaagaagtctgttgatatttcagtcattactgctcatcaacctatcacattttcttgtggctgtaacatgtttggactctcaaagattagtatacagtatgtgaaatttaggatcaggtaggattaggcagaagattccctaaataaagccttgctttcattagtaggatatcaggtctgcttatctctgatgtcgagcttactggtcttttgtgtttgttcattcacagaggacaaagaggagactgtggccaagatgtacatttcagagttgaagaacatccggctacgcctggaggagtatgaacagagggtggtcaaacgaattcagtctctagccagctctaggactgacagagatgcctggcaggacaatgcattaaggattgcagagcaagaggtaagccctaagagccatgtggatgctggttgtggagtgaatgctttcagagttcattggatggcaagagtatggcacctaagaaatgaggcaatagactcaagacagtccttctcaggagttcttcttgcagtctataaatgtcttttacccgtggagaagtgtgatttcagctccatgtgtattgctaaatgttgattagtttcctacagagttgagaaggcaaacagactagtaaatttttctaagcagtatatttgggctatgtattttgaaactgcttagtagagatgctactcttttattctatcccttatgtgcctgtgttactttaaatgacttggttaccttcagtcatatgaccaataaatataaggaatgactctgatttgaatgtgggctctgatacatgctctgtctgtgactttgagcaagtgagctctcatccctagtttactttcttgtaaaatggagatggcaatgcacgatatagggttattttgaaaattaatggtatagtacatataatgagcttcctgaaaaagtaaaatactatgaaaatgtaggatagtattcttgaagtaaaagtagcaaatattttttgctttattaagtcctctgaggcatacaaagaaaagtaaataaagatccttgttttttggcttatagtgtagtgaaaggaaaataaaaagtcgaagttacaattggagacttcagtataagatataagaaatgtcatgaatagtaactagtgtatttccaagcaaagattgctgtaggaacttagagtgtttctagaacatttctaattagaatggtatgagagagctctatgaaggctattaaatttgatctgggagcttaaaggggatggaaaggaatggctaatgaggaggagtgatttttctaactttctattttttccccccaaacctgaagagaagagtgagagggaagtatgatttttactggtggagagggaggtaatatgaggcatatcatatgagcctgggaattctcatgtggaagctttttacttttctatagggtgatacaaaatctatttgtccctgaaaaatagaactcactaagaaataaaggttgactgcatgctttgggaggccgagatgggagaatcgcttgaacccaagagtttgaggcttcagttagctataactgcaccactgcactccagcctgagtgaaagagaccctgtctcaagatacatatatacatacatacatctaaaatacctcttcctttttaaaactttattttaaaataatttcagatatatagaaaagttttattctcttatacctttcacccagagtctccaaatgttaccatttttgtgcatttgctttatcattttattmtatatattatacataataacattccttttttatcttgagagtaagttccagacatgaagctcctttattcctaaatacttcagtgtgcatcttcaaaaaacaagggcagcctcttacataaccacagaacaatgataaacatcaggaaattaacattgatacgggttgagtgtggtggctcacgtctgtaatcctagcactttgggaggctgatgtaggcggattgcatgagaccaggagttcgagaccagcctggccgacatggcaaaacctcatctccactaaaagtacaaaaagtagccaggtgtggtggcaggtgcctgtaatcccagctattcaagtggctgaggtatgagaatcacttgaacccgggaggtggaggttgcagtgagccgagatcacaccactacactccagcctgggcaacagagcaaacctgtctcaagcaaacaaacmaacmagcaaacaaacattgatataatactgctatccaagctcacgcctcattaaaatttcatcagttgaccaaataatgctctttacatcctcataccatccatccctagctaccccaagaaggaaggtccaggattcagtccaggattacatattgcatttggttgctgtgtatcttcagatttctttaacttgaaatagtttctcaactttccatcatctttcatgaccttaacattttttttatgagtgcagcccatttattttgtagaataaatgtagaatattttgtccttctgtttgtggttacctgaggtttcttcctgattagtgttaggtcttacaattttggcaggaatcctgcagaagtgatactgtgtccttggtatattagtgtgtcatataaggatacatatgacattactggtgatgttaattttcatctctggttcctattttccctttgtaattactgagtatcctatggggaggtactggagacaatgtaaatatcctatttttcatcaaattttcaccaactagttttagcatccattgttaattcttgactgaatcacttcttagtatcatagttgccaaaagctgcttttctaattctgtcgttccttctacataaaaaacatgtacattctatggaaaaggaaaaaccaggccttctttccttttctgtagtttgtcttccttctctccctccctccctttttttttcttccctccttcccttgctttcttctttcattatttatttatgtcaatatatactcatggattcttattttattcaatggtgtgtaatttgttactgtcattgttttcattgttttgatgctcaaaatttcccaaagttagccaatggaagccccttcaagctggcttttttgtccttttaacatgtccccatcattttttgagttatttccttctttctcttttttttaaatagagatgaggtctcactatattacccaggctggtctccaactcctggcttccagcagtcctcctgcctcagcctcccaaaagtgctgggattacaggcatgggtcatgatgcccattgaagttctttctttttgacaaaataagatcttccaggttcatcttgctttttccagtctcaaccctggaaatcaactgtttctccaaggagttctgattcttttgggcagagaatattatttagaaactaagatctgggtaccaaatgtattcattgttgttggagtattattgcttataggcccacttagcagacagagctagaaaacataggcygggtgtggtggctcacgcctataatcccagcactttgggaggccaaggcaggtggatcacctgaggtcaggagttggagaccagcctggccaacatggtaaaacctcgtctctactaataatacaaaaattagccaggcatggtggcgtgtgcctgtaatcctagctacttgggaggctgargcaggagaatcatttgtacccgggaggcggaggttgcagtgagctgagatcgtgccattgcactccaccctgggcaacaagagcgaaactctgtctcaagaaaaaaaaaagaaaacatatatttacaaatatatatatgcatacacacacacacacgtgttacatatacacacatatacatgtacgtaagtttacagatatagatcaatatatttattgatctctcaatttctctttctctctctctctctctctcwcacacacacacacacacacacacacacacacacacaaattcatatgtatttgtctccccatccagttcccaacccatagcacagggattattctagcctctttccatatttttaacccccttccccaagagagaaaaacctgctttatgttatccacagtatatttacttattgttcagtcctagcatttacagatagtagtttcagaattgttaactcactgcagtaaacaaacctaccaaactagagtttaacatttatttatagttccttatgtctttagcctaaaggtatatctatagttcgaatactgagttcagaaattgcttgtgtgtgttcttaccctttcttccccttcagtgtgattatgttatttatctgaaatacagttaggcttatatatttctgttgtgttccatttgagagccacccttaaattttccttatttatttctttacaagaatgtaaaacattaacatggttctaaaagtcaaatctatacaaaaagaagtgtattcccctctagctagtccttttatcccctttgccttccttygatcctttcaattccatccttttcatctcattagtttctggttatcctttctgtctgtctctttgtataaacatatacacatatattttctcattttcccttcttttatatacaaaatataacatgctatagatactctgttgactttgctttttctgcttaaaaatatatcctaaaaccacttaattcacagaaatctttctcatttcatttacagctgcataattctccatcgtatgtctgcttcatagtttattcaaccrgcctcctatatatgggcatttaggtggtttccaatatttagctattacaaatgtggacttctttctaccttttttgttcaattctgtctccctctttatgtgtgtcttgttcctggcagcacacccaggaggatttacagcaattgaggtcagacttggatgcagtttctatgaaatgtgacagctttctccwtcagtctccatctagttcaagtgtcccaactctgygctcagaactgaatctgctggtggagaagatggaccatgtctatggtctctctactgtatatctgaataagtgagtgagctgaggttttgggtccaagagcaatattttccattgggataagaaagagaaaggcttaaagtatttcatgaataatacagagagattatagatcctgaagagcatatactgataatgagaggtcttggcttcagttcctagtaacattaagtaggttcatttggactgcagtgaagaagtgccagtgatatgaaaggggaattaatttgcagtgttgggactatgatttacctcacttctgtttgattaaatatttctgaaaataatacttaatggcataaagacaaaggaagagacactaaagaataaaaagaaaagtttttagttacactaggtattagactttgaaggtcttcmctcttcccacccatctctacctatgaccttgaagagtagcgcatcttaaactcttcatagtgtaaaatgggtttctggcttcatgcctttcttccatgagtccaccacatgtatgcatgttccartgccacttagaactttattttgaattggcttaaattggcagcataaaaaccacatttacttgttttcacaaaaccctgtcaacatctaaaaatggtgacattgattttggttattatgttttatgaacctctctatagcactccaggtatataamcctggctcctaaaattcatgtgttaatgaaggaatgtgtatttgtccccacaggttaaagacagttgatgttatagtacgtagcatacaggatgctgaactcttggtcaaaggttatgagattaagctgagtcaagaagaagtagtactggcagatctctcagctctggaggcccattggtcgacattacgggtgagttgctctgagtttcttaggaggttgacctaacatattcattgctttgggttagcagagaaatgcaattttggatggcatgacactgatttaaatttgcatttgaataaggcagaatgtcattaaatatattttaatatgtattcaaagaagaagggactgagaagtatgtctagctagaaagggaagagaaaggactaggtwtttctatttattttttcccttttcaccttaataaaatcatggattaattggatacagtcagtggttgtgccataagtttataaatcacttagctgttatctaatttgattctcacaagccactctgtgaggtggacaagaagagatttttctctccatttacagatgagaaaaccaacacttactctggctaaatgacttattttggtttcatatgttataagtggtgaagccaggtttcaaacacaagttctatgcacatttctctatagagtactgcctgtccttggcatcccagtgtgtatcaggaaagcagagaccatgacatgtggaggcagtcctggcacaaacattccagggcacaatcacatatacaatgtggaaatagctgtagaccgtgtccttgtttcccaccttagactgactcctttttagcatggaaagtatacaacctgtttctgtacttatgtttccacagcactggcttagtgatgtgaaggacaagaattcagtgttttcagtcctggatgaggaaattgccaaggccaaggtagtggcagagcagatgagtcrtctgacaccagarcgaaatctggatttggagcgctatcaggaaawaggctcccagctgcaggagcgttggcaccgagtcattgcccagctcgagattcggtsagtggtggccccacctttttctyctattagagttcagggactaggtcttaaacaaaaacagagttatatctgtacatttatatttaaaggtggaaatggatagggaggggtggaaatttaaaaaccacataaattctggacaagtaagtgacagaaaggtgagaccggcaatctcaaagcagatgtaatgcctctcctgtgtcccaggtcttttctagttaagccactgatgacaatggcttcctggaatgtagacttgaaaggtccctggtgatcttttctcaaggacaaaacctatactctagttcttgttttattagctttgtatccaaatatgagccattttttatgatggagctttacagaatttcttgytttcatctcatttgctaattcagtaatttttcatctctgttactagaggtcctgcttctaatgacagatgtaaataggaaggacagaaactgcaccttttggaggctaagctggttagggaaatttgtagggagaggagcttaacaactcataagttttcattctaattgaagtcttatcacaaagctggttagactagagaagtgatatgacttattggaagtagcaggaaataatgactatttttcacttctctcccctctctccttgagaaattatagtgattcataaatcatagctgtgctgtactgacaggtactctgtcatcagggaatagaactgtacagccaatactaccttattggtcaccctggtaattcttggcaacctaggtgaaaaatttgacaaggattattgtgggatgctagaccacaaggcagcatccagggctagcaggtcacaactggtttctactcacttttttgaccatagggcactggtacatgcataggtctcactcagccttgcatcgctgttccccgtagataaagatggatcgtttgtggtcaagcccagctggatacatgggttaaagagggaattacctcatttactttattgtatttgtaccaaggtatctgatagcagtttccctttgttcttctagccaatctgagctagaaagtatccaggaagttctgggagattaccgagcctgccatggaactctcatcaagtggattgaggaaaccactgcccagcaggaaatgatgaagccaggccaggcagaggatagcagagtgctttcggagcagctcagccagcagacggtgagtgtggtagtagctctggcgagaagagttagaaatttaaattttctttatcataaaagaaaatgatrtactggcaattaaagcttcctccaaatggaagatatccaaattcccttttctttgagtggtttgagcaggatcgtcccaagatactggttttgcatttagactagagaacctgtaaggtaccttcagttctgagtttctgtaactgtattgaaaccactagatggacagattaaaattatctttattttgtttttttttatattacattttattttactaggattagatatggggttttgaaaaccaagggaaaattgtaagtagaagaaaatgattcttttttttttgaaaatgatttattttaagcattttttttttgttggtattttgttttgttttgttttgtttagcattatggttaagagtatgagatctggagttgtattgcctggattccaattctggctcacttacctactataagcctttgaagaagttatttagcttctcagtgttctacttccttatcagtaaaatggacatagtttgttatttatttaacctaccttatgagattatcgktgctaggattaactgaagtgatacatgtaaaatacttagaatagtggttctcaaagtgtggaccccagactagcagcatccgtatcacctggggacatgttaggaatgcaagttcttgggttgggcacagtggcttctgcctgtaattgcagcactttgggaggccgaggcatggggatcacttgaggataggaatttgagaccagcctggttaagaaagcgagaacttgtttctacaaaagattaaaaagacaaaaaagtgcaaatttgtgaacccaaacccactgaaccagaaactctggaggtgaggcccagcagtatgtgttttaaccaccctttccagcaattctgatgcagctaaggtttggaaactactgccttagaacatagtaaatgttcagctctttcaatggtggtaatggcaatgataatgttgtgatattttgcttcctaggccctatttgcagaaattgagagaaatcagacaaaactggatcaatgtcaaaaattttcccagcagtactctactattgtaaaggtaactttaccacatcccaaaaagaacatgaatcatcaccagctcaggaaaacctacatcttcactgtaggttctgtttctagacaaattaagcagagttcttatgctacaagctggcctgatccttcagttaagcagatgtgtatttcctgcaaccccatgtttggggttgcttggagaagtagcagacgttggctgtgatttgaggagtctccatttgcrtgaccgtaggccctttaaacttaacatggcaaaaacagaatgtttgagttttcttcttaaatatgcttcttacttgtctttcctatctcaggaaatagtatggccatttttttctaattgctgaggcaaaaaacccaggagtcatcctaaactgttctctttgccttaagctttatattctccgttggctcttgtcttcaaacatgtcccacatctgactgcctgccgttatctcccctctatttccctagttcacattccagtgaagaatcttctttagactactacagtaccctctgagctggtctcttgcttctgctctggcccccacaggctattttcccacagagtagccaaaatcccctttttagaacatattgcatgtcactgaatcttagactccattgattacaagctacaccataattttctgcatgccaaaaagaggaaaaaagaagaaactctgccagttatgtgacatgccattgattctaaaatatgttccaatttgaaagactaaaatgtggagaaaatgtgtaccttagaatagatgaaatacagcaaataagatcatgtcactctcctgctcaaaactgtccaatggcttcatatcatagtcgtaataaaattctaaattcttacatggtttataaggccgtgaatgatttagctctcccctatttctcttagaatatctttaaggaaaaatgacttgaggccaggtgtggtggcttatacctgtaatccctgcactttaggaggccaaggcaagagggttacttgatcccagaagtttgagaccagcctgggcaacatatcaagatcccatctgtaaaaaaaaaaattttaaattagctggatgtagtggtgtgcacctgtagtcccagctcctcaagaggctgaggtaggaggctcacttgagcctgggacattgaggctattgagccrtgattgtgtcactgcacttcaacctgggcaacagagaaagactgtgtctccaaaaaaaagaaaaaaataacttgagattattacatatttatttgtttattctgtgactcttactagaatgtaagttccaagggagcaaagtttttcctgacttgtttctcagtgtgtgtgtatagcactcaaaacaatggcaagtacatagaagatgcttaacaaatactttttgaatgaaggctttcctttagttaataacagaacactcactgtaagaaagaattgagttcaaacccttcaccattttccaggcttactttgagtatgcacttagmctatgtttctgttactgtatctataaagtgagaacaataatacctcactgagtgattgtaaagattaaatgagataatgtatacataggaccatgcctcaaacttaaagtgcactcagtaagtggtagcaattgctttgattatattttaatgttcttactactatttttttatgggttccttcacaaattcattccttgttttccttctacccrgagtttttttaagtagacagcagaaggacgttttaggcaaaggaactgcataatcccaggcagagaagaatgaaaatacttgattatatgaggaaatagagagtattctgatatagctagaaggcacaataaggagcagtgactatggaaaattagcggtgagattggggccaacccatgacaggccttgttccattgttgtggctttatcttctattcttgcttctcaaagtgttgtctttgaaccagtagcatccgtagcacctgggagcttattagaaatgtagaatctcagacctgctgaatcagattctgcattttaataaattatatggggatataatttatatgcatgttggtgtttgaaaagctctattctagatcattgaaagctttttaaggagaagagtgatgtggtcatctttgggttttagaaaaagtattctggtggaacaatagagaataaattgagattagactagaagcagtgaaagtacctaagaggctaccgcacttataaggctacttcatgtgagagaagaagagagtggactagagcagaacttgcagggttgcagaggaagtggcagaatagtatggtaaaatgagaatactggttcagggattagaaatctaagattctaatcctaactctgttaacacttacccacttagttaattagggaaattcacatcccctctctgggtttcactttccccacaggtgagatgaaagggttggtcagactgcaactaaggcgtgagcaaactatgacccacaggccaaatcttgtccacacacctgtttttgtatggcccatgagaaaaggttgaaaagaaaatcaaaagaataatattttatgatgtgaaaataatatgaacttcagtttttagtgttcataaataaagttttattctamcaaccacaccctttcatctatatattgcctatggctgctttcacttataatgagagagatagtatggcctgatattttctgtctggccttttacaggaaaagtttgctaacctccagcatgagtggtcaccaaaacgcttccagcaataaaaagctatgatttattacatgatgtatgtgaattataaaaccctgagtaactgtagcgaaattcatcctttcctaggactatgaattgcaactgatgacatacaaggcctttgtggaatcgcagcagaaatcccctggcaagcgccgtcgcatgctttcctcttcagatgccatcactcaagaggtgagagggtgggggaaggaaatacaccactgtcttcccttaaggaaagattcatttgcctgggccttacattttgatttagggctcacttttctggtgaacatgtgactgcatgaacatttcctcttattttgaactatttaaatttcattttctggcagacgatttatttaaattgttcttttgaaccacagttcatggacttaaggactcgctacacggcattggtgactttaacaactcagcacgtgaaatacatcagtgatgcactccggcgtctggaggaggaggaggtgaggacagttgggtccaaagtcatcttgaaagtacagtaaaacatcttagccagcacggtggtgtgtgcctgtagtctctggtacccaggtggctgagttgggaggattacttgagtctaggagtttgaatccagcatgggtgacatagggaaatcccctctctacaaaaaatatttaaaaattagctgggcatggtggcacacacctgtggtcccagttacttgggaggctgaggtggaaggatcacttgggcctgggaagttgaggctgcagtgaccatgattgtgccactgcactccagcctgggcaataggctgtctcaaaaaaaagcccaaaatatcccacataccccgtaaatatatacacctactatgtacccacaaaaattaaaaaaattttttaaaccagcaaaatatatgctatatatgtaacatataattaaattattatataatatatattttatttgagagacaaggaagttagaatactatgtataattatgatttcattaaaaacaaaactgtgtactacaaagacatggcatagaaagaagtttataggcacctataccaaatttctggggaaataacgttaacttacataattatgtattttagacttgtttgaatttattgtaatgagcatgtcatctgtttgtaactgtaaaaatcttctgtctttgtaaaataagtttctgcatattcagcctctcttataaaaaaaaagctgttaaaacattaaccataccatcttttgctttttaaattagcaagactttctttatatccatacctacataatgtaatctcagtaggcttcagtctcttctcttcttacagattcacctgtaaacctaagaattatgaaaatgagtaagatgctatatgtgaagagatttttttaaaaagcatcaaataattattgagtgcctattatatataaaacagtggtttgtatttttcagaaaggtattaaacctaggtataataaatttagctcacaaacacctgtgagcaatactgtaggctgggctaaattatacttggggttattttcacagcccacttatttaggtaactgtatctgtttttaggaagacttcatttaagaaaatctgaagtcgtgccagcctaataaaagacattgctagcatattgattttctatttcctattctagaaagtggtagaagaggagaaacaagaacatgtggagaaggttaaagaacttttgggctgggtgtctaccctagcgaggaatacacaaggaaaagctacctcatccgagaccaaagaatcaacagacattgaaaaagctattttggaacagcaggtgagaagaaggtccatctctgtttacctgggtagaataatatgtgataatacattaggtggaatagtagaagtcacatgtgggccattccagaagtgattgctacctgagtaaatgttaaagaaacttaagaagccatcttgtttgttcttgtacctttttatcagctgtagctcattggtgataataatttgacctaagctgcatattttctctaggatttaaaaaaataattttaaataatttttgactcttaattcttgggttttgaagctttttctctttatttctaccatgtaggttctgtcagaagagctgacaacaaagaaagaacaagtctctgaagctattaaarcatcacagatcttcttggccaagcatggtcataagtgagtattaaatgagagattatggcacatctggggcacctggtctatcagtctaaaacttacagccataatgagatttcagaatggagaattcagagcagcaagagccagattatggggaccctgtagttcatacggaggagtttgcatttaatttgttggctatgggaagagattttaaatgtgattgtgttttacttttaaaggttgctagaacagttatatgaagaaaggattgacatgtggtgagaatagaggctgagaggcctgttaagaggctattctgataatgtagacaagaaatgacgaggaatggaaacaaagagactaatattcaagagatgttaaggataatgaatctatgggtgtggttacacatgaaaattatcgcataaagtgacagagatttgaattatcagtgtattagaaaccatgtgggtagattactcaaaagggctttttggggcttctcagcctgttaaggaagcctcagagaaggaaaaggaaaattatgagtgataactcagaacccaagaaagaacagagttccaaaaaggagagaagttcagaagtcaagaaaagttgagaaatatctgttacatttggcaagttagaagtctttggtgcctctggtgacaagttgtgggatgaggtcagatttagtatggtgaggagcacattggaggcaagcaaggcgaaacagaactgctctttcaagaagccaggacataggagcaaaaaatataatagagtcaatatttaaaaatgaaatatatggtcaagaagggttttgttttcttaaaagatacaatggacttaactatgttttcgagtaagtctcaaggacaaaggggaggagataattagagaaaggtcccagtggacatgcaagaggaggaaactcattgatagttagaaagtacaaccttaaacaggaaattgggaccaccttttttctgaggtggagatgagggaaaggagattaagaaaggtatggatagaggtaaatttgttaggaccgaagccagaaagtaagagaattagtgcccagtggtctgtattttctctttgaaataggtggagaggtttgttgaaaggatggtgccgaggagaaaggaagagggacttggctgggaatttacaagaggattgtcaggaagtattgtgacccagttgagattggaaaccagtgggctctgtctatgtggttgtggaatttttttttctctaactggatttacctagcagccttagtgtaggagcagaagagactggtggtttgattgatttggggttgggcttttatcaggttagcgagtggagagtgcaaggataatggtaaggaactgatcaagaatatggattgtggggtctggcctctgaagaaaagaaacttaatagagaggactgatagaataagaggaaatggaggcattaaggaaggcttaggacatatccatgagttgatggatagatcccatttgaatcaacagagttcattctcagaaacataatgtggaatgaaaaaagaaagttgcgggattcatcagattcaagaggtggttacctttgggaagaaagggaaaggaatggacttggtgacaaatatacagtgggctttaattatatctgtaatgtcttatttctaagaaagggtctaaagcggccaggtgcggtggctcacgcctataatcccagtactttgggaggctgaggcgggcaaatcacctgaggtcaggagttcgagaccagcctggccagcatggtgaaacccagtttgtactaaaattacaaaaattagctgggtgtggtggcgggcacgtgtaatcccagctactcgggaggctgaggcaggagaatcacttgaacctgggaagtggaggttgcagtaagccaagatcgcaccactgcacttcaacctgggtgacagagcgagactccatctcaaaaaaaaaaaaaaaaaaaagagagaagaaaaagaaaaggccctaaagcaaatatgtaaaatagtaaattgtgaaatgaaagctggatagctagacaacaggtaaataagaatgtgttacattcttctgcctgtttaaaatattttattttaaaaagaaaataggtatagaaggagtaaagaaagataaaactgaaaggtagagttataatcatatagtggattcttgaagtctaagatttcagaagcagaataatttcagatgataggatctaagtttgacatttgggggtggggctaaagtggagatgaggtcatttgaactacaagcataggggtgacatagcattgacatcatcaagaaccatgacttgatttgagataaacagaagaactgactgaaatgccaaagtctccgatgaatatggaagaagatcatccatccaagatgaagaagtagcaattttgaagcaatagagcagagtttggagattgtttttttttctcctaaaaaagctttaatgcttcatcttccaggctctcagaaaaagagaagaaacaaatatctgagcaattgaatgccctaaacaaggcttaccatgacctttgtgatggttctgcaaatcagcttcagcagcttcagagccagttggctcaccagacagaacaaaaggtacttttagttttcatctccaaatattgggtggataccttttgaatggtatgaaggcagctttgctgattcagagtcatgatcactagctttccatgaccaatgtgacttaatttttaacctcaccttakcagccatttgtcttgtgtttctttactggggttccatgatgtgttggtcagtcaaaagcactagaagacacttacaactaaccctttagacctggttcaccttttttgtcttatgccattttgtggcagacagcagtctaggagaacataaattctgtattatatgtgatcacagggcagtaacatactcccttgtggcattgtcactcaaaagttgatagccaaaagttctggatattgggaagaaaaacctgtgaacctcttccctctatactaaggcagtaagaaatattaagttccaaagcaaactggtagagtagtttcactgactaagacgctggttcccctcacccatagtcatctcatcatgtggcatcttgaccagttcccctccatattcatttcctggaccatgtgaaagtcatcatagttcctactggttgtcctaagttcttcctggatacttgtgcgtgtgtgtacacttaccatattatatacatgtgtctctgggatatatatgtgtgtttgcctgcttatttcctatgttgtgaagcaatggccaacttatgtggggcaggccaaaattaagctcacgtgatagtcaaatttggtccagatgatgctcaaaatgatattcagacaaagcatgtcttgattctgatccttggatataaattttgtgcaacaggagctagagttgtaaaaaccacaagacaaaaccagctatgatttgatggtgtatttccaaaaacaaagtgctggtgtaacattctccatttaaggtagcccacttccagtggcttgttgcttcaccatataagggagtatgtgaaaagttttaacaattgcttgctgagaacatccggttctcattttgaaaggttaaaaaagaggggggaaaaggaaaaaaagaaaaaaagaaagacaggacaggctgctgagcaccactacattgagcatgatgtgtctcctgtatgtgtgtttcatgtgaagtattgktctgattaactgacatccttgcttacaagtttcactaaccctttggagtttaagcacaaatgcacaaagggaaaagaggacgacctgtttggggttcttttttgcaaaaacaaacagtcgcatgctggacgctaacaccaagcttacactgtgtgtgtgatacggctgagctgctccataaggctctatcttttatctgcccaaggcgtgccctgcaactctggtaagtagaagccttttatgttttctttcctcctctccttctatctcttaatgcttgtttaggtcagaatgtccatgtttggtaggacagaaatgagtttctctggattttttcccagctgagtatttcctgcctatccttcaattatatgagggtgttggaagtaacagtgtagacttttctctttggctacactgcaggcctttcttcaatgtcagcatttttgagactccatgaatctcacaaaagaaatgaaaagttctcaaagggatgtttttctttgtcatattgtctgttctgaatagtctttcatggattttctaaaaggaatttttaaggtatcttgaaatttttcagttatcacattccagtgaactttttccttcaatttctttaaaacagacacatagtgagtttgtataatatatatgtttaaattatatgaattggactttctattcttggtcagaaaacatggggatagggaataaataatactttaaatagtgtagagaagtctgtcagttattccattgattgaacacatatgtagaaatggagatgagaaccaaatatactgttctttcatttgctatccattctgtattcttattgtatgcacctcatcaagcttgaaatcctcagtgcgtgtttctaacacctgaggggaaatggcttaatgattttaagggtttccttattatttatccatattcatcccatatttattaaatgacagytactgttcctagaccttcatggacaatggatcagctcttacagaacttactcactgagataaaatgaaatgccattatttaggaggcagggaaataattggaaattgcttccacaagatcctctatcaataagatagagagttaaataagtaatcagaaagtagcactgaccaaagagggacagataaaattatatacagaaaatgaaaataatgaacatgaaaagaagagctgaaaagttggagagtaataaaaatgatgaagtgttgtaagtggttaaacacttaaataatttaaaatctgaatgtattattctgtgataaaagatctcaaaaatgagaattctttaggagctgtttctaggatttgcaagggtaattttgacagcgtatatgccttattcactgaccttcggacctaactcctgtgttaagatgtgactctactgtacttgtcttttacagttttctgggtctgactctgggaggacaaacaagatttagaatcagaccttgatttgtttctggaactcactagttttgtgaccttggacaagttacctaaactctgtgcctcattttcatttcttcaaactaaagattcaaacaattgttttcataggattactgtgagaattaaatgtcagtgttcagtagatctagtaataagtgatagctgtagtcatggttattgtactacccattctagcctggatcagaagaaaagttactagtggttccataggcaagggtccccaatctgtttcttccttgacttgctacttccaagacctagaactaacttaatttagagccattgccttgggagaagctagcattgtccaagaatatgagtatcccacttgctaaatagttgcttgagtagtatacacaggcctgtttactgggatgcacaattgttctggagcttctgggctgcataaatctctcttattctatggaccagtcctgctgtgctcatcagcagggaattgctacttctagagtcttctgtgtggtttgcaacaccaaaaacttgttgtatggcgttgaattctcactttgggggaactgttacgtgtctttaagaacatttatgatgatttagtcttagaaataagattaaatcctatcattttcactgcttaccaccctgtagagcttgtcactcagatatgcttaatgccactatctctcaagtaatctaggaacttctgacctattaaacattctgcagtttagaaaaactcttttttagtcttaacaccgggtggcttgcttcagaatatttcctacatgttggggcttatcccatgctgggttttccttgtggtcagaattttatatactgtagtactttttttttttttttttgagacagagtctcgctctgttgcccaggctggagtgcagtgatgcaatctcagctcactacaacctccacctcccgggttcaagccattctcctgcttcagcctcctgagtagctgggattacaggtgcgcaccacacccagctaatattttgtatttttagtagagacgggtttttcaccatgttggtcaggctggtctcagactcctgacctcatgatttgcctgccttgggcagattataggcgtgagccactgtgcctggcctgtatactatagttctttgaatgactcctttcaatagttgtgctttgccattggctctgattcagttttctttttcttctcttttcctttttttttttttttttaggaatgcagagcagttgctggggtgattgacctaggcacagtggagatatttcccatcttcaaagccatgcaaaagggcctccttgaccaagacacaggcctagtgcttctggaatctcaggttatcatgtctggcctcattgcccctgagacgggtgaaaacctctctttggaggagggcatagccagaaacctcattaatccccagatgtaccagcagctccgggagctacaggatgccctggccttaataagcaggcttactgagagcagaggccctctttctgtggtggaagcaattgaaaagagaataatcagtgagacagttggactgaaaatcttagaagctcacctggcaactggaggtttcagtctttcccctagtgagaactgtattaacctggaagaggcttttcatcaaggcctcatttctgcatggcttcattcagtattagagtcttatcttagaacatccaagaatttgatagaccctaacacagctgagaaaattggtttgctggatctgatgcagcgatgtattgtccaccaggaatcaggattcaaattactgcctgtcaaacaattggcaggggggatggtgagcttgaaatcaggccggaaggttagcattttccgtgcagttcaggaagggctaatagataggcaggtcactgtccggttgctggaagctcagctttttgctggtggcatagtagatccaagaacaggacacagacttacagtggaagaggctgtaagacataatctgattgaccaagatatggcctgtgctatcctcataaggcagcttcagacaggaggcatcatagacactgtcacggggcaaaggctaacaatagatgaagcagtgagcaatgatctrgtagctgctaagatcgcccttgtgattctggagtccctctggtcattcatggggttgctgtggcctgaatctggagagatcctcccaattacagatgccctagaacaaggtattgtgtctactgaactagcacataaaatccttagtaaccgacagcatattaaggctctgtttctaccagcaaccacagagattttgtcctggaagaaagcaatagaaagtggtatcctggatagagatcttgccaataacttaaaatcgatttgtatacctgatgtgatgccccacatgcaactagcagactctgcagaacaaaatattaatcctggagcagcagttctaccgtgcagcaagagccaccctaaggccacagcaagccagagtgagaatctgttgttccagctgatgactcacagctatattaatgtgcaaaatggacagaggctgcttctgttagataaagagctgatggagacactaacatccagagatgagtatcaaacaagtcctccaaaagtggttgaaattgggcatcaaaggcaaaaaactcctgagggattgcaagaatcagctaatgtgaaaatctcaggaactttcagcagtgggtggactgtgaggctgcctgagttccagttttcttctcagaacaaagaatatcccgatcgggaagattgcaytacagaaaaaggcaaaaagaccactgtagaaacagaagattcttctgtagagaaccctgaacaggatctgtttgtagaacaaaaagagagaaatccaaacattgatgctttgaaggtaataaataaagtcaaattagaggtacaaaggcagttgataggtacccaaagggaagaccaaacagcagtgtctgtcagagaaaatgccagcaggggacacctcctgaccatacctcctgctgaggcggaaggtgtgccgttggtggttgacaaagatgttttttctgttgaaacaccaaagaaagaacatcaacctctaagaaacacttcctttacatgtcagaatgaacaagcacacactcttgagactgaatatattcatgatgaaactggaggatctcacataaaaccccaaagcaaaaagttacaagttcaggtaaagaaaactctaggtataaagttagaactaaagtctgaaactgatgggaatgttcatcctctggacaaaaaggaaatgttaaagaaaacatttctggctaaggatgaccataaagaaagtcaagaagcacagaacatcgcaggtggtagtatgatgatgtcagaaaagaccgatgaggaagatagtggcagggaaatttttctgtcatgcagtcatccattagaattgcttgaagaagctaccttaaatgtattatctgcacagttactagatggtggtatctttcatgaacaaacaggtcaaaagctcttactaaatgaagcaatatcccgaggcattgtgccaagtcacactgccgtgaagcttatggagaagctgaacatgtttcaggggttctttgactctcagacttgtgagtctttgacaactgaagaagtcattaatgaaggtctgatggatgagaaattattacataatgtcctcatggcagacaaagctataagtggtgtcttagacccccgtacccagacactgtgctctgtaaaggatgcagttacagttggacttcttgacaaggaaacagccaccagaattttagagaggcaggtggtgactggtggaattattgatctgaaacgaggcaaaaaagtttcagtaactttggcctcaactcttggcttggtggacgttgctgaccagccagaacttataaatctggagaaagcttccaaaggtagagatgctgaaaaaacagttagggagagattaattagtttacaaatggaaacaacaggacttatagaccctgatagtaaagsacctttaacagttgtgcagtccattgacagaggtcttttggagagagaggaggccgttcgtttgttgactaagcaagtggtagatggaggtatcattcaccatatatctgggatgagactttctgttgataatgccttcagacatggcttaattggtgaagatttagccgagaaactcaaaagagttgagaacttaaacatccatcagatttttaatcctgaaacgaaggaaaatatttccctccctaaagccataaaattagatcttattacctcagacctgaaaagagaaatccaggaggttcaggcctttactggaaactttgtggatctcatttctggtcagagattgaccttggcagaagctaaaaaagaaggactgttaactaatgaagcagtattgtctccaggaatgatgcatggcattgtagatcccgagaactgcagaattgtcccctactcagaattagtcaagaaatgtaagattgatattgaatctggacagagatatctagaagtaattcccttctcagacattaaagatggggtgagcgacaaagtgcttacattgtctcaagcaattcagcttggaaaagtagactttgcatctacgctgaaggttctagaagcccaggcaaatactggtggaatcatagatactgctactggaaaaagactgacattggcatcagctttggaagagaaactggtggatgaaaacatggtcagaattattgcatctcatcaggtgttaaatggaggaattgttgacatatttagtgatcagagagtgactttagtagaagctattgagaaaagactgatcagccctgaactggcaaatatgatccaaatagatagttcagagttcagcgatcacagggctcagattgaaaagcaagaagggattgaagtgtgtgcattacaaaatgaatttctaggaaaggatatgttaattgcttgtaatcagactgctgaaatgagttgtaataaagtagaagagagtgagagattatttcaagttgaaaatcagtctgcacaagaaaaggttaaagtgagagtttctgatggggagcaggcaaaaaagagcagggaaatttccttaaaggaatttgggtgcaaggatcaacgtaagccaagaatgtcttcagatgctaaagaatttatcagtatcataaatcctcataatcttaaaggtaaatccttgggccaagtgtcattgacacacccttactctgaatgtgattttaaacttaaagaagtggctagaaataacatgggaaatgatacaaatgaagagcaggaaaaagcagtgacaaaaatagaaattatttctcatatgaagcagtctacctcatgtctagattctgaagaaataagagaaaatcaaggggaagtgattttggaagtacaagaaacatattgtgaaacgtcaggcaaattgccgagtgagcaggttttgcagcaaccaatgaatgctcgggtgaaaagtaagagagagaagagggaggtgattgtagaagaaagtatcagaacatgcaaaccagcatttctttctgaagaaaagttgtatcaggaaactgccattagagatgagcatgactcccatataaagagccaacctagggaaatgacctcaagtgaaaaagggaaagaagctgatacagaaatgggattttctattacttttaaaattgaagagtcctcttcccaagtggtacctcaaggaatttctgtaaaacatttagatgctttaacactcttcagctctaaacaggccaatgaaggaaaagtaaacaatttaagtctctgcttgactttaaaaccagaagaaaacttatctcgagaaattgcctgtggggcccagagtgaaccattcccttgtatgaccccaagacctgaaggattgcactaccaggaatcagatggaaaagcccaagtgacaggcccatcccaaatttccaaaacagacaagtctttccaaggaaccaccagacaggagaccaactatcaagattcctgggttacttcgaaaactaaggaaaccaaacatcaaatttcctcatctaatgaatgtaaagaaaagtcataccaagaagtatcttttgacccagcaagaggtcttaaattggaagaaatcacagtttctagaccagattcaaaagaagtcaggtatctagaattctcagacagaaaagaccttcatcatcagggcagcaaaagtgatgataaactttgtggaactctcaaatctgaaatagcaacacaggaactaactggagagaaatttctagaaatggcaaaccctaatgttgcaggtctagaagcaggatccattgaggacatagtgactcagagaggttccagagtcttgggatcctttcttycagagaaactgttcaaaggagtgtctcaaaaagagaatacagggcaacagaatgccatcattagtcctactgttctagagaccagtgaagaaaagacagtgtccctaacagtatgctctgcagtgaagacagagaagacaccacaggaaaagctcagagaaagccctggcagtgaacaaactcccttcatgactgcacctgaaggaaagggaaatggaggtgtaaacccagagcccttcagagcaactcaggtcagtggtgtgcttttttttttttcttcctaaagatacaattagtttaatgctaaaattcttaactgggtacagagtttacatatgtgtaattgtatgcctctatacattttaaggcactagatgattctctaagatataacttagtttatcatcatctgtttgtagcaaagttgttggaaaattaggcattggctctgaatgtctttctgaaatctgcaagggttttaaatagaaacgagctaatagaaatactaggatgatgctacctgaaatcagaatagcttttggaaattttggtaaaatgatgcttgtagattgatagctctgagcttctgctctctgaggaaattggtaaaatcacctttgtctattgatttgaaatgacttaaacaaagtgttttattttatcccactctatgtgcagtaaaaattgcttctatttgtctaacaaaaacccctgcctgctttaaagctgacttacaggagaacgtcagaactgagtcagctttctttttggctccacagaatgtatttacccggcaactctgtttagaacatgatgaaaagctagtatcctatctgtctctgttacggaacattgaaatgaggaccaaacagattcaacctttggagctaaacctggcagaactacaggatctgctgtgtcaggccaaggtaggttcccagagacttccaccacagacaccagcttcaagatagctgcctccatcttccttgaagatttcaagacttactagaacctgcttgcactctattctagggtaaacaatctcagacccttgtcagataattatgggatgggctacatttggatagaccggataaaatttatacaggataaacttgaacagaccttggatttggctatcaatgtaattactaccattttttttttttttttttttttttgagatagagtcttgctctgtcacccagggtggagtgcagtagcggtgatctcggctcactgcaacctccgcctcccgggttcaagcaattcccctgcctcagcctcccgaatagctgcgactataggcacctgccgccacgcctggctaatttttcttgtttgtttgttttttgtgtttttttktgtgtgtgtgttttttttttgagatggagtctcactctgttgcccaggctggagtgcagtggcgtgatctcggctcactgcaagctctgcctcccgggtttccgccattctcctgcctcagcctcccragtagctgggactacaggcgcctgccgccacgcccagctaattttttgtatatttagtagagacggggtttcaccgtgttagccaagatggtcttgatctcctgacctcgtgatctgccctcctcggcctcccaaagtgctaggattacaggtgtgagccaccacgcccggccctaccaattgttatctgcgtggttttggattgatttaggtaagttcaaaggcagagtgattggttaggaaactattgcagtaattcaagcaagaaatgttggaggcttaaamcagtagattagatatgtaagttaatctctcttacttcctaaaactatactaagacatcaggaaaaaggttttttgggtttttttttttagtgcataaattcataaaagggcaagagaggagaaaacagcagtaaaattttagaagttagaaagcagctggatgaggcgataactaccttagcaagstagagtaaaccagatcctcaacttaaagtggaggaagctaaggaacaacctgatttatactacagaactccccaaagcctcaaaaattgggagcaccagaaagagatgaaaatggatatgcaaacgggcttataattggtttaaagtctgtttaagaagcaattagacctttagattttcaacttacttcacatagcctggcaactgcttgtgctgtgctctaacgaaaggctggatgttcattctctgaggaaagtaattcaaagtrtctcttgactagggagagcagccatttattgaaggtaaatattccatacagaaatcagtaggattaactggaagttcacatacatactgaattttgagctatatccttgctcccgctatggtttgaccagcccaagggggaagacctaatggtactgatataagtggtttcccaactgtatggcccagctccatcaccctcagtgaagactacagccagcagagtttatagtcagctttttagggcattacactccacttcagcatccagaaagcttctgatacaaaaggagaggctaaaacaaagaaaaagaaacttggacaaaatacagactatttaggaaaaaaaacatactgagggccagtcacagtggctcatgcctataatcccagcactttggtaggccaagacaagaggattgcttgagcccaggagtttgagatcatcctgggcaacacagtaagaaattagccaagcctggtggtatacaccctagtcccagccactcaggaagctgaggcaggaggatttgcctgagcccaggagtttgaggttgtattgagctatgaatgcatcactgcactccagtctgggagacggagtgagaccctgtcttaaaaaaaagaaagaaaaatatattcaaaagcactgccatttaaaggaccaacaaagaaacaacaacaacaaaaatagattgaaaaagtctaactggagatctctgaagaagacctggaaacactcgtctcacagaaaccaaaggaggaggagtcagccctagtaactgccacagggagattgagtacaatgaggactgaaggggagattcagctcctgaaagttattggtgactttgaacagtttcagtggagtgacgggatataaactaacttgcagctggaagaaatgggaggttggaaagtagagacaattaatatagatccttctttccagaagtcttaggtacaggcaaggaatgaggtgggacactactygaaggagatggattgaaaggaatgttttgaatgggttttggactgaggagaaagaaccaattaaaagggagaacttgaagttagaagagagaggaagtgataactgatagaaccagtcccctaaaaacgtagaaagacagccttgagagggaggaagagtggctatttcactgaaattggaggttaagagttgtcataggattggagtcaccatgaagacarattgtagtggtttactggttctctcaatatctagtgtgtggccttgggtagggtggctgaaccggggctgaggatgatgccccaaagaactatgtcaagttcttccacagcttatttccggcttatctgttgaggaccagaatattacagactagatgagtggaaaagctggttggggttagctttgtattctttggttccatgaccctggaatttagagtggaagagtcatccgttcggtttattttgtagcacattaattctgcacagctgctccttggggaaaggcataatgacactctcagagaggcagcaagttacagtggagggagcacactgcactgagtgagaaaacctgaatccaagtcctggctgtactgcttaccagctgggtgaccttggacaccattcacattttttttttaagcaatgaggcatctcttctgtaaatccagaacagtaacatctaccttgcctacttcatgaattagtgattgtgagaaccaagtaaactaatgaatgtacataaaaacattttctaagccctaaagtgtgtgtagacatggggtgagagagaaatgtgttcacagctgattcccagagggtttctagtcttgcttttataggtaactccactttattccctcaggtattagaaagggagttaaaggatctgaccaccttggtcagtcaggagctggagtgtgtgaatcagattatcatcagccagcctcaagaagttcctgctcaactgttgaaggctctagagaaagatgccaagaatcttcagaagtctctcagctctgtgagtgacacttggaattccaggctactccacttccagaatgctgtggaaatagaaaaggtagcattttgcttttattcataaaggctcacaaagtctgggtggctgggagattttcataatgtgattttccatttatttcttagactaaagtgttaaatcagcacacacagctagaaggccgacttcaagatctgagagcctgggttggcaataaaaatcttattctgaacagcaagggatctaacagtgaaatagatgttgacagcctgaacctctgyctccaacagtatgaggtaaactcaagcacattttctttgtcctttgagttgtatcaattttatttccctgctaggcaaaccaatatccatatttatcttttttttttttttttgagacggagtcttgctctgtcacccaagctggagtgcagtggcactatggatggagctggtaggccattatccctagcgaactaacataggaacagaaagccaaatatggcatgttctcacttataagtggaagccaaacaagaacacatggatactaggaggggaacaacagatactggggcctacttgagggtgagggggtgggagcagagacaggatcagaaaaaatacctattggttactatgcttattaccccggtgataaaattatctgtatatcaaaccctcatgacatgcagtttacctatnnnnnnnnnnnnnnnnnnnntaggtgtgagccaccacacccggccatttatctttcttagaaagtctgattttccattttataaataaagtcagctatgtttaggtttataattatcatatccctggccggccatggcagctcacacctgtaataccagcattttgggaggcgaggcgggcagatcacctgaggtcaggagttcaacaccagcctggccaacatggtgaaaccccgtctctattaaaaatacaaaaaaattagccgggcggtgtggcaggcacccgtaatcccagctacttgggagcctgaggcaggagaatcgcttgaacccaggaagcagaggttgcagtgagccaagaccgcgccattgcactccagcttgggcaacaagaacgaaactccgtcttaaaataaaaaaaatcatatccctggagcttcagtgataatgatcatttctcctttcagctattctctgagagaccatctactgaatgmcctgttattatcaatctcatcctctctttataaatgagcatctaggatccgtcctttgtttcttttttgaccacgatccaatcctacgtgcacacacacataccagtttcaggagattttttgttgttgttttcaggggtacatgtgcaggtttgttatataggtaaactgcatgtcatgagggtttgatatacagataattttatcacctgggtaataagcatagtaaccaataggtattttttctgatcctgtctctgctcccaccccctcaccctcaagtaggccccagtatctgttgttcccctcctagtatccatgtgttcttgtttggcttccacttataagtgagaacatgccatatttggctttctgttcctatgttagtttgcttgggataatggcctccagctccatccatattgctttaaaggatatgatctcgttctttcttatggctggatagtattccataaaatgtggtgtccacattttctttatccagtgtaccattgatgggcatttaggttgattccatatctttgctattgtgaatagtgctgtactgaacatacacacacatgtgtctttatgatagaatgatttacattcctttgggtatatacccaataacgggatagctaggtcaaatggtaattytaagttcctgtgaaatcgccgcagtgctttccaccatgactgaactcaggagagtttttgattggttatttacagcatgggttggcaaacttttttttttttttttktgtgacagagtctctctctgtcacccaggctggagtgcagtggtgcgatctcagctcactgcaacctccattctcctgccgcagcctcccaagtarctgggattacaggcacccaccaccatgccaggctaaattttttgtattttcagtagagaggggtttcaccatgttgcgtaragtggtctcgaactcctgacctcaggcaatccacccaccttggcctcccaaaatgctgggattacagacatgagccaccgcgtctggccagcaaactttttaaataaagggccagataataaacattataggctttatgaaccatatgcaaaagacctatttctgttgcaatcactcaaaattaaagcagccataaatagtacataaacaaatggctatggctatgttccaataaaactttatttacaaaaaaacacgtgacagaccagattttgcttgggggccacagtttgttgacccccctgctctagagagttgcttttctycttcttaagccccagattaattgattctttttattagtcaataagagaaaagaccatgagacacatgtgagccagagagttttctccccaatattgttctctttttttgttctatttaagattatttgaggtattacagtggtttatcaaccctctgctatagagagatacccctctccttcaactttttagaatgtcagaacggaactagaaatgtcccctccttctattctatcttctccctcttccccaatcttaagagaagcagacataaaagtttgtccatgatcaaccttatacacaatctcatccctctttatcacgcaagagttgacctgcctcctctttttataccctttatccaaagatatcactgagggagagagtttcagactttattcagcctttatctgtttgctaagatattacaaagaagcaagcatgaaaaaaattaccatgacatagtgtgagatataaaaacatagagacatagagcatttcatgcattggtgccctcccctagttataacatatgaatcctcttgtagcagagaaygacagtctgagccttgtttttctagtgatagtttcctaaattatcatgttcacagaggaaggaagctttgtcttattgttagcagtggcaaatccatgtgagtctgcagcagctcggttcttgcctcctcaggcgaaagaatttgaccaaggggcataaggcagggggagagactgaggcaagttttagagcaggagtgaaagtttatttaaaagttttagggctgggcacggtggctcacgcctgtaatcccagcactttgggaggccgaggcgggcggatcacctgaggtcgggagtttgagaccagcctgaccaacaagaagaaaccccgtctctactaaaaatacaaagttagccaggcgtggtggcacatgcctgtaatctcagctactcgggaggctgaggcaggagaatcacttgaacccgggaggcagaggttgtggtgagccgaggttgcgccattgcactccagcctgggcaacaagagggaaactccatctcaaaaaaaaaaaaagaaaaaaagttttagggccaggcgtggtggctcatgcctataaatcccaacactttgggaggcgaaggcgggaggatcacctgaagttcaggagttcaagagcagcctggccaacatggtgaaaccccatctctactaaaaaaaatatataaaattagctgggcatagtggcaggcacctgtaatcycagttacttgggaggctgaggcaggagaatcgcttgaacccgggaggtggagattgcaatgagctgagatcgtgccactggactccagcctgggtgacagagcgcgactctgtctcaaaaaaaaaaaaaaaaattcagagcaggaatgaaaggaagtaargtacacttggaagagggccaaacgggcaacttgagagatccaagtgtgctgtctgtcctttgacttggggttttatatgttggcatgcttccaggggttacgtttctcctcccctgattcttcccttggggtgggctgtctgcatgtgcagtgacctgctagcacttgggaggggtcgcatgtgcagtgtgttkactaaagttgtatacatgctcacttgaggcgtttttcccttaccagtcgagcgtttttagaggaagttcatataccagtttaaactctgccactttgcctcttagtgcgcatgcttgagcccactcgcccagctcctgagatcttacctggaagctgctaatcaccagctttaggtgttttctatctattgagagcctgcctttctctgctgtcgctgcaaccaattattattttagagagatggttgaacaaccacctgaccgtcacctgatggtcacctgacattcttggaggtgaccatcaggtgatgtggaggtgggcagggcctctcatgccctgctcatatctgcctaactacctactgtaacattatgataaatattcaagaagccctttctgcctgttctgcaggattgactactctcaattgatctactctcagtttcaaagtgatggagatccagtataacataattgataatcactagatgtgggaagattacttgtttttaatagtctgaaaacagatgattttagtgtttggacagtttttactactttaagggaaaaatataactataacaagaaagtctgagtgtaatctttcagtttaaaaaatagtataaacagcatcatttactcagaaaatcaaaatttaggctgggcatggtggctcatgcctgtaatcccagcactttgggaggctaagtggaaggatcacttaagcccgggagtttgagaccagcctgggcaatgtggtgagacaccatgtctacagataacttaaaaaattagctgggcatggtggtgcacacgtgtggtcccagctacttggaaggctgaggtgagaggattgcttgagcccaggaggtccaggctgcattgagttttgtatgcatcactgcactccagcctgggtgacagagcaagatcttgtctcaaaaacaaaaattttagcgaatcataaacaaattatatattttctcagtactggcctaccagtaactcattgctggacagatacaaatagaaatttgaacctaagaaagtacaattaggtacatctcagatcagaaattcatgttatactttgcaaaacttttttaaaagattgatggccgggcgtgtggctcacgcctgtaatctcagcactttgggaggttaaggagggcagatcacttgaggccgggagttcgagacaagcctggccaacatggcaaaaccctgtctctactaaaaatacaaaaaattagccaggcatggtggtgagtacctgtaggcccagctactcaggaggtagaggcacaagaattgcttgaaccagtgaggcagaggttgcaatgagccgagattgtaccactgcattccagcctgggcaacagagcaagactctgtttgaaaaaaaaaaaaaggccaggcatggtggctcacgcctgtaatcccaacagtttgggaggccaaggcgggcagatcatgaggtcaggagatcgagaccatcttgctaacacagtgaaaccccatctctactaaaagtacaaaaaattagccgggcatggtggcgggcgcctgtagtcccagctactcgagaggctgagggaggagaatagcatgaacctgggaggcagagcttgcagtgagccgagatggcgcccctgtactccagcctgggtgacagagcgaaactctgtatcaaaaggaaaaaattcacagatattttggattaacaatagtataattatgctagcataaataattgagctgcttactgtatttggaaatcaaggtaggtccagtaaagggaacttaattctaatttatgaggagtttggagagactgaaagtgagagagacttttttttttttttttgagatggagtctcgctctgtcacccaggctggagtgcagtagtgcagtctcggctcaccgcaacctctgcctcccgggttcacgccattctcctgcctcakcctcccaagtagctgggactacaggcgcctgccactacgcctggctaattttttgtatttttagtagagacggggtttcaccgtgttagccaggatggtctccatctcctgaccttgtgatccrcccaccttggcctcccaaagtgctgggattacaggcatgagccaccgcacctggccaagagagactttaattctaatttggccctagaatcattagtgccagttatgaaaatacaggaaattagcctctctgattctgttggttttcttcatgaactgagaaatggaagtatcatggttttttgtkttttgtttcctttttccatttaccttaggatttgaaacagcccatggctgaaaggaaagctcagctggatgctcttgcttttgatattcagttctttatctcagaacatgcccaggacttgtcccctcagcagaatcgacagatgctgaggcttctgaatgaactgcagaggtccttccaggacattttggaacagactgcmgctcaggtggatgccttgcagggccatcttcaacaaatggagcaggaagccctggtgaaggtcagactgaaccagcagctgggctcagtttgtctttggggatgtcctctgtcattgggttttctggccagactctgtgtatcatgattgcaggagcctgggtttaccaattttgaaatttcatgtcatgcaggccagtatggttctagtccaggaggcacttgttctggctgttgttcttgccatgtctttggttttatgtatgtgtgagagaatgtatgtgttgacatgtgtatacatatgcaagtgttttcttttagtgagacttttccttcgctgtatctcattgtctctgaatttcaaatgaaaatcatgtatctagtcctttccctactttactttctcctttagcattgttttgagggctcgtaagaacatctagataccctgagctcttgaggagaagggttctgaaatcagtttcattctatttaatctatttcaaatgatttaccataaggttccttgacaatccttaagtggctgacaaggaaattttattagaatcgtattaatttttggctctttaagaattaatattattttcttgcacctttcctcacagtatagtgcccagtgcttattcgcttattcaatcatggaaaacagtatgtagaagcaggatgatactaaaacaaacaaacaaacaaacaaaaaactaaccatcctaccatcttccatcacaactctcttcttgcaaagctcaactcaacataattacattaatagtaacatcaaaaccttagaatacccagaatgatgttcatgccatttctgctatttgaatagtaagttggcatatagcaagatgatattagaattgtcattatcaccataaaatttgtctcaagggctcctttattaaatgttgtgcaaaaaattgagcttttgagtcagactttaagggaattagggtagttggtgccatatgtcctgtattactgtctcattttttcaactatattgaaattgagatatattaatggaaagctttaggttacctttgaaaactgagcatgtgcaatgctcgcattcaggagtttatatagcatgatataacctttggataattaatgaagtaaaattcatctgagccacattaagacaagacccagcccagattcagggtagactcctgagctgcagcaggtgatagaactgcatgtgaacattctccctgagcatgtaattaattccacaatgcttattaaccttgttattgtcagaaatgctctgcttctctcaatatttgccttggatgtgtgtgtatgtctctgtgttaacttgtttgctttgcttttttcagattcagtctgcacccatcctaacccatgaagatcctgttttacagctgaagagctcttaggagttctcttccagagcccttctatttgtcctaaagagggggagagagggccaatttgggcacctgtttgtaagtgcaggtgactaaagcgccatcagaaggtagaaactggtggaaaatggttttagaaggatggtcaggagaacacatcatgctcaattgctcagtcaggtgcttcaatgtcatacaactgagataaaatctagagaaaggatcaggcacagaaacatattccctctctctccttgggcctggcctgttcctttgatattagtgtagacacctaaaggactgagccagttgctattcttgggcactttccttctcaaaatagccaaatctagcccttcatgcctggcgtgtaatcattttatttaatgagtctctggattgatgagacatttgatttataaagtcagctcaattattaagaagctcgattaacttatgaattatccaggtctttgatttttctttctactccaattcttctacttttgcatattatgtagcaaatctctggttctagtggagggattgatcagaaccactaaattattatcatcaccattatcatgtgtggatttcaagcatctgggctctttcttctccatttccaaagataataacagcagtctggtgaaggagctctcaaaccraaacctgaactagaaacattctcataattatcctgattatccaatccatagayccagatcaatggactgtccamatgaggggagctttccgaatatgatttctatgtcttttcctattctagtctcccaccaacttttccatccttgagatataaccttcctgttttacatttcagggagtttcttgtatttgcaaaatgtgaattacgaaatgtctcttgacccctttgcatttwaattagaccctgcagaaacaacaaaatacctgtcaccagcaactggaggatctttgcagttgggtaggacaggcagaaagagcactggcaggccaccaaggcagaaccacccagcaggatctctctgctttgcagaagaaccaaagtgacttgaaggtcagtgtgaatctgtcaattttgacacaaagtctcgctctatcrcttaggctggagtacagtggtgttatcttggctcactgcagcttcgatctcctgggctcaggcaatcctcccacctcagcctccccaggagctgggacaaagtcatgagccaccatgtcctaattttttaatttttttgtagagatggggtatcactatgttgccaaagctggtctcgaactctgggctcaagcaatcctcctgccgtggccttggcctctcaaagtgttaggataacaggcttgagccaccatgcctggtgattttttcattccttcgacaaatatttagtgctcaagggttagcaataatggtaaacagacatcatccctggccttgtgaagcacacagtctagcagggcatacagaaattatacaggttattataaaaatgaacataaaattattaactgttatatctgtgaaggaaaactcatatgagaacatatagcagagagacccaatctagtctaggatttcagaaaagattatcttgaagaagtgtcacctaaacttgagaaatgaaagatatgtaggcgttaatgcatgaagaggtaggaggaggaagagaacataccaggcagaggcttatatattggtcttgaggtgggtatggtattgagcacaacatattcaagaaccgaaagaaagctagttcgactggactgcaaaaaacaagaggaaaattagggaaagttgaagtwggaggggtaagtgggacctgtatcacactggaccccgcaggccacattaaggataaggagtgatacccaagagagtataagggcccatcaggcctcgactctgctaagatcatgttgtcaacacttctttatggaaagaatgatctctttgaggataatgcattgcaaaatgaaaaatctctcatgttcatgtttatggacaacctccttttttggcttcactaaatatttgcttagaaaacaaaatcaaatttctttgcattgatttaagcctaaacctgaagcaaattgtagttagggactatatacaggactatatgtcatcctagccattccatctttataccattagaggacttagaagcactaaagtcgaaggctctgccattcctattttcttgtgttaaggatttacaggatgacattcagaatcgtgccacctcatttgccactgttgtcaaggacattgaggggttcatggaagagaatcagaccaarctgagcccacgtgagttgacagctcttcgggaaaagcttcatcaggctaaggagcaatatgaggcgctccaggaagagacacgtgtggcccagaaggaactggaggaagcagtgacctccgccttacagcaggagactgaaaaggtaatagactgctatgacgcttgatatttttcaaaaaagaaaattttggtaccaacacaaataaaagacagtgaggggaaaacaggcttatagcatgcacagaatcatgaggaagggctacttcaggagctagtctggtttttgttttttgagacggaatctctgtcacccaggctggagtgcagtggcatgatctcggcttactgcaacctctgcctgccaggttcaagtgattctcctgcctcagcttcagcctcccaagtagctgggattacaggtgcctgtcaccacacctagctaatttttgtatttttagtagagatgaggtttcaccaggttggccaggctggctagtctgtgtttttacaagaatctttatttttacaagaaatgtccaggaggagtttaagtcaggacagttggtaaaaagtacatattcctattcctccccaaacccccaaacatcttgctrtctgtatactcagtcctctgactaactraaaaatatcagaaagaacttagtgaggaagagtattattatggggagaaaaaaagcaaatggcytttttttttttttkttttttttgagacagagttttgctctgttgccaagactggagtacagtggtgcaatctcagctcactgcaacctccacttcctgggtttgagtgattctcgtgcctcagcctcctgagtagctgggactacagatgcatgccaccacacccagctaatttttgtattttttagtagagatggggtttcaccatgtggacccagctgttctcaaactcctgacctcaagtgatcctcctgcctcggcctcccaaagtgctgggattacagktgtgagtcaccatgcctggccaaatgacatattttaatatgagtctagactggtgatctaagagtactagggaaaaatatctatgaagtcttagtgagccaaaagctgtccccgagctgcctctatagttacgatgggaatcgtggcactcggataaaccaaagagaagccaaagtctcaaatgaccttctgcaccccactcagcactggcagattgaatttgaattctttgtttagccttggatgccgacactaatgaggaaagtggagaacatggaaaagaaaaataaattacctgaagatgaattttgaaatagattaatatataacttggcataacctatttaatctattaaaatacatgtagagccagtaaatataatttcagaggcaagttgaagaattaaatgtttccctgtagcctcaggtgagagaaaaaatttaaaaagagctaaatgttctgtttagttgaggaaaggatgaaagaagtttgtctttcctttaggaaagagcagcccggtaactgaatgtgactgtgctatttcttaccctaccaagccagtccggcacttctgtgtacctcaaaagattctgtgaagcttgctggggtggcaggactaaatgacctctaaataaaatatttctgaatcctaggatttgttttgttttgagacagagtattgccgtgtcaccgaagctggagtgcagtggcacgatcttggcttactgcaacctccacctcccaggttcaaacgatactcgtgtctcagcctcctgagtagctgggtctacaggcatgcaccaccacacccagataattttttgtatttttagtagagatggggtttcaccgtgttgaccaggcttgtctcaaactcctgatcctgaagtgagccactgtgtcctgcctctttttttttttttaaagcagtaagatataatgaaatgtagagatatttttaataatttttcaaaagattttaaaagatatgaattctcttttgtatgtgcaaagactgtttatacccagtcttagaattagcataaaattatctcctcccctttaccccattacttaacctgtggttgtatgattgagtatgtaaagccttctcactagactacctcggtggctttcagagtaaagcagcaaaggaactggcagagaacaagaagaagatcgatgctctcctggattgggtaacttcagtaggatcatctggtggacakctgctgaccaaccttccaggaatggagcagctctcgggagctagcttggagaaaggagccttggacaccactgatggttacatgggggtgaatcaagccccagagaaactggacaagcaatgtgagatgatgaaggtaagggtgttagcttatcctcactatgctagagaaatctctcctgccctgagcaagtaaccacaatcaccttgcccctaaatccagtgagcacttctcagtttgtatcttctttgatgtctcagcagctttgacactgttggccactcctcttgaaatactttctcccttggtttccataatactactctgccctgaccatctttcttactttcctctggccaggttttcaaatactgatgtttccaggtgtatcctaggccctctttttatctttcagaacatactttccttgggcagtctcatctactcacaacactgtaattgccatttgcactaatgaattctgtgtatgcatttccttccagccctgatttctgtcccgagcttcaaaacggtatataaatctgtctgcctatttgcaacttgggcccataagcacatcagcctgaaaatggaactcctatttcctatgatactcctcccacaattaaacattctctttcctttattcccacttcattgtctgaactggacatcatcctagattccattctctctctcactctcctatgtcaaatcagtcatcaaatcttatgrtaattatatttctttcaaagtcagctatacttcttcatctttattgagatattattgtagtttagaaccactgtctgctttcactgttattattatagtagcttctactggtcttcttgcctcttggtttttaccttccagtccattctccttactactaaggaatctttctaaaatgccatatccttgcttagccctttttatggttccctgttgccctcaagattacctggttaactctcytctcagcccctacccactgggatctagtctacttatttggccttatctgtcaccttcctttatacttgagcatctgcttatattgattcctttcagtttattggctaaactgtgctctcactttcctctgggcctttacatgctcttggaacttacttgcttctccattgcataaagtaacggagggggcccagctatttgttaatttttactcattcttcagatctcagcttagagttcacttcctctaggaagcccttaattcaccaccactcacmaaagttagggtatatattcccccatatgctcttctttcttttcttttatttatttatttatttattttttgagacagagtcttgctctgttacccaggctggagtgcagtggcrcgatcccagctcaccgcaacctccatctcctggagtcaagcaattctcatgcatcagcctcccaagtagctaagattacaggcatgtgccaccatgcctagctaagttttgtatttttagtagagatggggtttcactatgttggccagactggtctcaaactcctgacctcgggtgatttgctcacctcccaaagtgttgggattacaggtgcccagcctataagttcctcttataccctttcctactttgtagcatttctcattcgatattgttttgttgtctgtattgccctctagatgctaggcttgaaaacgcacactgtttcttacaggctgcctgttctgtaacaaaacaaaacaaaaaagcagaagtcacttcttactgkttatttctactcatttatttattcatttagtaattactgaatagctgccatatgccaggaattagaaataagccagtgagccaaccaagtaaaccatcttcaagggcatcaactggcatatacaggcacattctattgaatgattgaaagaagattacatatttaggacacttacaacacatggatcatatattttagtggtgacacctttatagaaaaaatattggcttagctggaatacttgtgttcagtggcctttgtggaccattgtcatattttatattaataggatttctgcctcttgcatgacgcttttcgaaggtccattatactgtgtcccccaaagccctggtagtcttataagaggacagagcaaaaatggttctgctgtcatagggckcctctgacaccttttgctggcagcagtcaacctaatsaagtggtatctccattctaggaargaaactgccttataggtagatgagttggaaggtgagaatgaaggacacctaggtgatatacagacaaggttgtagtaccgctcccacttcactatctaattgagcaagatatatttgtcattccagctttctttttttcttctgctttttttttttttttttttttttttgagacggagtctcactctgtcaccaggctggagtgcagtggcacaatctcggctcactgcaacctctgcctcccgggttcaagccattctcctcctcagcttcctgagtagctgggattacaggtgcacgccaccacacccagctaatttttgtattcttagtagagacggggtttcaccatgttggccagcatggtctcgatctcttggcctcgtgatccacccgccttggcctcccaaagtgctgggattataggcgtgagccactgcgcccagcttttttttattttttaaagacatgaggcctcactttgccacccaggctgaagtgcagtggtacgatcatagctcactgtaacaggtgtggactcaccatgcctcattaatttttttttaagagacagtcttgctatgttgttgctcaggctggtctcaaaaacctagcttcagtgatactcctgcatcagcctcctagtcactcagctttcttgaaatgatgtgggaagctgaggctatcaggttgytgttgatacaggctaaaactagacgatgatctgtagtccttctctaagtagtggcrwaaacagtataggtagtaaggaacactgacaactcccactgtcttctagattcaggaagaacatcccaatatatgtttcaaaacaaaaactcacagctctcctcaaagaactcatattccattggaatagaaagaaggtctatgtataagcacatagacacagtacatacaaataaaaagtacaaattacttattattacccagaaatacagtttaatctctaattattgaattaattttccatggcttttcctagtagggacagtcttcatggacacatgartgacatatttcacagttaagaacttgcattttttttttttttgagatggagtctcaagtctgttgccaggctggagtgcagtggcagggtcttggctcactgcaatctctgcctcccaggttcaagcaattctcctgcctcagcctcccaagtagctgggattacaggcacttgccaccatgcccagctaatttttgtattttctgtagagacagggtttcaccatattggccaggatggtctcaatctcttgaccttgtgatctgccagcctcggcctcccaaagtactgggattacagacatgagccaccatgcctggccaaacttacaatttttatattgtcacatgtatgatttattcagctacccttccactaatgtagatgattattagttgtccatttgtacagtttagcgaagagagtcaggtttgagttgcagttctgttcgttaacaaactgcatgaccttagtcaagatatataacgtctttttggtattcacttactcttaatatgggtattatattgtctacctacattataggtcgtgccacaaagcaaatgagataatacatgtaaaatctctttgaaaaccataaagtcctatacgtgtcagttcagaggggattagcatgtggcatactgtttagagagtgactgatattggtgatttctgagcagttggaaaagtgatctattgagtagaggtagagacctctccctacttctagcttataggtagatggtccttgaagattataagtacaacttaagagtcagcatctaaattaaagggctatacctaaaacaaggggctgaactgaataaaatgaagttaacagggaaaaatgtgagatgcagcaaaactgagagaggtgtatgacttgacagcaatgtgggtgaaaagaccaaggctgaatgtaagcagacctcacatggagtatgaagtccagtcttgtatacctcaaattattgtggattgcctactgattgtcctttgtttggggggatttttttttaccaggcccgtcaccaagaattgctgtcccagcagcaaaatttcattctggccacccagtcagctcaggccttcttggatcagcatgsccacaatctcacacctgaggagcaacagatgctgcaacagaagctgggagagctaaaggaacaatactctacttccctggcccaatcagaggcagaactgaagcaggtgcagacacttcaggatgagttgcagaaatttctgcaggatcataaagagtttgaaagctggttggaacgatccgagaaagagctggagaacatgcataagggaggcagcagccccgagacccttccctccctgctaaagcggcaaggaagcttctcagaggatgtcatttcccacaaaggagacttgagatttgtgactatctcaggacagaaagtcttggacatggaaaacagttttaaggaaggcaaagaaccatcagaaattggaaacttagtaaaggacaagttgaaggatgcaacagaaagatacactgctctccactcaaaggtaagggggcagttcctggcatccttggtgaaacaatcatggcagccttcacacaatgtaggtagtgtctggggctcagaataagaactccaggacacagtaggagagctgatttatacttggaccatgggcagaaggtcttcacaaacaatgcacaaaatgtaaaatacataggtactagcccaaaggcctgatagctagctaatacctaatacctagcactggcaggagtatatcacactgatggtgaaggtggaagtattccccttcctgtatcctgaccagcagacttggactcccwagagacatagcacacaggggaaatttaaaccaattgcacagtctttatttctgtctttatttcacagagcatctagggtgaatccttaccttccttcctatctaaagaacttgctcgctcttctaaagtttagaatccagtcagctcttcttacctgtcttatgccttctgccaacacttctaatccccaagaaagaatactttttgcacttcttaacccctacctttgtctgcaaccttatgttcatttctttggaagcttgtcatacatctcattaaattttcctgggaatgtaagaaggtcaaggtgaatagtatggagcaaacaatggggacccacacttagagatcattgctacccatctatccatgggttctggcaatacccttatctgaagttacagtgagttgtctgtaacaaagccaggcctctttctttgggcagctgctgcctttggcctgaccttgcttaagtctgcttacctttctttctctggcwcagtgtacacgattaggatctcacctgaatatgctgttaggccagtatcatcaattccaaaacagtgctgacagcctgcaggcctggatgcaggcttgtgaggccaacgtggagaagctcctctcagatactgttgcctctgaccctggagttctccaggagcagcttgcaacaacaaaggtaagtcaggacacaggctgtgttgtggtgtcaagaccttgtattccatggcgtaaagtaccccaaaataaagcaaatgcttacataaaataaaggcagtggttgggatgccttggacaagatctgagtgctaaacacttgcttctaatatttatggctatggttaaacttasaattattctgtaaagctgttcagtagctccggattcctagaatcatctttgattacttagatgtttttcttttgtttttttcatggacaagcagcagttgcaggaggaattggctgagcaccaagtacctgtggaaaaactccaaaaagtagctcgtgacataatggaaattgaaggggagccagccccagaccacaggcatgttcaagaaactacaggtataaagcagcaacagtataatagtactcccttaattcctagtatgtacctctattctgcaatatgtcacattgtgttgtgcaaatatctgtggtgccaggctagaggctgagaatataaacatgaatagacatagattgtcatcaaagagcttatcctctaatgaactttattcttgcaccattgaaggaccttcacaatctggcttcagtcccttttccccagacatctatcttctagccacatctacttttctttcccaagtaaaccacttacattgtattacccctgaagtttttcctattgcttagctgataacatttattgaatgcttaccaagcgtggtgaaatcttgcccatgcttcaagatgtagccaagagtatatcatggtgactatagttaataacaatatatcgtatacaggccgggcgtggtggctcacatctgtaatcccagcactttgggaggccgaggcgggcagatcacgaggtcaggagatcgagaccatcctggccaagaagatgaaaccccgtctctactaaaaatacaaaacaaacaaacaaacaaaaaaatagccaggcatggtggcaggcgcctgtaatcccagctactctggaggctgaggcaggagaatggcatcaacctgggaggcggagcttgcagtgagctgagatcgtgccactgcactccagcctgggcgacacagcaagactccgtctcaaaaaaaaaaaaaaaaaaaaawawawatatatatatatatatatatatatatatatatatatacacacacacacacacacatatgtatatacacacatatatacacacacacacatatatatcgtatacttgaaaatggctgtgagagtatattttaagtgttttcaccacaaaaaaatgataagtrtgtgaggtaatgcatatgttaaatagcttagcttagccatcccactcctcaaaagaaacgaaagataattattcttccttctgggcttctcgaggacagtacttctagtattaatataccacttaagatttgatttttatcattaattgtgatgcrtcttcctctgcctatgctctgttttaaagtcttaagttgtagatgtcagataagatacttaagtatctttagtcctcagcatctagtacaatttctggttctttgtatgcagtaaataactaatgcttattgaacttggctctgatactaatgcatttcaaacttattccttctattggtcttaatgtcaattattattacaattactatgttcaatgtaggactgggcatggtggctcatgcctgtaatccaggcactttaggaggctgaagtaggaagattgcttaaggccaggagttcaagaccagcttgggcaacatattaagaccacatccatataataataataataataataatttttattatttattawttaatawtattaataataaagtctttaaaagcataayacaaaaattgtctccactctttcttttcatggcctgatttttcagattccatactcagccacttccaaagcctctcctatagcctggctgagcgatcttctctgctgcagaaagcaattgcccaatctcagagtgtccaggaaagcctggagagcctgttgcagtctattggggaagttgaacaaaacctggaagggaagcaggtgtcatcactctcatcaggagtcatccaggaagccttagccacaaatatggtaagatctgtgtcccaagagctagcatagagggtatgtttgctatgtgccatcattacataatgttgaaaaagtaacaagagggaacctaatatctgtgaatcatctaataagatttagaaatgataactaatctatgtaaagatatttctacccagttgagctggaatgaaagtggagatagcaaagtcatgtggtagaaggggtggagaactaaggtgatgagatgtgtggtattctggaggctcggttgcagtcctccagtcccccttgtgagatagcatatagttattagtttgtggctcagatgtcctggaataagtgaaccaggagctgacagacgtgttcttcatgacagaaattgaagcaggacattgctcggcaraagagcagcttggaggccacccgtgagatggtgacccgattcatggagacagcagacagtactacagcagcagtgctgcagggcaaactggcagaggtgagccagcggttcgaacagctctgtctacagcagcaagaaaaggagagctccctaaagaagcttctaccccaggcagagatgtttgaacacctctctggtaagctgcagcagttcatggaaaacaaaagtcggatgctggcctctggaaatcagccagatcaagatattacacatttcttccaacagatccaggtgaggatatatctgccatgttagcagaataaagggaagagaagggcagggagagaaccagcatttgctgagcgcatactacatcagtcagtatactggaaactacctgcattatctttgggaattattacagtgatcccgtaaactaggtatcatttgtccattttttaagcaacacagtcaatatttatttttcactcttattacatgttcaacccaaatcagcagggccactcagttcatcatagtcactcaagggatgcagattgatggagatttcatcctgatataagctttcatgattactgcctcagtggtaaaagggcatattatatttatttacattttattagtcaaagcactttccacamaaccacctatacctttcaagagggtgaggaaatgtaatctcaccacttacctagaaggtgcaaagctagaaatatttggtaaaagtattaacagctaccacagatatatatccagaagtaaaactgccaagtcatagtatatgcatatattaatttaattcgactcagtagtggccaatttgagctccagaatggctgtaccagcacacattcccacctgtagtacttcagcattcctgtatctctgcattgctgccttcgctttatccagctttctaactttttccatattaaagtggaatctcattgtttggtttggtttgctctcctttttgctttgaatgatttcaaacttacagaaaagcagaagaaatggtccattacacaccagcatactcttcacctagattcaccagttgctaattgttttccctctcttataaaaatataaaagagagtatcattatgggcttctatatttgttattaccattattctttatgatacttaacgttttcccaaatgtggtcggtgggagcctcttcaagctgtctcctgtggctttttgacatgtcttcctcagcataagagcacttttggaacttaagatatttgtggcacaataatgtatttccttgtcccctatctgaaatcagctattyatccaaggagtcccacttttagtggggaatgatatttagaaaccaaatctggacactagatgagctactggagtgtcactacttttaggttctttttaatagatagtgttaggaaatatatgtgtatgtttcttatatcataaaatcatactgatagtctagtctcaacgcaacaccataggaatcttcctcctttccacatttgtatcttcctttcctgtagggagaaccctagttcccagcaactttaatatatttacttatttgttttattctacaataaatataagatagttttagaattacattagtatttctaccaataacaaacctgctaaataaaattgaagatttctttggatttgtttttgtccttagcctatgacccactatgtactgtgttcaaaaattacctgaattattttttctgtaatttcttatataattagatttgtttctatttgtattcaactttaggactttatttttctacctttgttgattaaacttatttttaaatatgtaaagcattaacataggtcaaaagttaaaactcttcaaaaagttatactcaaggtataggaagtgaataaggatatattctcattgtctttcctgtctcttccatcccattttcacccatccccatagtaacacatttcaggtttatttttttctattcctttttaccaaaatgaacatacacacacattcttattctccattcttccttacaaaaaagaagggtatattacgtaatcctttgcttttttacttaatatgtcttggaaatcacttaatatggattcacagagatctttgttttttaaaccatactttcattgtgtagaagagttacagtttaatcaacaagactctttctttctttctttcttttttttttttttttgagacagagtcttactctgcgctctgttgcccaggctgaagtgcagtggcacgatcttggctcactgtaacctcaacctccacttgggttcaagtgattctcctgcctcagcctcccaagaagctgggattataggtgcctgccacgatgcctgggtagtttttttgtatttttagtagagatggggtttcaccatgttggccaggatctcaaactcctgacctcaagtgatctgcccgcctcggcctcccaaagtgctgggattataggcatgagccaccacacctggccaacaagactcatacgtggtggaaatttgaattgttgtttccgaaattgtgctattactactgaatagctgtgtgtattttttcccataatattggaagtgtatcctcagaataagttcctagagtggagttgttgcattaaagggtaaatacatgtatagttttgttagaaatagccaaattcccctccattgaaatttcaccattttgcattcccagcagcagtgtattagagtacctgtttcccctatagcctcaccaacaaaatttattatcaagcttttaatttttttctggtgtgattggtaaaacatgatatgtgaatgtggttttaatttttatttctcttatgagcgaggttgagtgtatttttacatttaagagtcatttatttgtgaactatctgttcatgtattttgtcattttttggtaaagatttttggttttctctcaatttttaaagtttttttttttttagagttcttatatattagagagattaattctttatctgtgatatgttagaaatattgtttcccagattgtgcttttgacttatggtgttttttgccatgtaaacgtggaatttttttttttttttgagacggagtctcgctctgtcgcccaggctggagtgcagtggcgcgatctcggctcactgcaagctctgcctcccrggttcacgccattctcctgcctcagcctcctgagcagctgggactacaggtgcctgccaccgcgcctggctaattttttgtatttttagtagagacggggtttcaccgtgttagccaggatggtctcgatctcctgacctcgtgatccgcccgcctcagcctcccaaagtgctgggattacaggcgtgagccaccgcgcccggccgtaaatgtggaatttttgttctacatagaagattttatgagtattttattaaatatgtatttttagtcatagtttgaaagatttttgtcacacccaggttatgaaaaaatttattcatgctttattctaaaacttgttttaatttttttttacatttgaatcttttaacaatttaagcttattctgaagtatgaatcatgttacctttttctgttatgtctatctagttgttcataatagaagttgagtgccccaatccaaaatctgaaatgctccaaaatctgaaactttttttttctttttgagacggagtcttgctctgtcaccgaggctggagtgcagtggcacgatctcagctcactgcaagctctgccttctgggtccatgccattctctgcctcaacctcccaagtagctgggactacaggcgcccgccaccacgtccagctaatttttttgtatttttagtagagatggggtttcaccatgttagccaggatggtctcgatctgctgacctcgtgatccacctgcctcagcctcccaaaggcctgggattacagacatgagccaccacacccagcccaaaatctgaaactttttgagagctgacatgacactcaagaggtcatgctcaaaggaaagactcattggagcacttcagatttcagagcttcagattagggatgttcaactgctaagtataatgcaaatattccaaaatctggaagagtctggaattcaaaacacttctggtcccaagcataaaggatatccaacctgtatcatttatttgaaaagtccatattttccccagatttaagaaaccatcttcatcatatacacaatttttatatgtctttgagtckatttctggattttcttttttttctttttttttttgagatgggatcttgttctgtcacccaggctggggtgcagtggcatgatcttggctcactgcaacctctgccttccaggttcaagcgattctcctgcctcaggctcccaagtagctgggattacaggggcctgccaccacgcctggctaatttttgtatttttagcagagacggggtttcaccatgttggccaggctggtctcgaactcctgacctcaagtaatccaccgaccttggcctcccaaagtgctgagattacaggcatgagccacctcacctggcctatttctggattttctattctgttttgctggtgtttccattcatgtaccagagcatactattttaattatagaggctttatggtatattttaatgtgtggtagagagctagtcctcctcaatttttttctttcaaagtttttcataggtgtagttgcacatttatttttctatgtgaatttaggaatcaccttcattagttctagagaagttagcatttttatgtgggtcacactaaatgtattcattcacgcaaacacatatacatacataagcaaatacatacgcatgcacttttatggatgtgtttccatctagtcagatctgcttttgtgtttttcaggagtgtttttgatttttttgttcttttttgttttgagatggggtcctgctctgttgcccaggctggagtgcagtggcatgatcatagctcactgcatcctcaaactcctgggctcaagtgattcccaggagtctcagcctccccagcaactgggattacaagcaagagccactgcacccaatttcagaagtgttttaaaatttagattttgtgtttcttgttagttgattactaagattgagccttttgtgttgctatagtaagttgaagttttcattattgatttttgtgtgttaattttatagcctgctaccttgtttaactacttcgttgtttgatttcgttttattgttgattatcttgggttttacaaatatacttttttttttttttttgagacagagacttgctctgttayccaggctggagtgctatggcacaatctcggctcactgcaacctccgcctcctgggttccagcaatttccagctaatttttgtgtttttagtagagacagggtttcaccacattgaccagactggtcttgaactcctgaactcaagtgatcctcctgcctcggcctcccaaagtgctaggattacaggaatgagccaccatgcctggcctttttttttttttttttttttggaggcggagtctcactctgttgcccaggctggagtgcagtggcacaatcttggctcactgcaacctcctcctcgcaaattcaagtgattcttctgccttarcctcccaagcagctgggactacagagtgcgccaccatgcccagctaatttttgtatttttagtaragacggagtttcaccatgttggccagcctgatcatgaactcctgacctcaagtgatgggcctgccttggccttccaaaatgctaggattacagacgtgagccaccgtgcctggccatacaaatatactttcatgtgacctacaaatacagttttatctcttcttttccaattcttactccacagattgttttctcttaattgcattggctgttttttttttaattattaaattaactttttttaaaaaatagagatggagttttgccatgttgcccaggctggtcttgaactcctaggcttaagtgatccacccaccttggccccgaaaagtgctgggattacaggcgtgagccactgggcctggctgatatcttaagtataatgttaaataatagtggagatagtgtgtttacccccattttatagaagagaccatgaagcttagagtagtttagtagcttaagatcacaagttggtaagtggcaaagtgtgattgaatttcaggtgaggtgtatttgactcctgaaactttcattctttacgtcctgtcatggtacctcccaagtctttgaacgtttgtttagaggagacaagactgttttgtaattcctagccactctccagtggattgaagttgtcctacatatttatcagattttttaattgggytttttaatacaaaaaataattagctgggcrtggtggcaggagactgtaatcccagctgctcgagatgctgaggcaggagaatcgcttgaacccaggaggcggaagttgcagtgagccaagataccgccattgtactccagcctggatgacaggagtaaaactctgtctcaaaaggaaaaaaaaaaaaaaaaatgtttgtttgktttttttaaacttttcactgagttgcatatttattgttttgatctagcatttgacctggcaagcatacctctttccttattcctttttagagtatatttataaggattagaggatttaatacatttccttgtttgcttgacaggagctcaatttggaaatggaagaccaacaggagaacctagatactcttgagcacctggtcactgaactgagctcttgtggctttgcgctggacttgtgccagcatcaggacagggtacagaatctaagaaaagacttcacagagctacagaagacagttaaagagaggtgagttatcacttgtgttggtcagcattggggaactattttttcttgttatggagtgaaatgatcttttctcttttcttcctttaccagaacagatggcatctaaaattctactactgagttgtaggagggtgaaaagtgcctttttttaggcaaagctacctcatctacttgatgcttagtggtttttcttttctttttttttgagactgagtatcactctgtcacccaggctggagtgcagtggtgccatcttggctcactacaacctccatctcttgggttcaagcaattcttctacctcagcttcctgagtggctgggattacaggcgcccaccaccatgctcagctaatttttgcatttttagtagagacggggtttccctacactggccaggctggtctcgaactcctgacctcaggtgatcgacctgcctccgcctcccaaagtgctgggattacaggcatgagccactgcacccagccacttagtggtttttctaatagtaactaatagaaagtagggatgagttccctctctttgtgatcagaagcctaggccacttggaccaaacagaacaaatttgaggcagcaagtaagattacagaataattttgaaagaagagaaaaattggaagagacttcctagacataattaagggtgatgttggcagtcccctggcttttttttttttttttttttwaagatatggggtcttgctatgttgaccaggctacttgtgaactcctggcctcatcgatcctactgccttggcctcccaaagtgctgggattacaggtgtgaaccactatgcccagaccccctgcttgttttgaccacatttaagttgctattttagaagagtatctggattcttctttcaaggcaaacaagggaatatatgacaaggctggctgattttggtccctgttgaaaagccatgattcctcactggacagcctcacatagatttaagagcatgaacaagacttcttatctaagtttagcgataaatatgatcttgatttagcagataactgccttagtgattagaagaaaagagttgctcaaaccaacattattagcagcaggttatctaatggagaggatggggacaaaggtcaagaaagcttttgtttttcttcccctatgctgagggcctttttactgtatgaggaatcaggatttctggattgacatctgtctgatagatatggccatttccaaaactttccttttgatttagtttattcattggcatcattaatctagaactaatcacctaacttctgtgagcctcagtttcggcaccttccttgctaaagcaatcagcacttgaattggtccttgaaagagtcaaatagctaaaatgtagcagggccggaattgagatccaaagcctgcattctttccattgtatcacagtacctaaatagcagcctccctttagtttttctcactttcactttagcctagagtaagattgaagacctctttccccagaaatgtccaaacaagggcaatatattcctgagtttggtacgcttcaaygttatatgcggttgttcagccaaacctgctatggaaaagattatgagaaagaaaggccatgttaggtaactgatgtctggagtcacagaatgaactactcttagctcaagttgactttataaaacttagtctggcaagtaacaaaactgcttcattgacagagagaaagatgcatcatcttgccaggaacagttggatgaattccggaagctggtcaggaccttccagaaatggttgaaagaaactgaagggagtattccacctacggaaacttctrtgagtgctaaagagttagaaaagcagattgaacacctgaaggtaggtgaacaaagggactccaagaattgggctaggcactggtttgaatacttgtattaactggtctccagctgtggtggggaaatgtatgagaaatccaagttgtcagtctgcatcagaacagaaattcctacgttttcttcatatgataaccatctacccatacagtccttgagaagcatacactctctttgtatgtttgagaattagacaaatatatttgagcaagtaaccagataatatgatcaggaaattgaggatagaagaactagtactacttcagctagtaaaggaaaagctagaatcagatggttggaaggtaccttcaaggatgggaccaaccttcctcccattccctgcaaaatcccttctgtactgtctttgatccgtaattatccagcctctgcttacacctctaacctatgtcttccttttgttgaaataagccaaatatgcctctgactaactgtcatgcacttatccttattttctcagtaaagcatacttcatcctgagcagatgaaagaaaagcgtttgattgctttcacagagtgagtgccaggagcatttgctgttgggaattccctaggacagagctttcccaacatttttgtttcacagtgcccatggtgttttaagaaatttgtcatggcacctcaaggccaaaaaaaacagaaacaaaaaaaaactcmtaatacttctacttgctaagaagttaggtccaaacaacttagtagttgttcatatggtgttcaacagatgtcactgtattttcctcaaaaatgtaaaatattctgtgagtaaagccatagtttggggactgtggctctttggaatcaagagtgattaatggccaggcgcagtggctcaacgcctgtaataccagcactttaggaggccgaggcgggtggatcacaaggtcgggagttcaagatcagcctggccaagatggtgaaaccccatctctacgaaaaatacaaaaattagctggacgtggtggcaggtgcctgtaatcccagctactcaagagggtgaggcagagaattgcttgaacttgggaggtggaggttgcagtgagctgagatggtgccactgcactccagcctgggtgatagagagtgagactctgtctcaaaaaaaaaaaaaaaaaaaaagagtgaytaattaaagaactgacaagcagtgaccaagggtcagtttgaaattaggcaatatgagtagagctctgtgcctttctctgcagcttaaagtcaaaagcaaactaagtagattgtcagggatattcagtatggaggagggcaatgaaggctagaatggtgtcctttctctgaaaggagtaaaatcctacaactatggcaggagacatcttggagacttaacgtgatgtggtatttttgtcttagagcaaatgccattgtttcctgacggatttctgtggtagttggatctttgatttcaaacccaatataaagtttccttaataaaygcaaagtatagcctatgattctatgtatttttctgtrtctcaatatctagctccttatttatcctctagttaccatttctttttttatctttatatgcatgttgttccctcttgtccatctggcaaactcttatctttctttgctttttttttttttttaagacggagtctcactctgtcacccaggctgggatgccgtggcatgatctcggctcactgcaacctctgcctcccaggttcaagcaactctcccgtctcagcgccctgagtcgctgggattacrggtgcctgccaccacgcccggctaattttttttttgtatttttagtagagacggggtttcaccatgtcggccagtctggtcttgtactcctgacctcaagtgatctgcccgcctcagcctcccaaagtgctgggattacaggtgtgaaccaccatgcccagccattatcttaattcagagctttccttcctctaggcagaattagatagaactcctcttatgctcttggaattcacagactgtccataatactgtaatagcatttatcacattataatgcaattgataatctgagcttctggttttagaaattgtatcataattctattttgtaccccagtgtttggcatggtgccagtcatatartaaatgttcaatagatatttgataaatgaataaataaatcagaaggatggtctcttaatgcttttcaaaacactagggagtatatacagaacagatgtccctacttatgaggaaaaagccccagatactacatttggccattttcttctttaaacagagtctactagatgactgggcaagyaagggaactctggtggaagaaatcaattgcaaaggtacttctttagaaaatctcatcatggaaatcacagcacctgattcccaaggcaagacaggtgagtacaggctcttcaaaatatagtgaataaaaattgctctttgcttttggcctttggagatgcctccttatataattaaagtgaaaatcaaggttggatatgaaaacaaagggcatgcccaaagcagtcttcccctgcaacctgacctgtcaccccttttgctatataacattgctccattttgcaaaattccttcccatgatggaaaaagtaaatgaactagttgtcccacttagaactatcaaatgaacactgaataattaaaatgagattttcatcttgagaatttcccttttttgaatgtgtaaatgggatgggtaagcatcatctttaaacttgggcactggccagccacgaagtcagaagatcaaaaccagcctggccaacatggtgaaaccccatytytactaaaaatacaaaaattaggccaggtgcggcagctcacacctgtaatcccagcactttgggaggccaaggcaggcggatcacgaagtcaggagattgagaccatcctggctaacacrgtgaaaccccatytytactaaaaatacaaaaaattagccaggcatggtggcgggtgcctgtagtcccagctactcaggaggctgaggcaggagaatggtgcggagcttgcagtgagccgagatcacgccactgcactccaacttgggcaacagacagagcgagactctgtctcaaaaaaaaaaaaaaatacaaacattagccgggcatggtggcacgcacctatagtcccagctactcgggagtytgaaacaggagaatagcttgaacctggtaggtggaggtttcattgagccacgacagtgcatgcactccagcctgggcaacagacagagtgagactccatctcaggaaaaaaaaaaaaaaaaaaaaaaaaaaaagttgggaaagcctgggtaggtatgattgtgatatccaggaagaagcaaggtatttagaagtcagtgttgggccaggcatggtggctcatgcctgtaatctcagcactttgggaggcctaggtgggctgatcacttgaggtcgggagttcaagaccagcctggccaaaatggtgaaaccttgtctctactaaaaatataaaaattagccaggcctggtggcttgtgcctgtaatcccagctatttgggagtctgaggcaagagaatggcttgaacccgggaggcagaggttgcagtgagccaagatcgtgccactgtattccagcctgggcgacggacggagaccccatctcaaaaaaaaaaaaaaatcagtacttcaaagggggtacaaagattgtgcccagatgtgtatataatctttcactgcaaattaagtctttgaagcaaaatctaatatgaaggccaggcacagtggctcacgcctgtaatcccagcactttgggaggccaaaggaggtggaacacttgaggccaggagttcaagaccagcctggccaacatggtgaaaccccatctctactaaaaatacaaaaattagccaggcatggtggcttgcgcctgtaatcctagctactcaggaggctgatgtgggagaactgcttgaacccgggaggcagaggttgcagtgagccaagattgcgccactgcactccagcctgtgcgacagggcgagactctgtctaaaaaaaaataaataaataaacaaaatctcatgtgagttcccagtcacttgctcgttgttaattgagatcacataagttttattactagtctgtgatagtgcactcctatagtcacttaacgagtaaaggaaaaatttatttgctttctgaaaatgtgtacttttctatagtattctaaagttaaaagatattttggaactatccacaagtgacatttcagggaattggtgatatatcaacctctacgttcagtgacttattcgtgtgactaaatcagagtcagcaaactttttctataaagggccagatagtaactattttaggtttgcagggtatatggtctctgtcacagtcatatacctctgccattgtaacaaaaacagccaaagacaatacattaatagaaatgagtggttgtgactgtattccagtaaaactttsttgaaacaaagggccagatttgactgatgagctgtagtttactgactcctagactagatcattttttwaaaaaaaaaccagaaatctcatatagaacagaaatctcatatagaaccctactacgtaaaacaaaacattttgttggctgccgggcscagtggctcacgcctgtaatcccagcactttgggaggccgagacgggtggatcatgaggtcaggtgatcgagaccatcctggctaacacagtgaaacctcgtctctactaaaaatacaaaaagttagccaggtgtggtggcgggtgcctgtartcccagctactcgggaggctgaggcaggagaatggcatgaacccgggaggcagagcttgcagtgagctgagatcgcaccactgcactccagcctgggtgacagagcgagactccatctcaaaaataaataaataaataaataataaaaattaaaagaaaccattttgttggtgtaagtttcccttatatgttattttatagcatttatctgttatgaaatccatcagtaagaatattgagactaacttaacgaatataaaaatttgaaaaggaagattattggatgacagcttcaccatctaatttctttctttctttttttttttcctgagacggagtctcgctctgttgcccaggctggagtgcagtggcacgatctcggctcactgcaagctccatctcccaggttcatgccattctcctgcctcagcctcccaagtagctgggactacaggcacctgccaccacgcctggctaattttttgtatttttagtagagacagggtttcactgtgttagccaggatggtctcaatctcctgaccttgtgatccacctgccttggcctcccaaagtgctgggattacaggtgtgagccaccaggcccagcctatctaatttatttctaaattttgtttggtttcattgtatccagaaaatatggttcacacagattaagtaactgcaaatgatgacaaatgtttttgaaagttgacttcacaatgtcagaacaggctttgattgaattgagctagaaacttgaaagtgatgtaataagaaattattgtttcaaagttaaatcactaagaatatttaatgagggcttttacacatagaaaacacttaagactracattgaggacaaaaactgtccaactgacttgaagtgttaagaattctattattacacaattctgccacaatgagaactgtgtagatgtacagagagcaagtcgtgttatatttttggtcgtgttatttaatgtattacacatgtgctatagatgtttttctttgtatagtatacatgagtggacatggacaggtttgaatatcataaattgctggtaaagagctaccacctttccaatcagggacactcaaaaataacttaaaatagatgcttagatgtgtcaggagctgctttactttccccagaaaagcagcataattggttttatctggtgggttaaggtgtagaattcagcataattgaacatgcatgttttattatcatttctaagtacttagaaatttatgtgaatattacatttaaaccaaacattaaacacaatccctaaagcacgtttttagggtgttttgaaaatcagtttgaaaattactatcttgagtgctctcaaagttctcctccaactctgaaaaaccatgtatatttcagttccttacatttatctagctccgtttcataaagtactttgatatacattcgctcatgatctcttcccagttaccccatgagagttaacaggataggttgtattatctttaaatcctgcagaataaactgtgtttgtagattaaggctcacatactgagttagtgacaaccttggttagtaccgtcttctcccacctactagtccagtttctttttttgcatcaccacactgcaatggaatgttatttttctattttgtattttttaatcgaaaatataataacattaacatttaaaagttttataatcaccaccctaattcagctaatttttttccttccttttagagacagggtctcgctctgtcacccaggctggagtacrgtagtgtgatcatggctctctgtagctttgacctcctaggcccacgcaatcagcccacctcaagctcctgagtagctaggaccacaaatgtgcactgtcatgcctgactaattttttttttttttaatatttttttgtagagacagggtctcgtgttgcctaggctggtcttaaacttccaccctcccaaagtgctgggattacaggcgtgagccattacacctggcccacaactattttgtttttgttgttgttttgagatggagtcttgctctgtcgcccagactggagtgcggtggcaccatcttggctcactgcaacctctgcctcccgggttcaatcgattctcctgcctcagcctccccagtagctgagactacaggcgtccgctgccacacccagctaattttttgcattttaatagagatggggtttcaccgtattgcccaggctggtctcgaacctcctgagctcaggcaatccacccacctcagcctcccaaagtgctaggattacaggtgtgagccaccgcgcccggccaactattttgtaatataaccttgcacatgactttttgtacagtgaagtcagtgcatatgagagttttctgtccttttaaagtatcattatgaatatttttcagatttctgtataatatttatcattacctcacctgatttttacctatcttgggaaacttctgaaatataaggaatcagtttggggagaatgtatgtgaaattatggtgattagaaacagaaccaaaggcccaaagcacaatttataagaatgttgatgagccagatttattggcacttaggatttctgttttttcttggggaaaggtgagcaagaagaggttatgaaagaaaaggcaaataatcttcctttaaaaacaatataagaagggctcattttaatgtctttattagaagaaggctgctttttaggccaggcacggtgactcatgcctataatcccagcactttgggaggccgaggcaggcagatcacctgaggtcgggagtttgagaccagcctgaccaacatagtgaaaccccgtctctactaaaaatacaaaaattagccgggcctggtggcaggcgcctgtaatcccagctgtttgagaggctgagatgggagaattgcttgaacctgggaagtggaagttgcagtgagccgagatcatgccaccgcacttcagtctgggcaacagagtgagactctgtctcaaaaaagaaaaaaaaaaaggctgctttttctgtccttaatggtattttcatttttattatattgaaagatattratataaaaggtgaaactttctggctttattataaaagcttattccaaaatatggcaagtaccattctagactgaataattttaccagtacttgcttcacaaaattagggcggcatccagagaattcaagttggagatttaataaaaagggaatacgaatttcctctrgaagggattaagaatcattcctgctaagaaccttgagtgacrttttgttgcctggcrgctaaaataatttgtctctttccatgagtatgttgtcttgtgctgtgttaacttyctgatacctaagcttaaagtgagggccaaaggacaaattcagtgcctatatgtattcctaacacgttggtcttgccctgtttgtctccctgtccttctgctcaggttccatactgccctctgtaggaagctctgtaggcagtgtaaacggataccacacctgcaaaggtgagaatgccatttcaacagtgcttctttgttggatgtgttaggacagtgtctatgtttgcatctgtgtatgttgcaatatgtggtggaagaactgctgccagaatgggtgtgaggataaaaatctggggagaagcaactgtggtttgctggctatagaccataaacaggttggcagcccctgaagctaaaggtattgtagaaatacaatagattggatcactagataaggcaaatagggaaggaactcaaagaaaatatatgttaatctttgaattataaagaagttatactagagataatctagtctagctctcagcctcccagctaggtgacttctctgtagtttggagaagaaggaatggaagaatgctccaagtcccttaatcccaatagtaaactaaggttaatttcttactttgctcccttcacttttgttgttcccatgtttagcattttaaggtatacatctgagtatataatgccaaaaccagaaagcagattaatgagaaygcttttgttttgtgtatataaatgggaacttttgtatgatttagcaggaagataatctctaattcactagaaggagtaagagagatgcaagtaatttaggagtgaggagtcaaggagcatactcgaagagctgtctccaatctgatttctgtttctatgatactagatctgacggagatccagtgtgacatgtcagatgtaaacttgaagtatgagaaactagggggagtacttcatgaacgccaggaaagccttcaggctatcctcaacagaatggaggaggttcacaaggaggcaaactctgtgctgcagtggctggaatcaaaagaggaagtcctgaaatccatggatgccatgtcatctccaaccaagacagaaacagtgaaagcccaagctgaatctaacaaggtactgtgtttacattagttgcctcccaacaccaagaggaagagacagctgtaccagtgttcctgcccaagcccaggtatctgagagagagacatgggcaacaatctaggctgtgatgggcagtatgtttgacattctaaatgattaatatgccttaactctcctagagaattttcttatgaaattagaaattgttataagttagattcagaaacaaaaccaggtatgtttgcagaaaaagaatagccctccccagaatcgttagctcattgagaatgggatctcattttctatatgatgctgtaagcaagacaaaccattcttatcaaagtatctttccaattcttagagggatctaaataacagtgattacagttcattcttaagattgacatgtgagactaggaaaaatgtcagaagatataagaccacagaaaatcctgtaggcaagtttcaccaaaacttttaatattcccattgagcgtagcatctcatctccttcaagwtatgttatcatcatatcttggtatttttagtttattttgattaataattccttcttattgagttctactgatgtattatacataaaagaaactcagatcctgccatttagattttcattttaaaataaaaattgaagtagaagggttaagtatcttaacaccactaaacaagtcattgataggatcctagtagagtctataataactgcccagttttccaatcatttctaccacacacacaactttgtttcctgtccagaatctcatggcatgcatggcattctttctcctaggccttcctggctgagttggaacagaattctccaaaaattcaaaaagtaaaggaagccctggctggattactggtgacatatcccaactcacaggaagcagaaaattggaagaaaattcaggargaactcagtaagttttcacaagagtgttacaaatttgctaagttacttgtcttcaaagcaagtagagaatttcagcacatcctataaaacaggaattatttttagttaatttttataaataagcaattaggatccagatagggccagagcatgagcctgaattgggaagaaaattagaaattccactcaaaaagtcagaagtttggctttcttgggcaagtcaaactgrtaatctactgtgatcaagaaccaaagagaggccaggaacagtgcctcacacctgtaatctcagcactttgggaatctgagacaggaggattgcttgaagctaggggttcaaaccagtctgggcaacatagcaagatcctgtctctacaaaaagcaaggaaaaacaaattagccaggtgtggtggcatgagcctggagtcctagctactggggaggctgaggygagacgattgcttgagcccaggagttcaaggctgcagtgagctatgattgtgccactgaactccaacctgggcaacagagagggaccttgtctccaaaaaaaacgtaacaaaagaactaaagagagtattaatgataaaaatgaaagatggaaataataaaaatattcaataaagagattagataaattgtgtactcataatattgaactgtaaacaatgtagatgaattttttttaatttaattaaattttttttttgagatggagtttgctcttgttgyccaggctrgagtgcaatggcatgatctcrgctcacygcaacctcygcctcycrggttcaagcgattctcctgcctcagcctcccgagtagctggsattgcaggcatgcgccaccatgcccggctaattttgtatttttagtagagagggggtttctccatgttggtcaggctggtctcgaactcccgacctcaagtgatccacccacctcggcctcccaaagtgctgggattacaggtgtgagccaccatgcctggcctttttttttyttttttttttttggggggggggacagggtcttgctctgtcacccaggctggagtacagtggcacaatatagctcactacagcctcgacttccctggctcaagcaatcttcctgcttcagcctcctgagtaggtgggaccacaagcatgtgctaccacaactagccaatttttaaatttttttggtaaagatagggtcttgctttgttgtccaagctggccttgaactcttgggctcaagtgattttcccacttgaggagttcaagaacagcctgggcaacatagggagatcccgtctctacaaaaaataaaaaattaactgggcatggtggcacacgcctatagtcccagctacttgggacgctgaggtgggaggatcacttgggcccaggaggttgagacttcagtgagccatgatcgtgccactgctctatcctgggtgatagagtgagacactgtctcaaataagtaaataaataaataacgcttctggggtcatttcctgcagtatattaggaacataacttaggtaccaggccagttgttgataatgtaaaggaatacattccctcatttcctctctacagattcccgatgggaaagggccactgaggttactgtggctcggcaaaggcagctagaggaatctgcaagtcatctggcctgcttccaggctgcagaatcccagctccrgccgtggctgatggagaaagaactgatgatgggagtgctggggcccctgtctattgaccccaacatgttgaatgcacaaaagcaacaggtccaggtgagcaatatagcaacaaagaaattggaatcacatgaaactgggtttgaatgtttctcccagtaagtagatttcatgtgatcctggacaagtcatttaatctctcagagtctcagtttaaatgaggtatttataaggtgttaatcatggtgcctgtaaaatagtaaacagtcaaaaactctattattattattaatagagacagtaagatgagtagatatgagaatggggagtttttctgactaaattgtggaattacattttacttttggctgggcgtggtggctcacacctgtaatcccagcactttgggaggtcgaggtgggcgggtcacaaggtcaggagatcaagaccatcctggctaacacaatgaaaccctgtctytactaaaaatacaaaaaattagccaggcgtggtggcatgtgcctgaaatcccagctacttgggaggctgaggcaggagaatcatttgaacccaggaggctgaggttgcagtgtcctgtccggacagtagagcgtgactscgtctcaaaaaaaaaaaaawtttttttttacttgtaatcccctgtgatagtgatccacattacttaatatcttatatctgccggctttacataggattttctgtgatcaaacctcaaaaaaattgatttaagtgcctaacatcatagaaatttaggttggtcaggccgggtgcagtggctcacacctataatcctagcactttgggaggctaaggtgggtggatcacctgaggtcaggagttcaagaccagcctggccaacatggtgaaaccttgcctctactaaaaatacaacaattagccgggcgtggtggcaggtgcctgtagtcccagctactcgggaggctgaggcaggagaattgcttgaacccacgggatgaaggttgccatgagccaagatggtgccactgcactccagcctgggcaacagagcaaaaactgcttcaaaaaagaaagaaatttaggttggtcaaaattatgtcattcccaatgaaatcctgcctggaggcttttacttcttttacattctcccgcagcctggtccatgtcttctcaacttaccaggttccttaaattaagacctaagagtactttttgaaggaactgcttcttttagttcctgcatccaggtaattattgagtcctatttagtctacttaacaaatatttttctaatccgggattttcaaactttttggcttcaagaaccccttttattctctgaaaaattactgaggatccccaagagcttgtgtttatctattaacatttattgtattaaaatactgaggaattttaaaagtatatatttaaatttttaaaatagcaatgataaaaccatcacattaacgtaagtaacatatttttaatgaaaaaatagcattttccgaaacataaaagtttgataataagagtggcattggccgggcacggtggctcatgcctgtaatcccagcactttgggaggccaaggcaggcagatcacgaggtcaggagatcgagaccatcctggcttgcacagtgaaaccctgtttctactaaaaatacaaaaaattagccgggtgtggtggcgggtgcctgtagtcccagctgctcgggaggctgaggcaggagaatggcatgaactcgggaggcgaagctgacagtgagccgagwtcgcaccactgcactccagcctgggcaacagagcgagaatccgtctcaaaaaaaaaaaagtggcattgttttatgtctttgcaaatcttaatttctggcttaataggctattctgcttctgcatatctgttacaatatcgaatgccatgtagcttctgggaaacatcattgaacatttgtgacagcgcagaaattttaaaaggcaaataacatcttagtattattatgaaaatggttttgatctctgtatgtctgctaatcctagaccctcccctgaagtgcctttcaccagccttaatctctgctctgcttggagaactgctcgttctttattgtcacatctagggagcctttcctaatttctgtcttctgccatttgtcatccccagcggaattagccaccctattccatgctttcacagttctgtgttgcgtgttcacatcagagtttaatcatttttacttttgttacattttattatagttcattgtttacacatttgtcatttcgtgaggctatgtcttatttatttttgtgcagtgtaaatactgagtactttctataaattatctcatttaatccttataacagccaaagtaagtactttactgtcctcattttacagatgaggaagctggggtttgagaacttatgaaatcttgcctaaggtcatacagctagtaggtgacagaaccaggatttgaacacaggcagtctgactccacatcctgtaatcttaacttttttgatgaaagcagcaagggatatgaaaagaaaaaaaagccatagtcattgccttaaagaagctctttgtctaattatgctatattataaaatacagattgtatatgctcttcgaattctaagaaagaaactaagaaaaacagacactgagagttgacatggcaagcccagctagtaatacagctggctctgggatccagtgttctgaactcccaattcagaggcttgggtattgcatggcaaagcagatgaatgccaactttaatttctcagccgtgtctggccttagtaactgacattgaaacagaatgggacaaataaggaaaagaaataaaataggaacaatcagtgatcctttcaaagtaagtttttattaagcaattgttaagtgatactgcctcagcctaatagcctggtcctttagttttctggcttatagttttaaagtagttggcactatttggcacaatccaacatcagtttttgttttgacactgctttttcttttttggagacaaggtctcactctgttgccyaggctggagtgcagtggtgctgcctcagctcactgcaacctyggcctcctgggttcaagcaattctcgtgcctcagcctcccgagtagctgggactacaggtgttcaccagcacgccccactaatttttgtatttttagtagagacggggtttcgccacgttggccaggctagtcttgaactcctgacctcaagtgatcctcccacctcggcctcccaaagtgctgygattacaggcatgagccactgtgcctggcctgacactgcttttagatagatctgtttttttcctgtctaaacatcttggtgtcatttctatttcagtttatgctaaaggaatttgaagcacgcaggcaacagcatgagcaactgaatgaggcagctcagggcatcctaacaggccctggagatgtctctctgtccaccagccaagtacagaaagaactccagagcatcaatcagaaatgggttgagctgactgacaaactcaactcccgttccagccaaattgaccaagctattgttaagagcacccagtaccaggaactgctccaggacttatcagagaaggtgagggcagttggacaacggctgagtgtccagtcagctatcagcacccaaccagaggctgtaaagcagcaattggaagagaccagtgaaattcgatctgacttggagcagttagaccacgaggttaaggaggctcagacactgtgcgatgaactctcagtgctcattggtgagcagtacctcaaggatgaactgaagaagcgtttggagacagttgccctgcctctccaaggtttagaagaccttgcaggtaagttggggtgaagaacatacttctgccattattagaggcaagcagaaagaaggaatgggttaggagtagtcccaagattctaggattcccttacgtaatttgtagactcagaatggtgttaaaccaattccttctcctagttgcagtgagaactgttgtagttgttacacagtgaacacttaaaaatgtgaaggtttacatagcatagtcctaaagataaaagctctaataaaatttcagtcagcaagtagagattcatccccatagatgtactgataaatggagttccacatatactctcattgatasccactttttttttttttttaatattatgcataccacacacacacggtctcgctctgtcacccaggctggagtacagtagtgcgatcatggctcactgcaccctcaatctcctgggctcaagtgaacctcccacctcagcctcccaagtagctgggactatagacacacgccaccatgcccagctgatttttttttcttttttttttttgagacagagtctcactctgtygccccagctggagtgcagtggcacgatcttggatcactgcaacctccgcctcctcggttcaagcaatcctcctgcctcagcctcccaagtagctgggactacaagcacgtgccaccatgcctggctaatttttgtatttttaatagagacggtgtttcaccatgttggccaggctggtctcgaactcttgacctcgtgatctgcccgccttggcctcccaaagtgctgggattacaggcgtgagccaccgcacccagtgattatttttatttttagtagagacgaggtcttgctttgttgcccaagctagtcttgaactcctgggctcaactgatcctcccacctcagcctccccaagtgctgggattacaggcatgagccactgcacccggctgcttctggacttcttatgataacttggtagaagaaaaattgtgccattaatttattatttatttttctggaactgtttatgactttcacgtttaccagctagaagtcaaagtttacttctgttacttagatcaccttacaaggttgatacgaggattaaataagatagtgtacatgaaggagcctaattatatgcctctttttggtaggccctcaagtaacattagttccyttcccccaagattagaccgtatactctcagcaaacattttaaatgccagggttcaggctttattgatttcaattttattttctcatttcagccgatcgcattaacagactccaggcagctcttgccagcacccagcagttccagcaaatgtttgatgagttgaggacctggttggatgataaacaaagccagcaagcaaaaaactgcccaatttctgcaaaattggagcggctacagtctcagctacaggagaatgaagagtttcagaaaagtcttaatcaacacagtggctcctatgaggtgattgtggctgaaggggaatctctacttctttctgtacctcctggagaagagaaaaggactctacaaaaccagttggttgagctcaaaaaccaytgggaagagcttagtaaaaaaactgcagacagacaatccasgctcaaggattgtrtgcasaaagctcasaaatatcagtggcatgtggaagaccttgtgccatggatagaagattgtaaagctaagatgtctgagttgcgagtcactctggatccastgcagctagagtccagtctcctaagatcaaaggctatgctgaatgaggtggagaagcgccgctccctgctggaaatattgaatagtgctgctgacattctgatcaattcttcagaagcagatgaggatggaatcygggatgagaaggctgggatcaaccagaacatggatgctgttacagaagagctgcaggccaaaacagggtcactcgaagaaatgactcagaggctcagggagttccaggaaagctttaagaatattgaaaagaaggttgaaggagccaaacaccaacttgagatctttgatgctctgggttctcaagcctgtagcaacaagaacctggagaagctaagagctcaacaggaagtgctgcaggccctakagcctcaggtagactatctgaggaactttactcagggtctggtagaagatgccccagatggatctgatgcttctcaacttctccaccaagctgaggtcrcccagcaagagttcctckaagttaagcaaagagtgaacastggttgtgtgatgatggaaaacaagctggaggggattggccagtttcactgycgggtccgagagatgttctctcaattggcagacctggatgatgagctagatggcatgggtgctattggcagagacactgatagcctccastcccaaatcgaggatgtccggctattccttaacaaaattcacgtcctcaaattagacatagaggcctctgaagcagagtgtcgacatatgctagaagaagaggggactctggatttgttaggtctcaaaagggagctagaagccctgaacaaacagtgtggcaaactgacagagagggggaaagctcgtcaggaacagctggaactgacactaggccgtgtagaggacttctacaggaaattgaaaggactcaatgacgcgaccacagcagcagaggaggcagaggccctccagtgggtagtggggaccgaagtggaaatcatcaaccaacaattagcagattttaaagtaagtctgaaccttgtttttctttttcttttacatgtatttatttgcttgtaacttggaaaccagtcaagtatacattttaacttctgtccctagttttattattgtcacttccatcaccatgaaagcacactgtctgaagactaaatagtctctcggacttctgagcaaactggtttgagcatttttctttttctttttcttcttcttcttcttttttttttttttttttttttttgagacagggtctctctctctcacccaggctggagtgcagtggtgcgatctcggctcactgcagactcgacctcataggctcaagcgatcctcccacttcagtctcccaaggagctgggaccacaggcgccaccatacccggctaattttttgtattttttgtagagacgaggtttcaccatgtctcccaggctggtctcaaactcctgagctcaggcaatccgcccacctcagcctaccaaagtgttgggattacaggcatgagccatcacgcccagccagagcatttttctattgtagtttatttcagtctttataaccaattaaggatatagaaagaaatgtccaagtcttatctcttactctaagaatttccttttaggatttcttgagatttcagattaccagattttgtaatagcagtgaatgtatcttcaggtctctggtttttgtgtgtttttttttttttttttttttttttggagacagagtcttgctctgtagcccaggttggagtgcartggggcgatctaggctcactgaaacctccacctccggggtccaagtgatcctcctgcctcagcctcccaagtagctggggttacagtcgctcaccaccacgcctggttaatttttatatttttagtagagatggggtttcaccatattggccaggctggtctcgatctcctgacctcaagtgatccacccgccctarcctcccaaagtgctgggattacaggcattagtcaccgcactcagccccctgtttttcaaattgaggtatgaaaagccgtaagttaaacatagtctcatcttcctaaagggtttattttacatagattttaggggaggatattgatgtatatttgatatattatggaataaaacataaaattatcattaattgttaagataaaacatgacacttcaaataaatctcccatttatatagtaagcagcttaataatacatcccagactcctcaagagtacaagttctttgcctataggaaagaagtttgagaagtactgccttaattgcaaaaatactttaattctttgcctgagccaaaatctccattcctgagattgtgtgagtataaattaaagtaacaggagatgattacatgacccaaaagtgtggatttactgggttaggagcacatctgttggatcttggttctcactatattaacctgttgcccctagagttttccttgtggtaaatacgtaaaagtctctcactctgccactgtacatggaatagatttggaaaggatactttcagcactttgtttccatcactagagttaattattcctgcttacacagttaacactcctgccattaaagtaaaattgtgatctcagagaccctgcttgccagcgttatttatcttaaaaacatggatgcagaggtaatgttgacaccagctcagagccacgtagtcctagagacgtcacagttttgtagacaggatccaagtrcaaaaatgtggctgtttcagaagggcccctctaggagcttgggagaaattcagcactaaagtgggacattggctgaaggccttcttaccatgtttggagatagtacaattttgagcaagaggagtcatcgtatttgggtttcttgaggcacccagataaggaaagggtaggtagagaaaacgtaaacccgtgaagcagtgcattcctcttakaaacttcctttctagtggtagtgtggccttccctgtttcagcttgcacatttttctttcctcttttgttataagtgtctcaaaagcagagactttcttctacaggtatgcttcagttatccaatttacttgcatccaggctatttagaattaaccatctaaccaactcaatgaaatttttagaaaactgaaacttatccctttaggctccaaaatagttttgttttatcagccgggtgcggtggctcacgcctgtaatcccagcactttgggaggccgaggcgggtggatcacgaggtcaggagatcgagaccatcctggctaacacggtgaaaccctgtctctactaaaaaaaaatacaaaaaattagctgggtatggtggcaggcgcctgtagtcccagctactcgggaggctgagacaggagaatggcatgaacccaggaggtggagcttgcagtgagccaagatggcgccactgcactccagcctgggtgacagagtgagactccttctcaaaaaaaaaaaaacacacaaaatagtttcatctaaccaggttctggtttatataggaattattttaaactcaatttgcctaattttctaaatatgtattatgcataagttttttttaatgagtgcaggttaacattatttaaatggttgtactgtctatactatggtgatattctcaaggatgtgagacacatttggagctgctttgtattaagtattcccaaattactgtgcactttgatttctatattgaagttattgtttagggcctctatagtattatactggttggattggctgtgcatgtgtgtgtggagaggaggaggtaattttgggatttctgcccaccaccatgatattggttattatttcctactgctatcacttttcactgctgtcatttggtctgtrtagtctattcctcccttctaatcttcactgagctagaaaatgagataaacaggcctgttaaaattgcattagatatgagctaaaatgtacaaaagagtccacatgcrggcataaatagtgtttggatttgaggacaagtcatcttttccttttcatttaatccttggtttctagagacattctgacttttgatgttgctggaagatttcaaaaaattactgggcattactttatcttatttctatcctagtatgttgcctaatagtgctcagagttcaatagcrcttagttgcttgtcatagccaaattcgtttcactgatttctaaaaataagccttccacctcagatactctggatgtgaaggctgggactggacactgatcggctgggctcttrcagagtgtgttcatcmacagtggactggtgttgacaaggcaagcctggaagaagagtgggagaagggaraagggtggtggagtgtcctgtgtgtagtccattgtcaagtcagtaggtagttaccataaaatgatcagtatccmccctcaagttggggatgcaaatcaaaagccctgttccacctgtccaccttgtagggaagtcaaaagctttggaaagagtttttgccttctcccagcaaaaatctttggtcaggaggggaggagcatattcttggctgaactcatgctgagctcatcggaagtgaaaacaatgagaggagaaaaattctgtgtgtcagttccatagtccccaggaggcygcataaagggaaggtctttttggacccattctgaggactgagtcattttcatgatttgagtgtggagttcctgggttaatgtattatagtccagccatagattaatctttccttactccagcagcagaccagatttataaagtatgactctgttttcagattcaaattatttttaataaggtaaaaacaaagatgaagataaatatttttaaaaacagcattagctgtaagttttcagctctttttttaatggaatcatacttttagcacagaatctgcacaagagaagaggatatgaatctgggagacggaaactctgctttaacccagctaactccatgggagctagaatagacagatgagttaggcctgtgaagaaccccccagtcttacttgggactgtacagtcttgctgatagatccatggatctgcagtctgtggggaaaattatttcttccttaaatgaatgtggaatactaaaatacattattcctaggaaaggctttccctcagttgcttctgaatgattagtaggtcctcactggcwgaccagattctatcacatgggagtggaagagagttcctttccactcaaaccaggcagagatctcaggcttcctgagttaggatctttwccaggttcagctctctgttggaagtagaaaggaagaagccattctagaaatcactaatgagaggattgagcttgttttcagaaagctggaaagaaaagactttggcaaatctcttcaggaaattccgttttcctgaacaagggagtctggttattgaggaaaaggaattgtatgtgtctaacaggaggctaacaagaaaggaaggacstttttatcactgaaacttgagccaaagaattcccctagagtgaccttcctgggaagggtaaaaaaaaaaaaaawawawatatatatatatatatatatatatgttaagtctctgatgataacaagagattttcctcattttgaaattccctaygtaggttttacttgaactgagatcattctgaatcttaaaccaacccctcctttgccccctgctccccgcaagaaccatrtgacttctcactcagaaagtatttgatggtttgggcatcatactggtgagcattatcaagaaacctggatgcaccttcattcacttgtttttcatatgtatttatattgttgtgtatttgggtcatgcttcagacttggcattctacctctcagtgataaaatgaacaatggggccaggcacagtggctcacacctataatcatagcattctgggaggctgatgtgggcagatcacttgagcccaggagttcgagaccagcctgggcaacaaaatgaggcggcccttctataaaaaataaataaattagctaggcatgacggcacatgctgtggtcccagcttacacaggaggctgacgcaggaggatcacttgatcctaggacgttgacgctgcagtgagctgcgtccatgccaccgcagtccagcgtgtaacagagtgagaccctgtctcaaaaaaaaaagaaagaaagacagagagagagggagggagggagagagagagagagagaraaagaaagagagaaagaaaagaaaggaaggaaggaaagaaaagaaagaaagagaaagaaagaacgaacgaacgaacaatgggaaaaattgactgacagacctctttagggtctgcgagtttctcatagtggttcacttcacccagtggtgcatataaagcacccaaaccagttggtcttttcctttcttgtctttgaggctgggctgctgggttctaataggtgcagcatcaggcttccttaggattattttcattcctaattcaggttgagcagagcccaggatcagggtctcagtatacttgaagtttctaccgggggacctaggtatcctactatgaaaacagaataagaaagtcttgtaaacgccttcatttgattgattgattgattgattgattgattgattgatttattgccacatagaaagcaagcttaggcatcttcatgtgcacatgagaaaagccctggaagaggctgggggcggtggctcacgcctgtaatcccagtactttggaaggctgaggtgggtggatcacctgaggtcaggagttcgagacgagcctggccaagatggtgaaaccctgtatctactaaaaatacaaaaattagctgggcatggtggcacatgcctgtagtctcagctgtttggggaggctgaggcaggagaatggcttggacctgggaggcagaagttgcagtgagccgagatcgcaccactgcactccagcctgggtgtcagaaagagactccgtctccaaaaaaagaaaaagaaaagccctggaagacagggcccagcatggagttgaaagactgccagtttactccttcctttcaaatgattacaaggacagtatcagctcatgtacgtttttggcagttagtacacctgcctgagagtgagtcactggaggatagagcaaatgaggttagcgttatctacctgcccttggagagacaggaaatcacacttggtatgacctgtctgtcacctggaggtttaggtttccccagctttaccaagatgagtgggtatcctctatccctgccaacccccaccttgtgctgacccttccttggcctgtcttggttttttcctttcttccttaaacaaagctactccaaataggaactagggtccaaggaaataaagacagtatcctaaaatggatttctcaatttcggcactattgacattttttgggggtgggtggggaggaaaggggcakccactcacgccaccacctctgcctgccactatcaacattttggactggataattctttgttgtgagaarctgtcctgtgcattgtaggctgtttagcagcatttctgacctagtaacttcccagttgtacaactaaaaatgtctccctggaaggcagaattacsctctgttgakaactatakccctggaagaaattgccacctatacatgggaaacttagaattcaggtggaataggttactagttaaatatttatgtaacaagcakccttctgataatctgattatgactgtgtgtagtggcaacaaccacttctaagtcagctttcctttaagccaggctctggattctttatttttgctggccttaatctgtgtctggcttaacacctcctggtcactttccctggctggaatttacgtacagttgtcagttgttgatgcaggtgtttggttgatgatgcattgccaaagagaagaggaacttcctttgtggacatacttcagggagcttccttgttctgtgcctttaaggggagactacagtctctcagttgttctccacagccaaccaagagtttggctgctgatatttataacccttatgtgaccacccccacctccccaccccacaaagaattccaatgctctgtaataatcctctccacccccaccatagcaactggatgtggagaaggtgaaggagcctttaaggcctttaagtttgcttcatgttgaaccttttccagctcccttttaaaatattgccagttgtattttaaatatcagtgtcacaagcaaaatcccaggcttgcagccactgcatcatcttaaaggagcctcatgccccagtgaaggtagtaaaattgaatggaaggtagtaaaatcatcaagaaaggattgatagattttacaaaaatctgtctggaaatttgatagcaaggtgagattttaaagcaacaaacaggctaggcgcagtggctcatgcctgtaatcccagcattttgggaggctgaggcaggtggatcacgctgtcaggagatcgagaccattctggccaacatggtgaaaccccatcttakccgggcatggtggcatgcgcctgtagtcccagctacacaggaggctgaggcaggagaatcgcttgaacccaggaggtggaggttgcagtgagccgacatcgcgccactgcactccaacctgggtgacagagcgagactccatctcaaaaaaaaaaaaaaaagcaacaaacaaatatatctgtaaccaaagaaaaggactgagcagttggatttgagtttactaaaattcttcacatacagtatcagtatgtagcattcacaactaagatttatcatttgtataagaaggaagaaatatatttccagaaaaactagaatgtatcctgtgcagaacttgtatgtattgatcgtttagtagttgattagtaaacayggttaagataagcacagacttgcagaaaaggactgatcctcactgtgcctagaaatgaatggtaaatggtctcagccttaggctggttctggagcttcagaaaaatatcctgggcactttcaagctcgctaataagctatgagcttctaggaagtacgatgagtttctttgaagggccgtttattgttagagttgctggtttactaggaataaaatgacttccacagggagttgtgtcaggtcactgcaccaaaccatcactgtaaagggctgtctcctgctgaatggattcttcacaagtctcagctgtcccagttggaaaaacccagctatgggtagaatgtgcaccctccctactttgccaccactaagtgcttttcaactacgagtctctcttattgactatagaaggttaatggaatacacttactctctaggacgtcataaactatttttctaccaccagtcatgtcatttgaaatatggatctttgctacacatggtgatggttcatggatggaggttaaaaggaagtgattccatattccttttaacccatccttactgggcagttgctctgtgctagtscttgtggtgggtactggagtctcagatagtctctagttaacagtgtacagatgtgccttgacttacagtgaaattatgtctggaaaaacccatcataactcgaaactattgtaagtcagaaatgcatttaatgtacctactgacagccgggtatggtggctcatgcctgtcatctcagcactttgggaggccgaggtgggtggatcacctgaggtcagaagttcaagaccagcctggtcaacatggtgaaacccggtctctactaaatatacaaaaattagccgggcgtggtggcgagcgcctgtaatcccagctactcaggaggctgaggcaggagaattgcttgaacccgggaggcagaggttgcagtgagctgagatcatgccattgcgctccagcctgggcaaygagcgaaacttcgttccaaaaaaaaaaaaaagtagctactgaccatcatagctcagcttagcctaccttaaacatactcagacacttacattagcctacagttaggcaaaatcatctatcagaaagcctattttataataaagtgctgactcgctcatgtaatttattgaatattgtactgaaatagagaaactgaatgattgggtacttgaagtatggtttctactgaatgcatatcactttcaccatcataaagttgaaaaatcttcagttgaaccattgttaagtcagagaccatctatagtaagggaaacagatacagagaattacagtggtactgatgtagtggtaaatgcagtaagaaagatctgagtctaaatgatctctgaaaaaaactctaaatcagacatttaaaatcctattttgcagataagaaaacttaagacttgaagaggttaaaataacttgttcgagccacatagcaagtaaatattagagttgggattgggaaggtctgtttggcaccaaagtttatgctacaccagtggttgtcaaccaagcatagctttgcagagactcccactccccgccactcctttttttttttttttttttaaacagtttcactcccatcacccaggctagagtgcagtggcacaatcatggctcactgcagcctcgacctcccagtctcaagtgatcctcctgcctcagccccacaagtagctggaattacaggkgcatgctgccattcctggctaatttttgtattttttgtagagatagagtttcaccatgttgccaaggccggccttgaactcctgagctcaaakgatctgcctacctcagcctctcagagtgctggtattacaggaatgagccacagtgcctggcccagagacattttttattgttatgactggaaaagctgctactggcatctagtaagtgctgcgaaacaacctacaatacacaggatgacggccccttacaatgaaagaattattcagcttacttctagaaagctagggaatttgatttttgccatcttcagatcccatgacaagtaagagttaactgattaaatagttccactcgctgggggtgcttctgtggttttcctctccttttaagaaaattagttaagaaatagtgttgcttccgggagtgacttacacagatagagtcaggatcttggggaactaatctgagtcagcgactgaagaattttctctatgcctgaccagtccccaccccacactgccacaaggctcctgctgtggaaatcaatcagctgtgtatctcaggctgcttcctgtagggtgtgttatggaatggcatcagcccttgcaccagctgggagtactgatctcagtgtgattttatcagactatgtttcttttgagccttactgtttggaacaaaggaccctctgttaagaatgcagagagctggtgtgattggatagctagcatatacatacatggttcctatgggaaaaaaacagacataaattatgctatagccctctaaaattttcatctccaaaatgatttcctgaccttctgtctgtattcacagttctttctgtaagtgcttatccttcccccaaagcaattcgaaggccatctgatctgataaatggttgtatccttcagaactagcctatttctgtgtctccagtcttggatgtatttgatccccactatctttccagtgttatttcctatatagaccatacactacatccagttaccccagacactccttatacattttaggtatttgatttctgaagtcatagctcaagtccacttctttataaagctttttttttttttttttttttgagatggattctggctctgtcacccaggctggagtgcagtggtgcgatctcggctcactgcaatttctgactcccaggttcaagcgattctcttgcctcagcctcccaagtatctgggattacaggcacgcaccatcttgcctggctaatttttttgtatttttagtagagacagggtttcgccacgttggccaggctggtctcgaactcctgacctcaggtgatccacccacctcggcctcccaaagtgctgggattataggcgtgagccaccatgcccggccttataaaggcttttgatctccccagctcactactcctgatctcttaatcatttacaatgtataactcacttggcttttatcacataccacctaattttgacattttctgrttatatccatttgtcctatcccctcagttaattcacttttgtgtcccttaatgtagttagcatattggtatatacacagttggagatgagacaatatttgactgactggatgaacattctttatttctcataagccatgtgagctctaggattcaaaatgctatctactctgcaagacttgaggtatatatccttgtgtrtcctgaagaaattctaatcttagcctgatttcctcagttctccatctttcttctgggcttccttccttctctgctagttagtatatgttaagggaacacaatcttttttcagtataagagggcaaaactaagaaagaaatgtgctacttcttatgcacagagtcattgctacttactcaattagttgacagtttggtgtagtgaaaaaaactgaatacaagttctagtcagaagtatccaggtttgaatcctggctctatcatttactagctgagtgaccttcagggaaattacttaacctctctgaatcttacttactttaactgtaaaatacaaatattggtaaatcatacctttaggatttttatgaaaattaaatgaagtgatatatctaaaagtattaggcttatatttggtgctcagctcactagatgataatatgcttttttttaaaaagaagcttatctagacatataaattagaatattgkgaaatctttttttttttcattttttgtttgtttgtttgtttgtttttgagacagggtctcactttgtcaatcaagcctgaagtgcagtggcatgatcatggctcactgcagcctcaacctcctaggctcaagcgatcctcctgcctcagcccctacaagtagctgggattacaggcatgcaccaccacacccagctaatttttgtatcttttgtagagatggggttttaccacgttgcccaggctagtcttgaactcctgagctcaagtgatccgcccacctcagcctcccaaaatgctggggttataaacatgagccattgtatcaagcctgtgaaatctttttaataagaacagttacccctctttgtgcctagggatcatcattctccagaagacttgatctaaggcccagcaccagattattttcttcttgaaaattggaaaaatggaaattatgaggataaagtaaaattagtttgataacaatgaaacaagtggatggatagagagccttcctgagcagtttttgtgggaacaatagggcttatttctagccctagagtgggaataataggcaagtttaggtcatgattcaacacagcttaaaatatattttatgtacacatacatatacatacatatttatttattcattaattcatttatgcatttctatcagaatcctacaaccagcaggtttttctgagaccattttggccttggcttgtatgctctacaaattcatattattttcaaatcattaaccagaattaaccagaagacattaccagctcagtgacttccccagccactcagttgcccattagatcagctctaatgatctcagggattttggcctaattagcttttatcatagaccatgttatcttcctctgttaccgtacaatggcaactactaagtcagcatctttaggaaagacatctcttaatattaatcaatctttaattaaaacattgagggctgagccaaaaaatatcggcagagtttcagaagcaagcagcttaaaatacagatataattcatctgtctgccaatctcataccagattgagatgttttacagaaagtctttaattctttacagtttcagcaaatatgtgtttttaatgtttttaacatttggtcatgtgtatatatgagtcaaggaaagaagataattcaaagaaattatatgtgccttagattttctccatcttgaattaattgtatttatcaagtgaaccatttaatatctctgtcatcttgcaattcattcccaaaggataagctctggttttggtctaattctttaaattcatacctaagctgtttgtttctttgtcatcaatgrtaagaaktttccttagtaacgaaatgaaagagatggtttttagaaatctcttctctctgtattatttattctgccttcttttctaatattgaggagcaggggctggacgcagtggctcacgcccgtaatcccagcactttgggaggccaaggcaggcagatcacttgaggtcaggagttcaaaactagcctggccaacatggtwwaaccccgtctctactaaaaatacaaaaattagccaggcttggtggtgggtgcctataattccagctacataggaggctgaggcaggagaatcgcttgaacctgggaggtagaggttgcagtgagccaagatcgcaccattgcactccacctgggtgacagagtgagactgtgtctcaaaaaagagggggtgattcaacccagagacctctttcatggaaataaccaagcaattttgtgatgatcatgccactctggaactggaaagactactctcagttagtcccagggggaggcccacatcatcactttctcagggaaacctaccctgagcttccaggccaggttgaggcccatgacccatgttctcatagcacggtgtgctttccttagtgcctgggatagtttagagcacatagtagataccaataaatatttggtgaatggatgaaaagaagagaatcaacgatataaccttgtgaaattagttgcctcaagaggagaggaagaggaatccaaggagacaaagaaggactggctagaaagatagcaccagggtaccacagtgtcatggaagtcaaaagaacacagtctcaagaagaagggaggatccatacttatttctcaccactgcttatccttaaccccctctaatctgatccaacacccatcactgtgctgaaactgctctcttagatattcattggcttcctagttgccaagtctagtggccttgtctgcctcactattcccctctttcattgtacagcatttaatatcagatcttctttcttgaaagttaatttactttctggacattgtgctcttccgttctcttctctggctgctcttctgctttcctttttggtttgtcttcctatctcctaaatatgtggttccttaaactctgtcatctgtctcttctcttctctctgcactcaacctctgagatggcagctcctcactgttctatggggaaaggcttccaaatctatctttctctctcttttgttttttttgtttggtttggttttttttttgtttggttgttttgttttgttttgttttgttttgttttgttttgagatggagtctcgctctgtctcccaggctggagtgcagtgggtgcgatcttggctcactgcagtctccacctcccaagttcaagtggttctcctgcctcagcctcccaagtagctgggactacaggtgcatgccaccacacatggctaatttttgtatttttagtagagacggggtttcgccatgttggccaggctggtctcaaactcctgacctcaggtgatctgcctgtctcggcctcccaaagtgctgggattacaggtgtgagccaccacgcctggcccaaatctatatctctatcccagcattgaatcttttgtgtgaggggcccttctagacaccttcacatgggtcgttttttagtatttcacatacagaatgctctaagataaatgaattcaaatattttattctttcctgctgttgttttataataagtactactatgcccctagtaacctaagagtaacactatatggcattatytttgtttttttccctctaacctctaccttctctctggtcagttgtgaagcccaaatattcttcctctgcaattactttcacagccctcttcctcatttttactaggtgtattattctgaacaagtatgcttgccaccctaagtttcatttataaagatttagattttttaaatgagataataataagtgacagttgagtgagcatcccgtcccaaagtcctcatttaaaaatttttgggcgggggggccgggcttcgtggctcatgcctgtaatcctggcactttgggaggccgaggcgggcagatcacctgaggtcaggagttcgaaaccagcctggccaacatggcgaaaccccatctctactaaaaatagaaaaattagccaggtgtggtggtgtgtgcctgtaatctcagctacttgggaagctgaggcaggagaatcgcttgaacttgagaggcagaggttgcaatgagcgagatcgtgccactgcattccagcctggcaacagagtgagactctgcctcaaaaaaataaataaataagtaagtaaataaataaataaataaataaataaataaataaaatgaaatagaataaaacggtttttttttgctgggcatggtggctcatgctgtaagcccagttgggaggcttaggcaggtgcatcacttaagctcagacaacatggtaaaaccccatctctactaaaaatacaaaaattagctgggcatggtggtgcacacctgtcatcccagctacttgggaggctgaggcaggagaatcacttaaacctgggaggtggaggttgcagtgaaccgagatcgtgtcactgcaccccagcctgggtgacaatgtgagaccctgtctggaaaaaaaaaaaaattaacaacaacaacaaaaaaatttggagacaggatctcactctgtcgccaggctagagtgcaatgacacaattacagctcattgtaaccttgaactcctgggctgaacgattttctcagctcaacctcccaagtagctaggactacagatgcacatgcctggccaattttttaactttttgtagagacgagtgtcttgcaatgttgcttcggctagtcttgaactcctggcctcaagggatacccctgcctcagcttctcaaagtattggaattacaggtgtgagccattgagcccagccagaatttgcttctttagagtcctgccttcagctctctacttagaaatatttgtctttgccatctctgtatatctgaaatcctaatgagtaaatgtgattccctccataaagccttctctgatacctcytgccttccttcttcccacccttctgtcaggtcttttctaacttgcaaagccccatgattttgtcatcaccatggttttggtgaccattagtctaaaaagagggattaatacactgtcttttggaaagtctacaggcaggaaagggcttacaggggtcatgagagttcctgcagagtgtgtggaaagttttctcatgggttcacgagtayatgagagctcaaatagcatcaaaatccttagtatcccacttaaagcaaacttcgtgtcatgctatgttgctttatgagccactccgtagccatgtttataataataaaagtaccaaaggatggcagtgactgatgcccaacaggtacagactaatactgtggagtttctacttgctactaaataatgcttgtaaaatctaaagatcctaagatgaaaggcattgtgtagatttaaaatgagcaagatccaaccagtcctctgtatcctcttctactcagaattagtcttccaagagagagcacccatcaaggtgggtgataaggcatcatagaatctagggaagtgtgaatctggggtctccagattgtcccagagggctggcattttaggtctggagcagacaagggcaggatgccaggtccaaaacttggaaagggagctatgttagggtgtgaggagactccacccggctgtctttcattaggaagactgcaggaaggagctggaagggccaggatttttctttcttctaagttcactgaaggaaaatctaacaccaaattctgtacttgggaatttcaaaatgagtagagaattctttgaactctgtaatcaattaaccggaaactcatttgaaatttggcttcagtgcatatgtttgtggttacaggggtgggggaaatatctgaagagggtctctggagctccctgtatttctcttttaaaaagtttatacacagcatgtgaaatgaacagatgcttttttttttttgtagctatcagggcaacaagaggtggaaagctgtatcaggtatttatttcagtccctgmgatggctattggcagagtttcacatacctaaactaaggagaaactcatgaacagataaaaattaagacatggaggagaacttgtgcttcctctcttgatttatttctaaacacatactgatgattttttaaaaagagcaaagcactcagaaagtattctttggctttgggttctggggtttttttggaggtgcggtgggaggattagattactatatgtaatttctctttaggttgtatttaaatttgttttcctaacaccctaattagagagagtgtgactgcagataataagtaattcraatctgaatttcatagtcgtaggaatgctccatttatttatttatatggatcactgatgagagtagtaagaatattggtagatagacatgggagggaattatttaagaaaagtctggattggttgatacctgacttggtgaggaaacagtaaaggaatttctgttcatgaagtttgtgattccacatcaagataattctttatggctgggaacagtagctacgcctgtaatcccagcactttgggaggctgaggtgagtggatcacctgaggtcaggtcaccagcctggccaacaaggggtgaaacccatctctactaaaaatacaaaaaattaactgggtgcggtggcgcatgcctgtaatcccagctattggggaggytgaggcaggagaatcgcttgaacccaggaggcaaagattgcagtgagccaagattgcgccactgcactccagtctaggcgacagagtgagacagagtctcactcaaaaaaaaaaaaaaaaaaaaaaacattctttataatagaataaccacccatgtttcatccagagccagaattcctcagattcttccaaccagaggggccctggcatgctaaacagtctgttatgatatctgaacacttaagtgaatgtatttggccagggatatttgctagtaaaattgatctttccttccctgagtttttccagttgtgctgaataattaaaggaaaattaaaacctggattccctaaactgttaagtatcaratctgtaagctgtcagtccttaggattacagtgtatcagagttagaaaggactttaaaattcatctgaacaaactgcagaagatttgtaaatctgttttcccaaatctctgccaagtgattgcttgaatttctgctcaaacacctccagggtcaggaaagtcaccagtttaggggacactctattctttgaatagctgtgagaagctctttgttggttttaaatctcacatcttagtgtgccagcttaaggagatacccagaacaagtttccttcctcccacgtctcagcccttcagatacttcatgctaattacatctcctagaactttctmtaggtcagacattattgggtcttgcactgtttgttcttcataggacagggtttmtagtgtcttggcagtatacgaccaagaggacacaggattctggggcagtgcctttaaaagttttagaactaaaaaatattaaaactagaaagggtgtcaagacacaacctagtcggcctccccacccctttcagtttacagatgggcagagtcttttggatttgagtgggtagaattgatcagcagccgttgttgaagtgagaaatgaagtgtaaagcattttaccagagaaaggtcttttagttgcctaattccgattacaggcttcagcgcacttctcatttttgccaaggaccagtctgattccctaagtaagcctaaggctcagctcaaggtttcagtgccagatcttcatacaccaggtgttggtttcacttactgtttgtgtaaaggatagaaataacttttccataagttttgcggtatatattgaccacatggtccgacagagattccgaattttaatagatgtttttttccttcataaaatcagagaatggccatcacaaatagaacagagtattggacccgttcagagatgcagctgcctctggtggacagtttcctgggttgccctttgtactttctttgtttaacagtcaccaggtgaccaagtggcttttctaaaagccaarggccgtggacgacgggattgtgagcgacttttctctagtgttttctatttgagatttgaaatacccatgcttttcatctggtccaaggaggctcaggtttccttggctgtgcgcaactataaaggacccaggtgtttggtcgtagggctcagctgttggcatccccacctcccccaacaccccattttcttccgtcattgataccactcaggtctgtgagcagagaaatcctggtgggagaattgaccaggacttgatatacttgagaagggggagagggaaggtagaatgtgcctagagttatccaataactttggtctctgagcgtgaccgaattcctttgggacaccgggaaagtgccgggtttaaggctggagtgttcttcggtccggcaaggggcgcgctaaaggtgacactggaaggagcagggacagcctttggcggcagagatggagccgagagcgatgcaggcggcctaccccagccggcgcgacctgccggcacacgggaactcgagtggccgtcgccagagccggctagctgggggagcgcgggcgccctttctggattcgttcgcctttgggctgggctcggagccgggccggttggagcgagacaggggcgggaggggccgggccagcgggaggagggcggggctttcctttgtcaggggatttgcgccgcgcagcccagactcgcgcgggttccgttcctctccttgcgccctctccgggggcggggcgttcccctctggccccggggcgcggtgggcgtgggctgcgggagccgaacggctggcgtcccgggtctctcgctccgaatcccgcagaagcccctccttcggcgcctcagcctccaatcctctccaccgctccctccactctcggagtcgctcctctccccggccccgcccccgccgggccccgcccycgccctcgycctcctycctgtgctctccgcgtcgcgcgctccctggcttycagggggctgcccgggcggggcggcgcascgcggcggcgcggggaarggggaggagagccgcccgccagccgagcacttycagcgagctagcgagctakcgggtcgcgctgcgcgggggaggaggactckccccccgcccgaccctagcggagccttttgttcccagccagaagtttgcatgccgggaccgtgacagctgcgggcggggaggacggcggggccgcggggccagcggcgtggtggagaatagaggcggctgcttgtcatgcagcccacggcgtggcggctgcgggccggggactggcggcggcgggcgaggcggcgcccacagcactcgggactcagctgccggagggacaaactaacttcctgagcgcgggacytgaggctggcgcggccgggagccacctgcagcctgcggtgaggcgaccctggccctcggggcgcgcggcatggcgcggggaagcgggccgtgctgagcgagcccctccgacagacccgcggccgctgctgctgcccgcccgcccgcctgcctttccgaaggcctggcgcggggctccgctcgccttgttttgcagctacagcgcagggttggcctgggagccacaacaatgccatgatgttttggagacaggaagccccaagctggccccgaatgaaggacttcctgtgtttaaagttgcaggaatatccgccgaccagcccagttcaaatgcaaacaccccagctagggaggacgaatggctaattcagaccagctggactctccagggctggaactgaggataaaatgaaaggaattcttaggagcttgggccatacttgaagactagagaggctgtgccattgttattaaaggatacaatcggcataaatttgctgctcccaactctgcttcggtgagaagtgagtggaactagatatcgaaaaagactcgtcaatatcagatgatttttgttgactgtatttgaaagagcagtgctcttaaaaaaaattaaaccataagccatacaaggaattattttaaattatatcgtctgtcaaccatgaggctgctagcctgtgaggaaaaagctgtttgtcttagagcttctcccagaatggtttcaaaacggaacttccaggcctttctggagggcagatgcaattggtggtttggggtatgaacagctaaaaggatttataacttatgtagaatgcatttggggggaacctgtgaaaaatacttttgaaagattgatggttcatcttgattgaaaaaggatgggtaagccactcagcagaccagactgtttaaggcggaaccccagctgcctggggaaaggagaggaggaggatggctacatagaggactgctatgttccacaacggtctatatatgatacgatgaggataaatgagcaaattgaccaggggtcaaagcttaaccagacttcaaaaagcaccatggaaaagatggaaggaagtactatatccagcaatggtacattaggagcagcatctaatgtttttgaatctagagcaccagaaggtaagaagctggatgagaggataatatttgatgcactaaagctaagcagtgatgtgcagaagtcagcacctgtgccacccagaaggcggccaaatgcagaacgcaaagacaatgttaacaggagatcgtggaagtccttcatgccacccaacttcccagaatttgcagagaggatagaagcttctctcagtgaggtttcagaagctggtgcttcaaatccttccttgcaagagaagaaggagtccagttctgcattaacagaaagttctggtcatttggaccacagggaacctcagtcagagtcagtaactctggaacatgtgtccaaatccataggtattccagaggtgcaagattttaaaaacttaagtggagactgccaggactttagatttcagcagcacagtgcaaaccctcctcatgaattccagcctgtagaatcagaagctgtagcaacaagtggtaacacagatgtaatgcaggaatccagattctcaagtgcaacctggccgagggccacaaaaagtttagctaagggaggcttcagtgagaagcagcacccccttggggacacagcctgcactgtggaaatgccacctctctccccttgcctgagtgaagagctgttagatccagaattgcatgttctcataacccccagcctgagagagaaaacagagtctgagctaaagtttgaggaggatgagcgatggattatgatggaggctgagggagagtgggaggaagagaaactgtcagacagggaaaagacttttctgatggcagatgagaagaacagcctggcagatatttttgaagaaagagaacaagcaaacacagcagtggtggaggatggatccgattgcttagctgctgtcttgaggacttttggccacctatctcttggtcagatttgttgccctgatgacccacagccagccaaggaccagttggctactgttcccaaggatatacccctggattgcgattgtgttcttacaggtgaggatattctcggtgaggtggcaaacagaactgctcaggggttagagggacttgtttcagattcagcatgtactgtgggtactattgatgcagaacagctctctgacacagactcagtgcagatgtttcttgaacttgaaaaggagtgtttatgtgaagaaggagtaactcctctagttgagctacagaatcaaatctcttctgaagggctggctgcatcccaggatgcagaaaatttactcgtaattagtcatttttcaggggctgccttagaaaaggaacagcatttaggccttttacatgtaagggcaaaagattatgatactagattggattgtggatattttaataccctggattcttctcaggtgcctaatgctgtggaacttattgcccacgttgatatcatgagagacacttccactgttagcaaggaggaatgtgaaaaagtgccttttagccccaggactgcagaatttaagtccagacagccagctgatctggattcactggaaaagctggacccaggaggactgctgaactctgatcacagggtttctcatgaagaaaaattatcaggcttcattgcttctgagctggccaaagacaatggcagtttgtcccagggagactgcagtcaaactgaggggaatggtgaggagtgcattgagagggtcaccttcagttttgcttttaatcatgaactaacagatgttacctcaggacctgaagtagaggtgttatatgaatcaaatttactaacagatgaaattcatttggaaagtgggaatgtaactgttaatcaagaaaataacagtctgacatcaatgggaaatgtggtcacttgtgaattgtctgtggagaaagtttgtgatgaggatggtgaggcaaaagagctggattatcaagccacacttttggaggatcaagctccagcacatttccacagaaacttcccagarcaggtcttccaggatctccagaggaagtccccagagtcagagattctgagtctgcacctgctggttgaagaactgagacttaatccagatggagtggaaactgtgaatgatacaaagcctgagctgaatgtggcatcatcagagggaggggagatggaaaggagagattcagattcattcctaaatatttttccagagaaacaagttaccaaggctggtaatactgaaccagttttagaggaatggatacccgtcctccagagaccttcccggactgctgcagtacccactgtcaaagatgccctakatgctgcactgcccagcccagaggagggtacctcaattgctgcagtgcctgccccagagggaactgctgtagttgctgctttagtgccctttccacatgaggacatcctagttgcttcaatagtctccttagaggaggaggatgtcacagctgctgcagtatcagccccagagagggctactgtcccagctgttacagtatctgtccctgaagggactgctgcagttgctgcagtgtcctccccagaggagactgctccagctgttgcagcagccatcacacaggagggtatgtcagctgtcgcagggttctccccagagtgggctgctttagctrttacagtacccatcacagaggaggatggtacaccagaagggcctgtcaccccagctaccacagtgcatgctccagaggagcctgatactgcagctgtcagagtgtccaccccagaggagcccgcctccccagctgctgcagtgcccaccccagaggagcccrcctccccagctgctgcagtgcccaccccagaggagcccacctccccagctgctgcagtgcccmccccagaggagcccacctccccagctgctgcagtgcccmccccagaggagcccrcctccccagctgctgcagtgyccaccccagaggagcccacctccccagctsctgcagtgcccaccccagaggagcccacctccccagctgctgcagtgcccaccccagaggagcccacctccscagctgytgcagtgcccaccccmgaggagcccrcctccccagctgctgcagtgcccaccccagaggagcccgcctycccagctgctgcagtgcccacccyrgaggarcccgcctccccagctgctgcagtgcccaccccagaggagccygcctycccagctsctgcagtgcccaccccagaggaatccgcctccgcagctgttgcagtgcccacccccgaggaatctgcctccccagctgctgcagtgcccaccccagcagaatctgcctcctttgcagctgtggtggccaccctggagraacccacttccccggcagcttcagtgcccacccctgcagctatggtggccaccctagaggaattcacttccccggcagcttcagtgcccacctctgaggagcctgcctccctagcagctgcagtgtccaacccagaggagcccacctccccagcagcagcagtgcccaccctagaggaacccacctcctcagcagctgcagtgctcaccccagaggaactcagttccccagcagcttcagtgcccacccccgaggagcctgcctccccagcagctgcagtgtccaacctagaggagcccgcctccccagcagcagcagtgcccaccccagaggtggctgccatccctgctgcttcagtgcccaccccagaggtgcctgccatcccagctgctgcagtgcctcctatggaggaagtttcccccattggtgtgcccttcctgggagtttctgcccacactgactcagtgcctatttcagaagaaggaacacctgttctagaggaggcttcctccactggaatgtggatcaaggaggaccttgattccctagtatttggcataaaagaggtgaccagcacagtgctacatgggaaagtgcctctggctgcaaccgctggattaaattcagatgaggtaattgtccattttgattctgggaagggtctaaagagtaaagtgagatttgcagggctgacctggtggtgatgagaaatggcacagatagttcttttgttctttttgggtctcccgggcttatrgtttgtagtctttctgttcagtttttggggaaaatatactttaaktttgtctggtgaaagactttataatttcatgcttcgttttttattcagataagccaatcccacggaaaacagggatataaacagttgttgatttacatttttaaaaagattattagcaggaaagggtcattctgtttttgaattatacagtgagcatgttcttgcctaaaccaagagacagtttattcattggtggtgtcaacatttaggtagaggccagagtgtgagctttggaatgagacctggggtgcttcctaaccactctgggaaaattagttagctattcttgagtttcctgtttcttcatttgttaaggcataactctgtgaggataaaatgagatacatttaaggtaccaagcgtataagattaccaatcactggccatatcctccccattcttttcaaataggtatgttggttggttgaaagaatttaccaaagtarattggagagaagcaataaagctaaatgattaagaacttttaaatgcaaatatrtgtttctgaaaaccagagctaggcataatgtttatgaaaaatagagatattttagtcatctttgtcaaactgcctttgtgtccttaagcaagtcattttcctttccaggacctcatttcttcattataaaacaagaaaattgggctaaatgtcctcttgggtctctcttggctctaagattctttttattttttttttttagatggagtctggctctgtcastcaggctggagtgctagagtgcagtggtgcgatctcagctcactgcaagctccacctcccgggttcacgccattctcctgcctcagcctcccgagtagctgggactacaggcgcccgccactacgcccggcaattttttgtatatatatatatataattttttttttttttttttagtagagacgggtttcactgtgttagccaggatggtctcaatctcctgacctcatgatctgcccgcctcggcctcccagagtgctgggattacaggcgtgagccaccgcgcccagccggctctaagattcttaatgttagagaaccgaatgtgttaggaaacagttggaaacgatgttccacatccttgagcactcctagtccaaggaatttgagatcagcagctttccacagttaattacccaggtttgatttggtcagtggtaaagagtgcaggagttagaggtttaatctgaacacaagagatgactgagtgagaagattgttttgattttactgcgcccctaggactcaaaatagtgccttcttcatagcaggcatttgctgttgactgactgactgaatgcatgaatatcaatttcctagactatggatggatgctacaagaaagatgggttttctcattcacctcactgcagagcctttcagggcagccttaagtcagctagagcaccagctaaacatgcaggtcctgacaacaaaatcattttgattgcatgccataaactctttgattaagaggattgattaagataatctggccttgctgagtggtggtggttttaccttgagctttaccagttattttgtcaggtagcattccattaaattaggatgcatcatctttgagactgatggatttttgattcatttttccgagttttattgaatttggaatgacaccgagatcccaatagcctgtacaaagtgaagacagtaggtcaasaacagagccattcttgataatacagaatatttcacaccaggcacagtggctcacacctctaatcccaacatttgggaagccaagggaagaggattgcttgaggccaggagttcgagaacagcctargcaacatagtaagaccccatctctgagaaaataaaaagaaaaaaaaaaamacagaatatctccagtataaagcttayatagcagtaatcatgaaatataaggattaaatttatagtgaggcaatcaaatctgcataaaggggaaaaagtcatagaaatcctgtatcagtctctggaatccttgtttcctcatctgcaaaatgagtagatggctacataatctctaactatccttccagctacaggaggtaatccttttatgaaatattgcctgatgtaaatgacaggagaaggaaatggtagcccagctgcaaagttgtccatctttgaagtgtggttactttgtggaatatctggaagtgagcaaatgcctatatctgtgtacaggaaaggatagatctgagcctcagccaggactgttaaccagcaagaatgtagagaggccattttgaaaatattgaaacaaaacaaatcattatagagttaacatgagtatacaggtttgctaaattggtgaaatattattttaaaaggtttttccaagatgagaggttaattttttatttcttccattcccttaggattccaagaggcaactgaacctgccatttttatatataaatacttagaactcaacaagtgatttagcatgaactgaggtcctctatgtctgtatgtatatgtgcaagtgcagacatggatacatggttaaaatagatataaactttgtaattgcaataacaacagagtttggtagaactaaaatgccaaaaactcgtttgctttttctgtaatgggatctgaggcctactgagaccaatctctggttatgtaaattccctgcttatttatagacctcttcagtyttaatcccagccactggttcaaaggaagaaaaaaaccttttgtataaaataagggttytataagattacaatttgccaagggagtctttttaagcaaaaattggagagcaccacaattccagttcagtgtttgaacgctytgctgatcggcagaatcttcattggttttttgcattccctaacaccgtttgtgtacaaggattcattcattcatggaacaaaaaaaagtttttktttttttttttagacagagtctcactctgttgcccaggctggagtacagtggcacaatcttggctcactgcagcctytacctcccgggttcaagcaattytcctgccccagcctccgaagtagttgggattacaggaatgtgccmccacacccagttaatttttttttttttttttttttttttttttttgkatttttagtagagacagggtttcactgtgttggccaggctggtctcgaactcctgacctcaggtgatccgcctgcctcggcgtcccaaagtgctgggattacaggcatgagccaccacacccggcctgagtaaatattatgagtacctactctgtgccaggtactaggctcctgcagtaaatagaattgacatggtccttggccttgtggaacttatactgagtggaggaggcagatattaagaaaaccacacataaataaatataaaataaatacatagttagaaattttggcaaattctttgaataaaatgatgtcaatggatttgaagacaatagggtggattgaagatatattttggaggtaaaatcaacaagatctgattgtggcttctgtgttggggctgagggagttatcaagggtgacttttaggttctggtttgtacagtggagtggatagtataaattattgatttaaggaagaggtaagggaaagtgggagacactgtttcatttttgaactgttaggcttgggatgcctgtggttcatttttttgcatggagatattaaaaaagcagttggatacgtagctttgaaactcagagagacaaattgagagtcataagcatttattgtggttagtatttaaacccacagaaattgatggaattgcctaggaagaatatagaaagagaagagagtccaggactgacgtcgttctctcactcccacccccaaagatcatttagagatctagaagaggagaaagaaaacaaaggacaacagaaaagaatcagtcaggataaaactggaaaaatgcaataacaaggctggatgccgtggctcatgcctgtaatcctagcactttggaaggctcaggcaggcagatcacttgaggtcaggagttcaagaccagcctggccaacatggtgaaaccctgtctctaccaaaaaatacaaaattagctgggtgtggtggcgcatgcctgtagtccccgttacttgagagrctgaggtgagagaatcacttgaacctgggaggcagaggttgcagtgagctgagattatgtcactgcactccagcctgggcaacagtgtgagaccctgtctcaaaaaaaaaaaaatgcagtaacaaagataaaagtgttttaaggagttctttgggaaattttctattttgtgtcctagttgcatcttacaaccttgcaacaatttttactagtgtacttctttggaaaatgtctgccagtactgcttagttaataacatgacacagtcctatttcactaacagtgtgtgaaatactaaggagtaggaattttagtgtatctaaaagcactggttttgcaaaacagctttatttgggagttgacagaaggaagcaggtgttttcaaatgtacgttctttaacgttctgttcacttttattcaaaatagataatatttagaggtgctttcatatatgttttaacttatgagaaatgatacaaatacccattgtccctgtcaatccatagagtgaaggtgagaaatgaaggaatagctaatgcttctataggaaatgtttgtaaacaaagtaaatccaaaagtttaaagttgcagtagctcttattatagattgaacatccaaaatgcaaaatgctcccaagtctgaaactttctgaatgctggcatgatgctcaaaagaaatgctcattggagcatttcagatttcagattttcagatttgggatgctcaaccggtaagtatttaatgtagatattccaaaattttaataaatctgaaatcagaaacacttctgttcccaagcattttggataagggatattcagcttgtatatgaaagagattattgaactatttaaatataattttacttttctttctttctttttttgagatggagtttctctcttgttgcccaggctggagtgcagtggcatgatctcggctcactgaaacctccacctcccgggttcaagcaattcttgtgcctcagcctcccaagtagctgggactacaggcgtgcgccaccatgcctggctagtgtgtgtgtgtgtgtgtgtgtgtgtgtgtgtgtgtgtgtgtgtatttttagtagagacgaggtttcgcctgttgcccaggctggtctcaaactcctgagctctggcaatctgtctgccttggcctcccaaagtgccaggattacaggcatgagccacttgcctagcctattttacttttctgtgtcatttaaagtgctgtccagtaggacttgctgccaagatggatttgttctctatcaatagtccagtagagtamccactggccatatgtggctttgactatgtgaaacgtggctagtgggtctgaggaactggattttaaatttaatttaaatgtcaatagctatatgtagctgctggctgtcatgttggaaagcacagaaagaatttaaatgtcagttgtagagtgagataggatttggttattgagtaaaagagggccctgtaatgtggacttgacatcttccctccataccttggctttctgccttctttgccttttcawtccttcaccttcaccaccaccattttattgtaccaaaagcagctttaaacttgggatgtttttcctgcctctatctgatttttcttcagcagaaacatctttaatgctacaaaatggaattatagcagttgttttttctgggaaccatgttgttggagaaatagtcattttaactgaactgctttgtaatgttgcctaagaaaatatggtataatcaaattatagtaaaaaaatgaagtgcactcataattacttttataaccttcctttttcagtgttccctggggctttccctccctggtaatcttagccagccatagaccattctttctagaatcagtttcctaatcctagtgtggtctgtagtctcatattgaccaaaattggtcttactcaaacttatcattttcttttatatttatttttgtcctcttccattttctgtcatcctctggccttaattgactcacctggctcatggaagaaaaaggaagggaaataaatccaggctagtgaaatatagctggttctatccctctgataactgagagaaacccaatttttttttttttttttttgagatggagtcttgctctgttgcccaggctggagtgcagtggctcagtctcggctcactgcaagctctacctcccgggttcactccattctcctgcctcagcctcccgagtagctgggactacaggtgcccgccaccatgcccgtctaattttttgtatttttagtagagacagggtttcaccatgttagtcaggatggtctcaatctcctgacctcrtgatttgcccgcctcggcctcccaaagtgctgggattacaggcgtgagccacygtgcccggccacttcatactcttaatgtggcagaagtaccattctcttctgacccttttttccttttagacatgtctaaatcgtaatggagcttaactgtagtagagcaaaatrtacacgttgcttgttacacctattcacattgttttaaaattctgttgcaccatggtaaacgtggataatacagtatcatttttgagcagttttttaaatgtaaatctgtatcttactcagagtgtgtgtctgaagttattaaggacatttcccaacgttactggcccatttccctttgtaatcagaggaattctgtttcaagattattgttgtgtgtgatctgtggctcttgatcagaatgaagttaaatggccacaggaggattaagctatgaggttggcatttttcacactgttaatatgttttgactaattgagttattagtcttagtcagagaagagcatttcttattagtggtcagttaaggctattccccaagggatattccatcttaaatactagtcatttggtattattctattcttctcttttaggattcatatacattgcgcttacttgtacagcatttcgaggttgatgcttttctattctccatggctttttgcattaaaaattaagcaacaggccgggcgcggtggctcacgcctgtaatcccagcgctttgggaggccgaggagggcggatcacgaggtcaggagatcgagaccatcctggctaacacggtgaaaccctgtctccactaaaaatgcaaaaaaattagctgggcatggtggcgggcgtctgtagtcccagctgctcagaagactgaggcaggagaatggcatgaaccygagaggcggagcttgcagtgagccgagatcacgccactgcactccagcctgggcgacagagcgagactctgtctccaaaaaaaacaaaaaaaaattaagcaacagattttaaaaaaaagaacaaaggaaagagtcattgggttaaagacctaagtagtgtcataactctctgtaattacatgtccataggagaatgtattgaaatacaaaaccacatgttttcttgatgcttcacgtgcaaatgcttgttctttctttttattcctggtcgtctttcattaagtcataaatgccccaagaataaccagtctctgygtggtatagagagtctaatagcctttgtattaaatcttctttggcttgtaattatctagatgtttcagaaagaacaagtggatcctcttcagatgaaattgcagcaggtgaatggacttggccagggattaattcagagtgcaggaaaagactgtgatgtacagggtttagaacatgacatggaagagatcaatgctcgatggaatacattgaataaaaaggtgagtgacaatggggtagcaagtgtactggaaacggaaggcatagaaaagagacatctgaatctaaggtttcccgaaacctgaatggaaataaaaatttagcagttgcaatctataattactaaaagaggtcagtagtaatttgaaaactactttctcygttctcataatgaacctacatgttcatgatacaggtcgcacaaagaattgcacagctacaggaagctttgttgcattgtgggaagtttcaagatgccttggagccattgctcagctggttggcagataccgaggagctcatagccaatcagaaacctccatctgctgagtataaagtggtgaaagcacagatccaagaacagaaggtaagtgagaatgttgggacagtgaactgtaacagccgtagggagtagtagacaacacatttgcttatagtttaagaagcagttcaggagttttagtagaatcctaaactactttgtgtcgtcctgaaaagaaaggtggaaattgattttcattatcttacttaaatctggtttactgtggcatatattagactgaataattttacctgttcatgtatcctatttcagtgttcatctacaattttgtgttaagaggtttttggtgttttcagggtcagcaatattctaaatagtgttgtatatcatgtacaaagttttatctatattttttgttggtttaatttctattttagtgcagttttttctttttaaaaaaaatttatcccaaaggaaattttatttttttctcagctttattggtatatagttgacaaataaaaattgtatatgtttggctgggtgtggtggttcacgcctgtaatcccagcactttgggaggccgaggcaggcggatcacaaggtcaggagatcgagaccatcctggctaacacggtgaaaccccatctctactaaaaatacaaaaaattagccgggcatggtggtgggcgcctgtagtcccagctactcgggaggctgaggcagaagaatggtgtgaacctgggaggcggagcttgcagtgagccgagatcgagccagtgcactccagcctgggagacagagcgagactctgtctcaaaaaaaaaaaaaaaaaatgtttataatatacaatgtgatggtttgatatacatatacgttgtgaaatgtttaccgtagtcaagataattaacatattcatcacttcaaatgttaaccattttttacggcacttttctcttggttcaaaggaagttccctgttagtcacataatgacagtcactgctccatttaaaaatttaagtgtgtgaaaagtatacgagtggtgagaactgtgctatatctcctgtttttgccccaaggatgaaaaaaacttcttttactcaatgaagcttaggatttggcgggttggtttcttttgttttttttctttcttcctagttcagatttcaaaatgatcctgtgttacaryttttcattctctttataatagttgctccagcggctcctagatgatcgaaaggccacagtagacatgcttcaagcagaaggaggcagaatagcccagtcagcagagctggctgatagagagaaaatcactggacagctggagagtcttgaaagtagatggactgaactactcagtaaggcagcagccaggtaagatcaaaggaattttgaggagtgggtcagaggtttgttttgttcttcttcgacttattatcactataagttcttggatgattcatatagatttttggaaggtgtttaatggcttttatttgaaatgggataagattttagagatgatcctcataatcagaatcacactcaggaaatggtctccagcatcttcataaatttccgagagctggaaaactcattgctctgtgtggttgttctgctgtagtataatcatagttccaaatgacagacacagactcctacagtccagccgagttattttctgagtttttcaaacagatttccccctcttatatttataaataatgcttttgatacttggaattgaaatgtgtcatatttcttttctattagcttatagtaatattagatttttttgcctttaggagctagtctgtggttctgttaaatatctgggaattcaagagatgcatgaacttacctcaataaatggtcaaaaagacaggcaacaaatcctccttcaaggaaatattccctttctcttttcatagctataagttatcctgtgacttgagcttaataagtcacatagatgtctttacttttatacagtcctcagttttaaaattaaataccagctaatgagaaatcaataagagagctgatcatttgttattgtatcctttacatttcctaggtagcctatggcagtcttcaaataattccctcttcagtctttttatgtccacctgcccatgacttggcttattccttacctgagttgcaaagtatggcttgcctatgttagtggaagaaacaaaatggaaagaatttaacttacttgtatttccagatttgtactgcttattttcttttctctctgtccatttccagtaatggtaccattagctttccagtttcctaggcttaaaacctcgactccatttttacttttctttttttaatttctcctttgtgcccacatcgatcagcatgctaaattctgtctattttactttacagtgtctttcctgtccatctgtttctctaattcccactctcccctcagttcatgacttacgagctctcactaggtgtatagagatagcttcttcactaatcactctaccactaaccctggggccttccccttcccatcccccagctgcagatgaacctttctgaaataagcctttaatcatatcttttcaagctcagagatatttaattgactccctgttagaataaaacctttagattatgaggctgacacactgcctgccgtgctaagaaggtgcttaaaataaaatataaactctttaacacaccattcaaagccctctatttgaccctaacctacctttcttagcttctactattcttctcactccttaatattatagctgaagtaaactatattctgttctttaatatcttctgacaatgtcctaaccctgtgtcttattttatgggttataatacatctttcatgaaatgcttttgtccagctctctctcttctataaaacttacctttattcctcaatcatggaataatttttcctgcctcttcactgccataactctttatctgtaccttgtattatgatcattattttatgtacttaccttcctggtccataaactccttaaagtcatggtttgtttatctaatgcatatttttatgactctttccttctactttacttgtttccatcctcctagcctaatatagtttctgggccaatattttaaatagaaacaaataacaagagtagatatttgatgcttctaaattatttttagctcttctccctaaaaatacctttaatcttattacaataaattcttcaaattttcagattccaaaatcaaatgagtaagaaagacataaaaattagaggcartttttaaaaaatgaaattcaaatttaataataatttttaatattgtatgttttagttgcattacttgaagatatattttgaaggctggcataaacaaactaggaaagaaagttttagacttagattgccacttaaaaaatatgtttttctttatattcaaacataattgaatttccagtaatcaaaatgccaactttttttatttaaaccacttcttattaaaataactttgtcagggcataactagcataggacctggcgtaaattaggtcttcagtaaaggtttgctgaacttaagtgcatcatatactcccaggcctcttcaaatgccatatcttagtctgtttttagtaattcaaagacaacattatgacctttcattattaatctgcatgctaatacagttctgtggttgttttcttgtctgttccttgtcaggctatctccaatatccagacttcctcctcactttgtaatttgctgcttttattttatagagtaaaacaaaccacaggtactttggaaagtacatctcttagcacttctctggtctcagtgacagtcatgtatcccaggaaaagccaagcttagttatggatcttatattaaataagagttaagattccaagtgagctataaagtctgtagttttttttgtttggtttttttttgggggrggtgctttttgtgttggcaaattcagccagcgtgaggttttttgtttgtttcttttttgtttttttgccttaaatctggattcaaagttatgttctggggcttgaaattaccagaagcctgactggattttggggagttggggagggagttctagttcataggcaatatacagtctttactcttcagatatcttcactcataaatgaaggtagtagtgacagagagaatgaaaacagacaactttttgcctcctttaaaccttattttggtcagatgttcaggtgatatatatactacattctgttttgatttgtgtyaaataaggagaacattagaagatttgattctactgttgctactcaccaggtgattggacaaatctttctttaagccttctgactgaactttctcttttataatagggggataattattcttttataatgggggataattattctgtccaccttacaaggttatgacagaatgagaataaggttaatggtgtgaaatcctttaaaacatcgaaatgctacataacgtgtgttctgtttactattggtatttaaactatacctggaaaagactattcttttactgagtatagtactattaccagttttaatgtgacttttyttcctgagcagcttgttctatatatttgtgtaggcaaaaacagctggaagacatcctggttctggccaaacagttccatgagacagctgagcctatttctgacttcttatctgtcacagagaaaaagctkgctaactcagaacctgttggcactcagactgccaaaatacagcagcagatcattcggcacaaggtagggagtggttacagtaaatgaaaatagaaaactggaattagaaatcctagaaatgagtaaactgcctgcagcattctagaggatgtgtgttttgtgggtttaacttaaaatatggtcagattattaattggaaaagtcacattcttgaaatacaaatagaaattgactgataggctaccaccggaataaacagcttttgttcccaatttttatattatttttgcctttcagtcggtgagttttttaattgtttaatttgttgtatcatttgttattcatcattttgtgtttacttttcatttattttgtttctgttattcattttttccatctggatttccaggctctggaagaagacatagaaaaccatgcaacagatgtgcaccaggcagtcaaaattgggcagtccctctcctccctgacatctcctgcagaacagggtgtgctgtcagaaaagatagactcattgcaggcccgatacagtgaaattcaagaccgctgttgtcggaaggcagccctacttgaccaagctctgtctaatgctaggctgtttggggaggatgaggtggaggtgctcaactggctggctgaggttgaggacaagctcagttcagtgttcgtaaaggatttcaaacaggatgtcctgcacaggcagcatgctgaccacctggtattcatgtttccatttttattggttatgttattctgttattttgttattttgattcatgtttctcttcatttatttttttttcttcattacaaacacttcaactttattttatacacaagtgcatagttagtggacttgatgctgactgctaatctgtttttggatgagtccatggaaatacttatatttaacaagttaaatcagtaattctagaagatggtacagggtatatagtcaggggccatctgaactccaactcatgatttacattattaggtgatgggtcactaagattctatttgagcagttttatgaaagataatgtgctttaacaaaaccagatctatctgtgtagtgcccaggatttgatcatacagttaaaaaacttttaggatatttctggatttgttcaaattccggggattctgtgtcatcttaatagaagagtttgcctttttcatttcatttttatgaaatctgtttgggagagtaaaaataggtaatttttctaatagtctgattcttttgcttcgtcaactttaaatatgaagagagtttttaaccaggattctgatttaagtcagtctgttcttactgaatttcttctcttgaactttctgtttattccttattttggacacagtagacaattttgctcaatttcacttctgcctttcttgggttcaggtttggtaccaataattggtaaagctgatgtaattctaagtttttctcatccagcgcataggaaagcttgcctataggtatctgatttaattattttgaatagtcaatgggctaaccaaggagaagatgaggggatcaaatatctgatrtttaaattaaacyagtattcatctctttactttaaatttgrtctcttaaaggtctcgcattttgtttcatttgtagtgccacagtttcaggattaatggtattctttcctttcaggctttaaatgaagaaattgttaatagaaagaagaatgtagatcaagctattaaaaatggtcaggctcttctaaaacaaaccacaggtactttgaaaagtgtgtctcttagcacccctatggtctcaaagacaattatgtacccaaggaaaggagttccctgccttagcctcttctttatgtatatatgagaagcttagtattcactgattgtattccctactgtgctccagaaggttgtttcctgctaaatcttttgaaaactaagttatctcacatctggttatagatgatgatttctcctctccttcagtatcttgaatgccaacatgcactgaaaggtgctggaaacatctagaaacacttgacrctgaactcagattttaataattcagaagtggcttcttttatccagtggaaagtttattttatttcccatttgcccttagtatgggataggtgaaatcattaccacagmgagagagagagcgtctatgaaattaaagctctgatttgaagaaaggggatcagagactcctcattcctagrtctcttaaatatgagtaattgtgtgctatcttccataggtgaggaggtgttacttatccaggaaaaactagatggtataaagactcgttacgcagacatcacagttactagctccaaggccctcagaactttagagcaagcccggcagctggccaccaagttccagtctacttatgaggaactgaccgggtggctgagggaggtggaggaggagctggcaaccagtggaggacagtctcccacaggggaacagataccccagtttcagcagagacagaaggtgagctgttactttaccataaaaagaaaaaaaggcttcctctttgtcagaatccttaagttttatcaacctttaccttaaatataaactaaaaatatgtgccccctttcttgtttactcatggacagtaagatttgacataaagacatatacgttacacatatgttatgaagaagaaagaagttgaatcaagtttactttgtaacattttaacctctattatttattctctaaagagtgcttcatggttttatttgatttctctgcaggatctagtatagttctagatgcatagaaatattgtataggtacttgttaggttaaatactgagcctttggttaaagcattatttatcatttctgttgaagtaaggagatgaaagaagtattagttgttttacccagagacaatgtggctcaaaaagtcttacaggcagttctaagcaagcaacaatgaagtctaaagtcaggcttcagaatgattgaaaaatctgagatgagaaaaaaataactgaaggaaggaggtcagagtcctgctgggatgtgtggtagagatagcaatttccacccagcacagttgctgatgtgctttatttagcaaggtatggcctgaaaactcttttccctccttaggaattaaagaaggaggtcatggagcacaggctggtgttggacacagtgaatgaggtgagccgtgctstcttagagctggtgccctggagagccagagaagggctggataaacttgtgtccgatgctaacgagcagtacaaactagtcagtgacactattggacaaagggtggatgaaattgatgctgctattcagagatcacaacaggtaatgcttataatacctctgcattaatattttagacagtattgatgtgtgagatacagtactatgacccacataaatacagactcagaaataagaatgggctcaagctaaatctggtggaataaatatgtttcattgatgggaaatgattgggtagaagtttgtgaggatggatccagaatttgaccaaaatacttgacccctttgagtagagaagtacttggagaagagtctacatgaggccttttcttagctaatgccmtgctaagaaggctgatggtgatgggagtagataatatctagattcaaaaggtccaaatgcaccacaatcttagtttgacataattaactctcttagcattagatggaagagggggaaggaattactatcaaatatgcaaaccaaaatagcagagctatctaaaatagaaccttctcagtaaacacaggtgtcatatttcccttgatcttttttccttcctactttctggaaaaaaatcatttgttcttttgtgtagctggatacacacctcttaatgtgccgtagtacaaaaaataagttaatataactccttaggatcatagtgatgaacatatgctttttgaatcacacagaaatttgctctgagtccaggtatatccccagtgtgtctttagagttatcccttatcttggcyagatatttcaataygaaatgtattgtgcttgggagaagcgtatttttaaatgtaagtgtatattggccaagttgaagaggaagagataaaagactggagaggtcaggcataggagactgggctcacacctgtagtcccagcactttgggaggctaaggcaggagaatcccttgaggccaagagttcaagaccagcctgggcaacataacaagacacaatctctacagaaatatttaaaaattagccgatcatggtggcaattgcctgtgtagtcctagctattagagaggctgaggtgaaaggatcactcgcgcctaggagttagagcctgcagtgagctatgattgtgctactgcactccagcctgggcaacagaatcagaccctgtctctgagggggcagggaaggatggaggattggggagccctcatgaaactaacagtcacgtagaacatgttcttggttttcgttattacataaccatttaaaaatgtgttgttcttttggggtcttatgctgcttcagctaagcgggcacttccgagttaacttgactcatccgtctactgccatattaggtttatatttaaacatctgactaaacctactactgttccatgtctgggtaggaaagagcaatggcaggaagagtgtagtctcataaaaacactgattagaggcatctttcttttgaaggggattgatatctgttatttctagctgtagaaactgagttctgtaacttactttaaagaaattgaaatgtggtcagttttaacttgtttgcatcttgatttgtgattttatgaaattcttcccagttttgactctactttgtgagatataaactgtattactgaaaatccaggccttgctttgttgaataaattgcagttatgtggagacttggctgtatataatttgtttatttttctttaatacgtctattagtatgagcaagctgccgatgcagaactagcttgggttgctgaaacaaaacggaaactgatggctctgggtccaattcgcctggaacaggaccagaccacagctcagcttcaggtacagaaggtacgtgcccactctttcctgagctaatagaatcatcagtaacttagagtgactaggagagtttctgactatcccatgtcaagtggaataatttagtggcatgatggtaaatagaaattaattttctatgtatttggttgagatgaggaagaatttttttttttgctttgtgagaaaggaaaaataggcccattaatccataattagcaatttccttgatagaaatttttgtaagctactaaaaagataagctagagaagatgttggataggcaaagtgtcaaactgtataagaacaatttttgatgtggctttttcrtagattttgtcttaacctttagtaataacaggaaaagggtctttttacttcttaactacagtttacttttcaaaggctttctccattgacattattcgacacaaagattcaatggatgaactcttcagtcaccgtagtgaaatctttggcacatgtggggaggagcaaaaaactgtattacaggtgaattacatttatttatttgccatattgttcctgtttttatcatggtgaattagaagcacaattgtgaaatgatggkttaaggctttttccctcctggacttttcttatgattgttattaaagtccagcttgatgttctggggaattcagaatcttaaccctgtgtccacaaatgtttaaaacagccatcctatataatgtgaaatatattgcaaatccatcttctttataacaggggaattgctacttatcctcactccacagggagcaagctttgagttacttttcaaggtatttatggtagatttttttcagaaccatatgcagatattaattccttcattatakccttctaaaaggtcgtacctagttttaaaaggattggtcaagatggtttgtagacaagttttttcatttcgttttgttttgtttcataaaggatatgtttaagcacagtttcctcagaaatattcataaactgactgarctactcatcctaaacatttgaagcataaatggcaggtttctggagacttttttttaatcagaagaaaaatgacaggcaaaacttgataggcaaagattccatcgtagccccttagatgttcagttttaaactgatccattataatggtatattggccaggcacggtggctcacgcctgtaatcccagcacattgggaggccaaggtgggcagattacctgaggtcaggagttcgagaccagcctggccaacatggagaaaccctgtctctactaaaaatacaaaaattagctggatgtggcagtgggaacctgtaatcccagctacttgggaagctgaggcaggagaatcccttgaacccaggaggcggaggttacagtgagctgagatcgcgccagtgcactccagcctaggtgacagagtgagactctgtctcaaaaacatatataataataataatgctatatctaaggttgtgtatcattactgaaaggttaattttgctgtgtttttcttatactattttactgctttttaaacttttatcttttaaaaattatagaaataaaatatatgtatgataggaaaattagaaaatttcagataagtatgaagaagaaaataaaaatcacttgtaatctttactgatattttaaaataatttagttatgtattcttttagactttttaatgtatatatacctactttttttcttaagagtttataatagtaatacttatcctttttttttttttttttgctcacataggaaaagacagagtctctaatacagcaatatgaagccattagcctactcaattcagagcgttatgcccgcctagagcgggcccaggtcttagtaaaccagttttgggaaacttatgaagagctcagcccctggattgaggaaactygggcactaatagcacagttaccctctccagccattgatcatgagcagctcaggcagcaacaagaggaaatgagggtaaggagcatgccaagtttcattttattgttctaaaatggtctctataatttatttaaaaacaacatttgttagtgtctataggtgcaagttctgtgttacgaagttaattcttaatcagttagaattcctttcataatacataatctgaattatttccttggttgtttaatatcaattgattaaacactaagattatagagatgtcgagaaccttagaatgacagaactaaagaaagaactcactaaaaatcaatggaatttaaaatatttccggggataatagggtgttgttacactcaaggtatggttggacagtactttctacttagttaggcaccaactggagtgaaagccatgaggtaatgtcaaaaaacatttgctctgtatagttaatgacacttcaaaatgtttatttctggtttatggcttgtgcttattgctattcttataagtggaagtgtataaactggacgtagtcagcagtaaagtcaaggagtggttggattgccaaaaatgttgctattcatagcttatccagcttggtatctcagtctggggaggtagacaattattaaaccatgtagagtaaaatagagtacatagaagtacttatgattacagaagagtgtggagtagacttgtatgacacasctggtaggggaagagaagagaggatgtttccaggaaggctgctagggtgatgagacatcagaactgactttcaaaaattaaattgggtaatgtcagaacctaagacttaggtgtttttctgttcccacacaaatggtgagatgctgggccttgctggtttttaacaattttgtttgttcctcttaaagttgatattagctctgatcaaagtatctaaatacataaactggtataaaagtactcattatggtttaattctttttttacctagcaattaagggaatctattgctgaacacaaacctcatattgacaaactactaaagataggcccacaactaaaggaattaaaccctgaggaaggggaaatggtggaagaaaaataccagaaagcagaaaacatgtatgcccaaataaaggaggaggtgcgccagcgagccctggctctggatgaagccgtgtcccagtccacacaggtatgtgtgtgtctgacactcataaccttgaattgtctactgttctaaacaagaggtctctgtatcaggtatgtctctgtgctcaggaatgtccagagcagcatgttaatacgtgatcggtagatagaacagaaagcttagcctatcttcatttttattccaaggaacattggcatactgacattctaaggagagtgaaatgagtcttggctggtatatattgtctgttgatggtttctctgaaaactttatgttgtgatgatcctttagcagatgattttggataaatttaccttgcagattcaaaagcagtgactgcctcaaaaaagtacttattgaacctgttacttttttgctttagagcaacagcacattagttttcttaagcaaccagctaactcatagtttaagatgcttgagtaaggagtagtaagagccaaagagaagcataaaccagcagagggatttaaagcatgtaactacatactttcaactaatatattactcttagtggtactgttgtcatgtctgggtattttattcctatgtttagtcaatattcttggttaatatttgtacttactcaagtttctccccccaccttccgtcccatctctcactcacattgtggaatgtgttactttgtgttgttgctgcctgctcctgtcttccccacatcgtcacatttcattgttgtgttgaccgcgcccaccattacagattacagaggtaaggtacccatccccattgggactagggtgttcttataatgctgaaaattgaggtcattacctgtaagggaatttcccttaactttagtggaataaatttaattagtgcagtttattatgccagtttcatttggggtggaacctagaagtgagagagtgatgggaagtgatgttgttaaggaatcccaccatgttttttctawaggacacttgaaattgataagcctttctttaactaaaaccagagttggtttgagatagatttttcttaggaggcatgcttatctgttttgctcttttctctcctctctgcatcaaattttaatgagaacttttcagttgtagtcatgttattcaaagtaacagaaaagtgggaaggtaataattcttcaagaataaggttagatttggtcttccttaattacctttcattattccaacgttttttctctcttattgttccataaggtgggtcgttaaactgcatgccatgttacttttaaactacaagtcgtgtagcatattaagtttcccatccatttacacagctggtggagggcatctaacttgttggtstagtctgttgcatgcaactgtcatctcagatgttgacatactgactctcagcagtttcatagtcttgtcccttttttgttacattagttggaataggagaaatattgtggcagcactaaagatttgaattggtttctagtatattcatatatttagattcttaaaataaatattggctttttttttttytaatgggccagctctgtatatgcccaaaacagttttgttgttgtttttttctttttcttttttttttcttttagacaaagtcttactctgtcgcccaggctggagtgcagtggtgctatctcagctcactgcaacctctgcctctcgggttcaagtgattgtcatgcctcagccycyctagtagctgggactacgggcgygcgccaccacacccggctaattttttgtatttttagtagggacggcgtttcaccaygttggccaggctggtcttgaactcctgacctcaggtgatccacacacctcagcctcccaaagtgctgggattacaggtgtgagccaccacccctggcccaaaacagtttcttaaccaaactcaacacttaatagccattgggctaaactgagcacargttatcctaaacagtagtaggataatatcttgtccttattccctaacacttctccaagaagagtgatgaggtatgctgtgatggtaatgttccaacatttgtttagtttcatgataaaattgagcctatgttggagacactggagaatctttcctctcgcctgcgtatgccaccactgatccctgctgaagtagacaagatcagagagtgcatcagtgacaataagagtgccaccgtggagctagaaaaactgcagccatcctttgaggccttgaagcgccgtggagaggagcttattggacgatctcagggagcagacaaggatctggctgcaaaaggtgcttgatgattgtcattatttttaaaaatcaacagaataaattctaggstgtggttatcttcagcatcccaccagatttatttatttctttgaatgtaaaggcagtccccagtaatgagtattccagaaagtcactggaaaatcatttggaattcagaacacatttcgccattgaaacaaggttacaattggtagttagattcccaggccaggaaacaaaagctcctttaacccctaacgtgagtaaactacagtatcaatagtgggtagaacatagctaccttttgtaacactttccatgggaaacatacaagtttaacacagaacactggaaacaagagttctcatcttagcccttttgtaagttaggggttttgtatcttagcactacctttatagtagatgatagctcatttctggattacttctgtgatccctgtatgtgggataccaatgtaagaggaaaacgctagtatataaataataggccggagccacccgcagtggctcatgcctataatcccagcactttgggaggctgaggtgggcagatcacttgaggccaggagttcgagaccagcctggccaacatagtgaaattttgtaaaaatacaagaattagctgggtgtggtggcatgcgcctgtaatcccagcaactcaggaggctgaggcaggagaatcgcttgaacctgggaggcagaggttgcagtgagccaagatcacaccactgcactccagcctgggtgacagagtgaaattccctctctctaaaaaaagaaataaataataggccgggtgtggtggctcatgctgataatccaagcactttgggaggccgaggcgggtggatcacctgaggtcaggagttcgagaccagcctggccaacatggtgaaaccccgactctaccaaaaatacaaaaattagccrggcatggtggcacatgcctgttatcctagctacttgggaggctgaggcaggagaatctctggaacctgggaggcagaggttgcagtgagccaagattgcgccactgcactccagcctgggcaacaggagcaagactctgtctccaaaaaaaaaaaaaagaaaaagaaataatagtaaaactaaaatagaaaattatcctttagttataaatgcttagcatttttttaaaaaatagtttcattgaaaaggtcagagttacatggaatttctgaatagaccaatttcaggctcttcagaaagtcctattcatatctctttttttaacctcctcagaaatccaggataaattggatcaaatggtattcttctgggaggacatcaaagctcgggctgaagaacgagaaatcaaatttcttgatgtccttgaattagcagagaagttctggtatgacatggcagctctcctgaccaccatcaaagacacccaggatattgtccatgacttggaaagcccaggcattgatccttccatcatcaaacaacaggttgaagctgctgaggtaagaaggaaacaaaaccctttttcttaggtgtctgtcctctagaaaaagcactttatcaaatcaaagtgaggtatgttaactgcttagccaggctgagtaccttaaaggtttttgtttttgtttttgttttttgctcttgtccccaaggctggagtgcaatggcatgatcttgactcactgcaacctccgccttccaggttcaagtggttctcctgcctcagcctcttgaatagctgggattacaggcatgtgccaccatgcctggctaatttttgtatttttagtagagacagggtttccccatgttgaccagagtggttctgaactcctgacctcaggtgatccacccaccttggcctcccaaagtgctgggattacaggcgtgagccaccactccaggcctaaagtttctytttaagtgagacattctccaattgaaaaaaacctgctcattatattacatttcttaaatgtagaaaaatwgatggtagaaaataaaaatcaattttggactcattatctagagataacagttgttacattgacatacttttttctagtttttggtgctatttttcttttcttttcttttcttttcttttcttttyttttyttttttttttttttggagacagggtctcactgggtcacccaggctggattgcagtggcatgatcttggttcactgcagcatccacytcccgggctcaagcaatccagccacctcagcttccctagtagctgggtcatatgccaccatgcctggctaatttttttatgttttatagagatggggtttcaccatgttgcccaggcttgtccagaactcctgggctcaagcaatcctccagcctcggcctcccaaagtcctgggattacaggcgtgagacactgcacctggcccaggagtctcttttttaccaacaacatttcttacctcatattgtccatttagcataagccaagcctatcttgatattatttctctaatttcttacttttatttcagctattttttcatagagaaattctttccctccccaccttgggtcaataccaatacatgagccaatttttaggatctggcacagagtttttttcaagatcatagaccccagcacttctgttatactctattgtcagcacttaaatttgtgacttgtactgtgttattttacccttgatatgtttctctgtaatagacttctagctgttgattataatttctttggaggcaggaaggggtgaacctttggtaaattattgaacctcaccataccttttctatagtattttatatatacatatacctatatgtaatatatattttgtatatatgaaaaataaccatgtagagtctgaagctttagtgtccagataagtgaaactgacagttatgttgagcatctgctattgatggggtataaatcacatttgcaaagtttggtaagttctgttctgttttctattttggcttatattctrttcgtttacatgtagactattaaggaagagacagatggtctgcatgaagagctggagtttattcggatccttggagcagatttgatttttgcctgtggagaaactgagaagcctgaagtgaggaagagcattgatgaggtgtggagaaatggatgaggcactcagttagaacattagtgggcccagactgaagagtggtattgattgaagaatctgattgaatgtttttcccctagatgaataatgcttgggagaacttaaacaaaacatggaaagagaggctagaaaaacttgaggatgctatgcaagctgctgtgcagtatcaggacactcttcaggtgagaggccaggaggtgaccaccaaggaaatacaggttctgttttttgccatttttgtcatttttggaattaagcacaaaagtggatcaccttcacaggactgcagacctaagatagtggtgtttccacaaatttagccaaagttccccacttgtagtgaaaaaagtagcgacatctgtctgaattcttactcttcctgccatgtttatcattgcctgctcatcatagattcattcagctacgttgtgaagctggccttactgtgaaagtcattgcttgccagaggttccaaacccaggttatcttcaagcacagtttggcacagttgcttcagaacatcatgagcttgctagctgggattgaaaaatcttcacttttattcaaatttagtatttccaaattgtagtttattttgaacattatcttgataatgttggctccattattaaatcaccatattattaatataaagatcattattctttatctgtgccccttacctgaaatcacaaacagcacaaggtgctttgattgatttatgtcttcttatgttagcagagataatgctaattctctcccaaattcttctggttgtttttgactgtttacttgtcttttgttctaggctatgtttgactggctagataacactgtgattaaactctgcaccatgccccctgttggcactgacctcaatactgttaaagatcagttaaatgaaatgaaggtttgtatctgggtatggcttttgaagaagaattgttttattatagtttttaaaggcttgatttgatgttaacattgagtgtgtctttgacaggagttcaaagtagaagtttaccaacagcaaattgagatggagaagcttaatcaccagggtgaactgatgttaaagaaagctactgatgagacggacagagacattatacgagaaccactgacagaactcaracacctctgggagaacctgggtgagaaaattgcccaccgacaggtaaggcaggtggtagatgacatcagtgaactactctccgctsttttctaatttcgtattgaatattccctttctgtcttttcctgagtagcacaaactagaaggggctctgttggcccttggtcagttccagcatgccttagaggaactaatgagttggctgactcataccgaagagttgttagatgctcagagaccaataagtggagacccaaaagtcattgaagttgagctcgcaaagcaccatgtaagtattttcattttttcatctctaaccctattgatttgagaccagatgctgccaccagcagcctttgaatgttgtgtatatcttaagagaaccaagttagatgatatccatagagataaattatgttgttcaacatgttttaggtcctaaaaaatgatgttttggctcatcaagccacagtggaaacmgtcaacaaagctggcaatgagcttcttgaatccagtgctggagatgatgccagcagcttaaggagccgtttggaarccatgaaccaatgctgggagtcagtgttacagaaaacagaggagagggagcagcagcttcagtcaactctgcagcaggtacatgtgacatccaagtaaggtaggaagagctatacagataacagaaagcctatctaagtcagagagaagagatcaatttgaaaagcaaagaatcccttatgtcttgaggggaaggttaatactgtgctgtaacttatctrgaaagagcagcttttgattgggtagttcttttctgaattcatttctagctcagtctctttattcacattcaaagttagcagatcttcactataacagattccctttttttcttggatcaagwcaggtctcttcctattcaacagtaccttaatcaatagtcaattcatctgatcgtatcaggcatttataatatgttatagtgaggtctgaaggattctgctagattctagcaataatattggccccatgctaatctagcaacagaacagctttgccagagagcagccgaaaattccttcctcaagataaactcctcatatcatttggaaagttgacttttaaagctgagaaatgactactgacatggttgatatatctttttctcaaaaggcccagggcttccacagtgaaattgaagatttcctcttggaacttactagaatggagagccagctttctgcatctaagcccacaggaggacttcctgaaactgctagggaacagcttgatacacatatggtaatagcaattttttgaaattgagcataagcatcccatattcactagctcctttccaagttcacagtcataattaatatgtatctggaaatctacaaagtagtgcatttttatcaaacatatagtataacctttggggattgctgcctgttacaggcttctaataccttacagtaggcagcagtagtgacagggaaggtcagctggaaattttgagttaatcagctttactggcacacatatattgacttgaagatgacagcatcaagaagacaaatatacaacacagatgtgctttcacttaagaaggaaactacttaaggggggtttagggaaatcaaatagttacccgacagtatttcaagaatgcatgctagaacaaaaagcaacataatttctaggcaaatttttcatgaaaaggggaaatagattattggagtcttttgagggatctctaatccttaaaaaatgtttttcttggycgagcgcagtggctcacgcctgtaatcccagcactttgggaggccgaggtgggtggatcatgaggtcaggagatcaagaccatcctggctaacatggtgaaacctcgtctctactaaaaatacaaaaaattagccgggcgtggtggcgggcgcctgtagtcccagctactcaggaggctgaggcaggagaatggtgtgaacccgggaggcggagcttgcagtaagccgagatcactgccactgcactccagcctgggtgacagagtgagactccatctcaaaaaaaaaaaagtttttcttctatgggtgataaaattattttaatattttaatttgccacttgttatttagtaaaatatgttaatacttacattttaatacaaatgaattctaagtaatcagtatttagttattacaattaattttattattaagtatggtgggtttcattcccttatggctcagcacttgaactgaatccaaaagaatggcttgtaatcaagatgagcccttcctggactttcccagactstgctacagaatctatatgtaggtgtcttccagagaattcgtagaattgatatctttccygccttttcktgtaggaactctattcccagctgaaagccaaggaagagacttataatcaactacttgacaagggcagactcatgcttctaagccgtgacgactstgggtctggctccaagacagaacagagtgtagcacttttggagcagaagtggcatgtggtcagcagtaagatggaagaaagaaaggtacagtgtatgatccccatgtttgagtaatttgctgagtgattgcatgtataataattgccatcttatttatatgaagattttttgaagaccagggtattgtaacagaagttgcagaactgattccatctgtgttgagttgcattgatggtataagtttctgttgttatttgcttytataattattcattccttacctgttaagacattactgccattatcgcttcgtgatgggctttatgtcctatattaatcaccaatttgtgttctacttaaaaacaaggttttgctggagttggtatcttggggttgagagattggggacagggcatatakggactgacgaataattctccacaaggaatttggttcctaacgtaaatgtagtgtgcamggaaatttwctagaaatcaggagagaagtaaattatatgacctcttcccactcatcctcaaaaatcaaattctcttctctacaaaataatgaaagatgaytagggatcaaggtgtttgcccaaaaagattattttttatgagtacagagwttcactgtrttttttgctgctcagatcaagtatgaaatatatacatacacaaacctgttgaccacattcactcaatgaatagttattgagcaagtgtgtgccaagtcctgtgcctgatttatggtggaaacactaaagacgaccctatctttgggaaattaatgaacaraagggcataaaacacatgaacatcttgagagaagcattaatttcctaaaaaccttctagcatgggattgggtaatttgattatattaagaatggctaaaggacctaagtgtatgctaattcttggacagagtcagacctggtggctcaygcctgtaattccagcacttgggaggctgatgcaggaggattgcttaacaccaggagtttgagaccagcctgggcaatatagcaagaccccatctctacaaaaatacctaaaaattagccaggtgtagtggcacacgcctgtagtcctagctacttgggaggctgaagtaggaggctcacttgagcctggagggttgaggctgcagtgagcagtgatggtgcccctgcattctagcctgggtgacatcaataacctatctccaaaaaaaagagaaaacaatccttggacaggctgtcatccatagatcctgcagaaggcaaagctaagattaaataaactgagacagattccagctcataaccaagaaattttcagagagttttcttaatagttgagcaaaataccttaagacatagttgcccattatcagaaatggtcaggcaaaagctgagtgtcaaggatagtttattattttgcagaaacattaccttcaggatcagtaaaatcatttattaaatgtgtgtggtgctgtagtaagaaaatataaagaatatgtagatataaagaatataaagatataaattagatataaaagtatatcttttatatctataaagtagatataaaaaatatataaagaatatgtggatagaatgatgtggaaagaattcctatcatctaggaacttgtaatatattaatttctaaacatttctatatatatttgaagtggatttcatttttccacctgatttgtttagattgggtttgtacatttttataacatttattgtaatttttttttttttggtggggggtggttacaaaaataacctgaaagcgcaaagaggaaaatagaaattacaacccagtcaggtagaattaacaacagttaacgtttttggtgtacatcttggagttttttctgtgaatattttggaaatactcatttttgtcagcctgtcatttttactttgcctgcctagtaggggggccagaggcagaagtcattaccaaaaggttagtgtaggtctctgaggatggagcttatgaactctgtgggattgaagcgtacttgtgaggagtagccttttccctgaatgagctcttgttgttgccattcttaggtaaatgaaagtgtctgaaaatctacatctagtgttgtcagatttttgcctagaatgtcttggcttctttcgttacctcttcttcttatagcataagcataatttttagactcatattttcatatgccatattttctgaaaacatgtatttaaacaaagagtactacattgaacatcatcttcatagtaaattgcttttcatttagctgtttttataccacaaaaagtacattaaaggaaactgaaacattacccaaagcaggttgtagatcctgcagctgtcaccactaaagggtctgttcacttacagttattgaatagtcttattcccgttcaaggaagtggagagtagcagagaaaggaacttagctgcttattgtgctctatttccttttccatgtacacagttcttgcccatttgtttcagacactaacattaaaatgtccccttctttacaaataaagcatgtttggacgttgattaaatgaggcttcctttttagaggtcatttcatttgttgtacaattcatgcctttgtcgctgagcctataattcctgaaattggcgctttttctttctgtgtgtgtgtgttttacttgaaattcagtcaaagctggaagaggccctcaacttggcaacmgaattccagaattccctacaagaatttatcaactggctcactctagcagagcagagtttaaacatcgcttctccaccaagcctgattctaaatactgtcctttcccagatagaagagcacaaggtaagtatgatattatgatgctgcattctttttgaaagcactaattgaaagaaatgcccctttatcttatcttaagctaaaaaagagcactrttgttccctcaggtttttgctaatgaagtaaatgctcatcgagaccagatcattgagctggatcaaactgggaatcaattaaagttccttagccaaaagcaggatgttgttctgatcaagaatttgttggtgagcgtgcagtctcgatgggagaaggttgtccagcgatctattgaaagagggcgatcactagatgatgccaggaagcgggcaaaacaagtaagttggggaagaaagatactaattcactgaagagtcttgggctgcatgtattgagtctctgggatgattstcaaacgtgctgtatagtgtgtatattcattcctgttaacttatttcttatgtaattttagttccatgaagcttggaaaaaactgattgactggctagaagatgcagagagtcacctggactcagaactagagatatccaatgacccagacaaaattaaacttcagctttctaagcataaggtaaagcagttaattgctcttaggtcccaagccatagtattcgctaaagcttgtatcttgccaaaaataaaaatcagagctagtaaaaagaaaaccaattggttaatgtttaaaagtcaaaatgatgaagccagggttccattttatatctagatggtctaatcatgatatttgctcatttaaataacagtttaaggaaagtagttatgggagtaactagttaaaactgtaggctttcacaaattgtcaggcacttctatatatgrtataaacaaaaaattataaatttcttaaggataagctatggttaattttagttcaaaaaaagtggtgatattcatactttatttggtttctagcctgaaaactcaaattcttttgttccaaatcaagatgtcgtctgacttttaacacttttttcttttctttctggaaacataggagtttcagaagactcttggtggcaagcagcctgtgtatgataccacaattagaactggcagagcactgaaagaaaagactttgcttcccgaagatastcagaaacttgacaatttcctaggagaagtcagagacaaatgggatactgtttgtggcaagtctgtggagcggtgagcatgaatgtccccttcaggggtctaaccgggatcccaaaagcaagaggttcttaccagattctataaaatggtgataaagctaatgcatcagtaagaggttttgtaccatcttaacaccaccagttagttcaaagactgttataatttaaataaaatgtgtaaaaattctcattttaaacttgaaccttattgtattagagagaggcctataaaatcaaaccaacaataatagatcagtaactcaaaagtatttgtaaatcatcaatttgtaataccaacaactgtcttattgactgctcttggacactccaaagcctctacatgcattacctcatttaaccataatgatacctgacctttgctgggcaattactactgaatatgtaccaaacagtagctgataatcatttaatcctcataaccactgaggtgggtaccatttttattccattgtacagatgagaaaatgaccataaagaggttcttaactcccctaaggtcactcagctaccctgttggcagagctgaggtttaaaccatggcagtttggttctaaaagttgtacttttatctatttgtacccactatgccatrctaaatattacaatattgctaccctatttgtacttttttttgtttgtttgtttgagacagagtctcactctgtcacccaggctggagtgcagtggcgcgatctcggctcactgcaagctccgcctcccaggttcacgccattctcctgcctcagcctcccgagtagctgggacyacaggcacccgccaccacgcctggctagttttttgtatttttagtagagaagggatttcactgtgttagccaggatggtctcaattttctgacctcgtgatccacccgcctcagcctcccaaagtgctgggattacaggcgtgagccaccgcgcctggcatttttttttttttttgtcatgttgagacagggtctagctctctggcccaggctggagtgcagaacttactgcagcctccaactcctgggctcaagggatcctcccacctcagcctcttgagtagctcagactataggcatgtgccaccatacctggttaatgttttttgtttttgtttttgagatggaatctccctctgtcatccaggctggagtgcagtggcactgtctcgggtcactgcaacctccatctccccggttcaagcaattcttcttcctcagcctcccaagtagctgggactacaggtgcacaccaccatgcccagctaattttttttaatatttttattagagacggggtttcaccatattggccaggctggtctggaactcctgacctcatgatccacctgcctcggcgtcccaaagtgctgggattacaggtgtcagccaccacgcccagccattgttttttatttgagtagagacaaggtcttgctattgtccaggctgttctgtaactcctgacctcaagtgatcctcccaccttggcctcccagagtgctgggattgcaagtgtgagccaacacacttggcctgtactccaattttttttttttatgaggtgactgaggttcaaggagatgaagaaacagcctagggtcacacaactgatacagagctaggagttgaactgattccagatcactaccaaaactatcatcttttacttagagtggtatatgaggtgattaacacasaccttgggttgttagggtgtgcctgtgtgtyactgggctataagatgcctaaagggtatctctacctgtcccctgtgctacccttaatccattctagagggtggtttgatttaaaatgtctcaccatctctcagtcactttttactctatttcttttttttttttttttttttgagatggartctcgctctgtctcccaggctggagtgcagtggtgcaatctcggctcactgcaagctctgcctcccgggttcgcgccattctcctgcctcagcttcccgagtagctggaactacaggcacccacsaccatgcccggctaattttttgtatttttagtagagacagggtttcaccgtgttagccaggatggtctcgatctcctgacctcgtgatctgcccacctcggcctcccaaagtgctgggattacaggtgtgagccaccgcgcccggcctttactgtatttctaactgttctaacatagaagtcactctctatatagggttcaagcaatattccctttcagcgaggcagaattgtgggccatttgtaaaaggaatmcctaaaaatggtagcgtttgtgtgcatttctcaggcagcacaagttggaggaagccctgctcttttcgggtcagttcatggatgctttgcaggcattggttgactggttatacaaggtggagccacagctggctgaggaccagcccgtgcacggggaccttgacctcgtcatgaacctcatggatgcacacaaggtaggggtgaggtctgggctacattggagtgcagtgggtcttctgtatatgactgcctagggtcttctacatatgactgcctctgcccttctttctaggggagaaagagagcctgacagttgctttgtgtgtttaaacaaactgttgctgagattctgcattagtcacaacgaatttaccaaaattggtttgattcagatttggcaatgtgtaaacttcacttcaaggttgcgcctcttcctgtttgtttctctcagttgagtcacaaaatggatctaaattccaacggaaacccataagatagccatttccactgactcctaaaatggaaatgagtgattttttttttaaaccacttctgaacctaacaatcctaacaccaggcacgccaatatttaacataatctctatctgtcatgttgaattatgtaatatcctcctgtttcagcacaagcatttaactttaccttgaaattacaacagattcttattatgtgcacagcagatgtttttatttcccataattctggaaacgttagtataatggttaccattttacagatgaagaaactgggccttaagcaacttttcaaaattatgtatctcctaaatgcctgagctagcatttacagccacattttctggttgtttttttctttcttttttctttttttccccttgagattgggtctcgccatgttgcccagactggtcttgaactcctgggctcaagcagtcctctcatctcggcttcccaaaatgctgggattacaggcatgagccactgcgcccggcctggttgttttttcttatgcattgctctgcctccctctatgcataaaagacacatgattagaacctaccaagaaaattattatttcccagtggtttcttggactcaaaacattccttgaacaaacaaattctcctattttcttttctaggttttccagaaggaactgggaaagcgaacaggaaccgttcaggtcctgaagcggtcaggcmgagagctgattgagaatagtcgagatgacaccacttgggtaaaaggacagctccaggaactgagcactcgctgggacaytgtctgtaaactctctgtttccaaacaaagccggcttgagcaggccttaaaacaagtaagggatatttgctgtcccaacccaagggatagatctgagtgggtttatttggtttttcttttactagaatctgttccagtcagtcttgaaataagtataacagagttgaaaattgatattctgaatgttctataaaattttaatattcattttgagaaataatgaattcagttgattttcaaagatctacaaatgaaagataacctttgtggagttttgatgaggccatgaaatgtctgaatgaacactggaccctttccctagcatgtcccagtatctaggtccttggctgcagagagaggttgaatcttttgtgcttggttatttcaggcggaagtgtttcgagacacagtccacatgctgttggagtggctttctgaagcagagcaaacgcttcgctttcggggagcacttcctgatgacacagaggccctgcagtctctcattgacacccataaggtaatccagccttggggtttggtgacctcatgctacctaccaccttgagggctgcctaccactaaatgaaagcaactttttcttggaaatatcagagctcacatgaaaaggaacaaaaccagagtggccctagctcattggtttagcaggaatgaaagggaagcgactgatgggttttttgacaccttaaacagtaacattcattcttataaaagtaatatatgttggttgtaacaagttttttaaacatggtattaagaaaaatgttgactatttcatcttctttactcctcacctgcatacgcctttgtttgccttatgttaccagctttaggccctgatctgatcccccagcaccacttactaagctgtagagtatggtgcagtgtctggggtctcagtctgtcctaatgaggtgggaaatgtttccctttttaaatttttatgttatccactcagagattttaatcatggatttgttattatattctgttatgggtattttttaaaatcatggtttttacaactataattatatttttccaatacaaatatgtttaccaacatgaaatgaaataggatataaatgagagtaaatgaaaaatgggactaaaaaagagagaaactaactcgaatgggaaaaggggggcatacctctgtgtgtcctattctttgttgtcatctccaccagagaaagtcattcttgtgtaaacccctcaccttcccacatcttttagaatgaaaatgccrtaaataactatacaggcttttagaggtctgcgttaacacatggaggaaaaagaaaacattgaaatttatcccccctcagtgtaaactaacagtgctgctaatgtagactttktacgtttttgttttcaaatcttttttgtttaggaattcatgaagaaagtagaagaaaagcgagtggacgttaactcagcagtagccatgggagaagtcatcctggctgtctgccaccccgattgcatcacaaccatcaaacactggatcaccatcrtccgagctcgcttcgaggaggtgagtccctggttcagaggaggactgcacacgcccagtaaactatcactatagtatagtatagtatttttcccccaggtaaggaatctttcaytcactgtgaataactyagcaaaaattaagttaacattttagtaaagactgttttcttggtaatgtgtggcaacctggaggagtagtgttggcatagtgctatgttaatgtgacttccagtggacatgttgtgtagtgtctgctccttcctgggaaatcctgtgttaacaggatgtacagctgacccttgaacaatgtgtatttcaactgcacaggtccacttatatgcggttattgttcagtaaatacagtcagccctccatgttggtggggtccacattcacagccaaacatggatagaaaatacagtattcacgggaagcgaagcccatgtgtgcagagggcagacttttgcaggttgcacaaaaccaattataggccttgagtatgcatggattttagtatccacaggtggtactgggaccagtcccccatggataccaaggaacaactatactagattttctttcaggagggctgatattttattccagctcttatcccagttgtcactggggtaatagtgaagcctcttgactgtttgggtggtctctcctctaaaaagtcattgtgttggccgggagcagtggatcacgcctataatcctagaactttgggaggcttgaggcggtcagattmcctgactcaggagttcaagacaagcctgggcaacatggtgaaacccatctctactaaaatacaaaaaattagctgggtatggtggcacaagtctgtaatcccagttacttgggaggctgaggcrggagagtcacttgaacccgggaggcagaggttgcagtgagccaagattgtgccactacactccagtgtgggtgacagagcgagagtctgtctccaaaaaaataaaataaaaagccattatgaaaatcagatgaaaaagggctttggaaacaaagggggtatgcttgactgaaagaggccatggtttccttctttttccacaggtcctgacatgggctaagcagcaccagcagcgtcttgaaacggccttgtcagaactggtggctaatgctgagctcctggaagaacttctggcatggatccagtgggctgagaccaccctcattcagcgggatcaggagccaatcccgcagaacattgaccgagttaaagcccttatcgctgagcatcaggtatcttaacctcactgtgtgatcactggtgttttccgtgttgggcatggagaccatctctgttgccctgtgtatatgtttttaaatggctgcttaacacattaccacagacttagcactgtaaaacaacacatacttacttacctcatagtttctgtgcttcatatacctgggcatgagttgactaagtcctcttcctggagtctccccaggcagaaatcaaggtgtcagccagtactgcagtctcatctggagttcagggtcctcttttaggctcactcaggatgttggcagaatccagatcctggtggatgtaagactgaggtctctactttcttgctggctctcagctaggagttgctcttgccttctagaggccccctcaggtcttagccacacagccagccggagaaactgtccaaagtgctctatggagtcttgaaatgtaatgaagaatgaaatgtaattaagggagtgaatattccatcatttgcccacactcaagggagggggattacatagagtgtgcatacaggagtgggaatcctgggggcctttttagaagtctgcctgccacagcctgtttttattgaccatcatttgagccagggtcccactggtccccattatacctggttcagaaagctctctygcatgaacccagtkgtcagtgaaggtgcacattagactaaactgaatggaggaaagctcaggtgggccatcttcataatatatccttaagaggcaaatactatttttaaccataatcatttatactgaattcaagcgtgaatgttgattagttatactgtagactatatggtctttttagtttatataaacaattaccccagcaagtgagaactcactatacagatagtccctgacttacagtctctcaactttatcatggttcaaaggttatacatattcagtagaaactatacaattagaggccaggcgtggtggctcacccctgtaatcccagcactttgggaggccaaggggggcagatcacttgaggtgaagagtttgagaccagcctagccaacatggtgaaaccctatctctactaaaaatataaaaattagtcgggtgtggttgtggttgcctgtaatcccagctactcaggcggctgaggcaagagaatcacttgaaccagggaggcagaggttgcagtgagctgtgatcgcaccattgcactccagcctgggcgacagagcaagactccatttcaaaaaaaaagcactttgagtgcccatccaaccattctttcactttgattacatgagatagtcaacactttattataaaataggctttgagttagatgattttgcctaactgtaggctaacgtgttttgagcatgtttaaggtaggccaggctaagctacgatgttccatagtttaggtgtgttatattttcagcttaacgatgggtttgccaggatgtaacttcatcgtaagtcgaggagcacctgtccttcctgtgggatgtacctcctctctgagagattatcttcttcctattcwgttcttctcctttctgttttcctctctctcctctatgtcttcagtctctccctgtttattcttttctctaaagcttccagacatgtccttccaacccagagttcccctcctttttcagctacgcttcttgttccctgtctcatctccttttttcccatcactccccaagtccctgtggtctggctgacactgttctggtcacattctactggctaaatccaacagagttttttcagtctttattttgtttgacatgtaacctagctggctcttcatcccttcccaaaacttcccttttgacttctgtgtcctttaatctttgtgttttcctctgatctctctgaccgttcctttttagcctttttagctggttcctcttccctgcctattcatcagtgttgttccctgacgtctcattcttgatgctctcctcactctgctaagatttatctggtctaacagctttagctattacctataaagcttctgcatctttttcatcttcagcactatcatctcctaaagtccagacatacagtaaactagaagcagttctaaaatttccactttatctttgcccscttgcctgacgtcatttgtccattccagatctgccccccctttcctcattcagaggcctgtgatgtctggagttcctccttttcctcacatctagccactcaccakggcttgtcagtcccactttmaaaatacctcttggttccatctttcctgccctggctctggccctcaccatgttttgcctcagttgctgcaatggtttcttaacctgtcttctcactgctagccactccccatcccacacttacccccacccccacatcactccatgttttacactgaagccagagtgatagctgtaaagcatgggtctgatcatgtctcttacctggatcgaaatccttcagctgccccctgttgctctcagaataaatggccaacccttagcctgacacagaagcctttcgtgatctgtctcctgcctgcctctccaaccctgcctcttgccattcctctgattgcatcctctgcccagccagtgagtggaggggtcctggtcacagcactgtcaggcatccctgtctctgtttgggttgcaccctcttccaggactgccttcccaccatttgttgactgtttcttcattgctcagtgtgtcagtccgtttgcattgctataaaggaattcctgagactgggtaatttataaagaaaataggtttattttggcttacggttctgcaggctgtacgggaagcatggtgccaatatctgcttctggtgagggcttcaggaagcttagaatcatggtggaaggcaaaggggagccagcgtgttacatggcaagagagggagagagagaaagaggaggagatagcaggctccttttaaacagccagttctcatgtgaactaacagcaagaactcactcattaccatggggagggcacsaaggccattcatgaggaatttgcccccataactcaatcacatcccgttagaccccacctccagcattggaaatcacatttcaacatgagatttggaggggacaaatatccaaactacatccctcagtaactcaactcaggcaccagcctccacacagcctttcctgccaccacaggccgtaaagtacccatcctagctcttcctttgcccccataagagtaaaaatacaatatttaactctttttcctattttttgtgtttaacagacatttatggaggagatgactcgcaaacagcctgacrtggaccgggtcaccaagacatacaaaaggaaaaacatagagcctactcacgcgcctttcatagagaaatcccgcagcggaggcagtatgtttccagccccctgtgttaggatgcttcattcctgctaattgaggatgagcactttccaaatgcctatcaaaaaaaattatattccattttcaaaaaccgtgttggttttgaaccaaaatctctcatttttgaaactcacttttcttacattgacagacagtagctgtactccatattctttggtatgattggtatgaaattacgaggtggttaagcttattttttaacartggcctttccattgttttggttatcagccctagctgtttacatttggcttgtactaatttaatcaacacaacagcttctacagaatatgttgcttttttagttgagttaacgtgtcatcagctcactaaggtaggacagaattgcttggagatatgtaggcagcaggtaagtatgtgctgggaggatcagtacttttggaattagtacacctccgtatctaaatattgccaagtcccgtatttcttttctcagttattgactggatattattataaagatcttctaggtttatacatacagstatttctctttgtatactaaccagctgttctaatcttgtgattatttttccttttagggaaatccctaagtcagccaacccctcctcccatgccaatcctttcacagtctgaagcaaaaaacccacggatcaaccagctttctgcccgctggcagcaggtgtggctgttagcactggagcggcaaaggaaactgaatgatgccttggatcggctggaggaggtaaygccctgctgagtggccttccctgaaacaaagtgcttttttcaatcaaaacacagcccttctgaggctctcttaatgtgaaccttgtgtcttaatttactttttcacaatagaaacagacctataccaagccagtactcattctttgaggcccctgaatgagaaaagacacatgtgtaagaaaaccgtttgtgacagagtaggctaaagcttctaggtgtggaaagcaagaaaacagccagtccataatgagggccaggacctgatctgcctcagcatcttgctgtggttgggaatcaggaacagaactttggaaatttatctccagatatgtagcatagcacaaaaatgacccttgttgagcctttcatgtaaaaacagatgctacagaattatgaaataggagtaatttttaatgattttgttattagtcttcacttgatcatgagaagcaactctattttgaagtgtcattacccagtataaaaaatatagtactatgcttcctagtttctaaaacaagcctctaatatcttttgtatttttttatttgtgcatatcaaagcagctatgcctggaagtgagtgttctgtgttttgtttattttttccttaggtcagttgacttttaagcttattgggttcttggtgcttttttcccccattccttctaactttggagtttgaaagaccaaggggaaactgctgcactctttaagtcattttgagtgtatatcattaacgtagacttaagtagctgaaaattgtcttgcccactgcataggcctgctgttttccatcaaggccaaatatttaacatggaggtcagatgggcaatttgctctctggtgccattccaaagaaacatgcttggatacaacattggrttcccaatgcttccatccagaactcagattttctcattgaaatctcagaagatagtggtaaacacgagcctcctgatatgagccctatgtgtgattataatgcctttcaaaacaacataatcgaggagtgctaaggacctcccttctgggttagaatccatttccttgcatctaagagagtgatcctttgaaaagcccaaagggaaagcaaggctggcttcacccattctcattctgtgtgctccatattttccatggtgattcagttattgtttctcttgctattccattataccatagctcgtgtaaatagtcatggctttaagtgaaagagccagattgtgccttcacaaaagaagcaaacacatagatttcattgttgatggcccctggaagcatggctttactgaatgtctgaaagtttgggtatgctctgggcagcttttgagggcccaaaaaataaatcttattgacacttctgatttctgtgtagttgaaagaatttgccaactttgactttgatgtctggaggaaaaagtatatgcgttggatgaatcacaaaaagtctcgagtgatggatttcttccggcgcattgataaggaccaggatgggaagataacacgtcaggagtttatcgatggcattttagcatccagtgagtctagtcatcattccaaacatgggtcacacctggattccttgcactttgtagaagctgtgatattctagctaaacagtctttctgaagctggccaggagcttggctcacacctgtaattccagcwctttgggaggcaggtggcaaaggcatggtggcacacttgcagtcctagctacttgggaggctgaggtgaatcacctgagcctggggaggtcaaggcctgcagtaagctgtaatcgtgccagtgaactctagcrtgggcaacagagtgagactctgtctcaaaaaaaaaaaaaaaaaagacagtggttaaccagaggttttcagctgggaaacaatatgatttggtctrtgttttagtaaatcactgtgactactataaatagtcacacttccctttgtatagcaatttgtttagaatctaagacaataatctaaacataggaaaacttcatgctattccaaactgtcactattctgaaataatctaaatatccaataattgtggagtggatgagtatattcttgagttgagtggtaggactgtgggtggttgtaatattatgtttatgccttttggtatatttgaaatggggaatattaccttttttcgttgcatttggggtaggggagtctataagtggatatgtattatttttcaggaaaaatcaagacataaatttttttgctcttaagaagtatttctggccaggcgtggtggctcgcgcctgtaatcccagcactttgggaggccaagatgggtggatcacttgaggccaggagttcaagaccagcctggccaacatggcaaaacctcrtctctactaaaaatacaaaaaaaattagccgggcctggtgacaggcgcttgtattcccagctactctggaagctgaggcaggagaatcacttgaaccagggagacggaagttgcagtgagccgagattgcaccactgcactccagcctgggcgacagagcaagaccttgtctcaaaaaaaaaaaaaaaaaaaaaaaaaaatctataaccgccaaccraacaagtacccctcttaatgtttcaaaatatgattccttttctccagagttccccaccaccaagttagagatgactgctgtggctgacattttcgaccgagatggggatggttacattgattattatgaatttgtggctgctcttcatcccaacaaggatgcgtatcgaccaacaaccgatgcagataaaatcgaagatgaggtaagggaaataattatattttgagtacacttctggctgtaggtttgtaatatcctgaatttggttgggttcagtgatcatattagcctttgacttgtctgttgggagataattatttggagttctattttgagatctctttttggatagcatttcaaagagtcccagaggatctctgacatctgagctctagctcaggctagatggattactcaagtgagtcatgtctgtgtggtgctctgaagtttayagagaacctttgcagggcagcatactcatcctggttcactcgtcctgtgtttgggatggactcatctcactcttgagcatgctgcctggaatctagggaaatggtctmccagtgtagcatttaagggttgaaatggactgggcatggtggcttacatctgtagctctagcactttgggaggccaacacgggaggatcactggagcccaggagttcgagmccagcctgggcaacatagtatgattstgtstgtcccccccgccaaaaaaaaaaaaaaattagccaggtgtggtggcaagtgcttgtagccccagctactcaggagactgaggtggaaggatcacttgagcatgggagatcaaaggtgtggtaagctgtgatcatgccactacactccagcctgggcaacagagcaagacttgtcttaaaaaataaamacaaatgtttaaaaggggagtaaaatgtaatgtttaaaatggtgtatacccatcatgctttctgccttgttaagaactaccacattgaaactgccaaatttattagtgccatctagaaaccctaacatctgttgataacagatcttggtaagggagaggtgctgggacaggtcttaggagtggccctggaacacaccaggactgacttccagggaatcttgggctcctagggtgaaatttaaagcagttcataatttgctttattaataatttgattttgatgcaagcatattagcacttttctctgaaggagttttgaagcaggaataaagaatgtgttgtatagtcacttgggaattttctttcatgccttttctcagtgtctcaattagttcacttagtaagaagaacatatactaatttggaacagacaataaatgtatatgtcaaaagcctgaaatgcctaaaaagtaaataatgagcygtgcgtggtggctcacgcctgtaatcccagcactttgggaggctgaggcaggcggatcacctgaggtcgggagttcaaggccagcctgaccaacatgaagaaamcccatctctactaaaaaaatacaaaaaattagctgggcctggtggtgcgtgcctataatcccagccacttggggggctgaggtaggagaattgtttgaaccaggaggcggaggttgtggtggagccgagatcgcaccattgccctccagcctgggcaacaagagcgaaactccatctcaaaaaaaaaaaaaaatgtaaataatgaatagcctccctgttaatgtataaaaatctttgtttctctgaataggaagtyttgctctaccctttacactttcctttttgttcacacccaataggttacaagacaagtggctcagtgcaaatgtgcaaaaaggtttcaggtggagcagatcggagagaataaataccgggtaaggaagagaaaaagcagtcctttgttgtggtggtttctcatatgtggctgatccyaccttttcctcytgatgcttagaggcccagagcccatcggacttgagatgtggtcactctctgacctcatctctatagatgccaagtgtcaggtaccctgttacatctgaaaactagtcccatatctacctagatagtagtagtttgtatttaagttttaagatargagatatttcagagctgtcacttcacatctgacaaagttcctagggggatgaaggtacctttggaaacaattrtatctattgactgaccacttgcccacaaagagatggtcattgtgagcctgagtggctcccaggctagagaggcctggggaaactgtgttgaagccccaacagacactgtgcctgctctgagctgggctacaaatggggcccaggagcactgaggagacatcaggctcagtggtcttccctggaaagccatgctaggtgtggccataactgacagtgaactatacttgtgttttagcttcttttgggaccagggtcagggacatagaaggatctgaaacaggtctcctaaaatatatcaacagctcgtcaagattctctaaagtcctaagaaaaatctatgattggcaaagaggatttagattgcactaagaaacacaggaaggtccatgtttcattagtatatccaaaatgtcctcaaagtacaccaaatctaccccatgctgcagtctcctgaggagtgctgggtgaatctgctttgaatataacctagggcatttagttaataaagctccatataatcttatgcctgcttgttggattttgttttcttgttttttgtttttaattatctatgagagaaatgaattaacaagaacaacatagcatggagagttagttcatagtttataaaaccacatccctggccgggcgtggtggctcacacctgtaattccagaattttggaaggtagagaggcgagcgagcggatcacttgaggtcaggaattcgagaccaacctggccaacatggtgaaacaccctctctactaataacacaaaaattagctgggcttggtagcgcatgcctgtaatcccaactactagggaggctgaggcaggagaattgcttgaacgccggggtcggaggttgcagtgagccatgatcgcgccactgcactccagcctgggcaacagagcgagactctcaaaaaaaaaaaaaaaattaaaaccacatccctgtggcaggagcttggtaagaatatgttcagtgtgtgtcactttgccagaaaaatgtaatgatatgattttcattctttagtgttaatttgacaaaatgttctctttttttttcccctcctttcctccatcctttactctttactgtctatagttcttcctcggcaatcaggtacagtgtgccttgcaatgttctccttctcaatggatatggtctgtgtagctaatgctgcctgttcttcgctatggggagaggatgtaatctgaagcatgcctgggtcgcacctggttgtcttaccaagtggagaaactgttgatggggccagcattgcaaagctatcttagcagcaaaagaatataagtataattttttataaaggagatgaaatggasgaaagtgaagctatggtatcagtccattacacttctaagaagagcctggttttgtacttctgtgttagaagtcagattaccaaatagcacagttcttatttatattagaatcttttgacagttaataaattttgtaatgtatggtaagtcaattcctgaagaacttcagtactatttaaatatctttttaatatttgtagttacttatattgtatgttataattacaaggtatctgagaagtgtagtgtggagatcgtaattggccgtggcctgaagtatgctgattatggccagccagccaagatttaatgggaccaaattagacttgcaaaaaagattggatgctttgactccacttggtaactctaacctttcagatctttttgagtgctgtggggtcctgtgtcctccaatgtggaaggaagttgcatgagtaaaatctgtctctctgatatgaaattataaacactagttgttgatttcaggccctcaaacatcccaggccttgcaagtcactatagaaatgttctagrcaagtgggaagaacaggggataagagaaaaaaactaaagatgagaacaaactggctttaaaaaaacatcattgcttgagagtgtccaatatgcctatttgctaatgactgtgtgtgaatgctagggtgcctttgaagagtcctgacaccctcttctactgctccattgatcaggagagggtcagatgacttctaatgttgagaacggaattatgaagttcattttatacacaggcaactgaggcctcaaagatcacatgcctactctcacacagctagtgtcagccactgcaagaacccaagtctctgtaagaggttttccttttaaaaggtggaaacaacagttactgacccttaggactcttatttgttctttgcctcactgacaaccttgtcctaccaggtgtgcacaggtctccatttttagagctgccataatccctcctaccacttgtgactctggcctcaacttccccagctacactggctgctggcttggtcaaacctcctttcccccatagcttagcagaaacaagttagaatctttcaaagagagctttagtgtgaaattaaggttgggggggacatgaaatatatggagtgataaattatagtacacagtattccaagaataaagtactcttgtggttccttcctgattcaccctggggtacacacaggtgcatactccctgcctctcacccatccagagaaaaccctttgcagtgactcaggtccaagagcactgctcttgggtggaatcctccatatctctcagaacctcccacagggcttctcattttcacttgtggggcccagcttctgagagggggctctcacagagcctggggggcagcttccttcccaggacaggacgtgtattctctttcaagtctgggttcagtgctgctgctaccacacagtgcttttgctgcagtcactttgtataaacatgtttaaattgtatcagatgaaaggtgtgggacttcttttattttcaaagtaaagggctgggagggaggatacagtatttttcaattgccttgcctgtgcaaatactgcatttgagtcagagcagctaaggaatatggagaattaccacaagtatattaattttgagggaggatggctatatgacctcagatatcctttcttgcattttcaatttttctgccttgttttaaagttacagttgtcctttataactttgaaaatcctggccgggcgtggtggcttatgcctgtaatcccagcactttgggaggccgagacgggcagatcacgaggtcaggagatcgagactaacctggctaacacggtgaaacaccgtctctactaaaaatacaaaaaattagccggcctggtggcgggcgcctgtagtcccagctactcggaaggctgaggcaggagaatggcatgaacccaggaggcggagcttgcaatgagccaagatcgcrccactgcactccagcctaggcgacagaacgagactccatctcaaaaaaaagaaaaagaaaaagaaaatcctaccaactccatacccgaggaacccttgaattgaatgattttaggaattccatttctcctaccagatgtttgtttgttttggaaactctgcatacttctcttttgttgctccttacttcattttggaaagagggtaatttatgccatgagaaactccagatgtttagagctgggaagtaggaatgtttgggcaagaaaaaagggaaaacataaataatcagaaatatgcttgttttagcatctaaaatgattattggatactgttcataatcatcatgggagctacaatttttaattgcttcaactcaattttagtataaatatgacctaatcatttgttcagctgaagaaacttttctgctggtgacactgcaattagcaaatacttcgggttaaytcctgaaaacctgatgcagaaaatcagattttcttctaagcttgtaatgatgctttgcaaaggtttccttaaggcttgaaatagtattcactattttccatttagctttaaagcatactgtattcagaagttgatatccacaatctttcttttaggaaaacaaattagcatgccaagaatatgaatttttaattgagcagaatctcttttaaaaaaataaagtgacctaacactttgtctgttttcctacctctccttttggtgcagaggcagtggtgtgaccattaaaagtgatttttatcccaatagaaagtatattggcccggcgcagtgtctcatgcctgtattcccagccctttgggaggccaagactggcggatcacgaggtcaggagttcaagacagcctggcaaacatgttgaaaccccgtctctactaacaatacaaaaattagctgggcgtgatggcacacgcctaataaacccagctactcgggaggctgaggcaggagaattgcttgaacctgggaggcagaggttacagtaagctgagatcacactgttgtactccagcctgggcaacaagagtgaaactctgtctcacaaagaaaaaagtatatcaagacaccagtctttagcttgatatttctgcttttctatttttaaaatccttttgtgaawtatataaaaatgcaaaattgtgagagttaacaattcttctgtagctatcaaattgtcattcctgtctgaatacagtctgctttgggagaaaaacatagatctgctttaagacatatatattaattaagtttcctttgattctacagtttggggattctcagcagttgcggctggtccgtattctgcgcagcaccgtgatggttcgcgttggtggaggatggatggccttggatgaatttttagtgaaaaatgatccctgccgaggtaaggaaccattctaagcatgaattacgtgttaggtatgcccccagcagtgatcttttaygcttacaggaagcattgatggtggggtctgtctsttttttattttgttaagctgcccaggtgtcatcccactagcacagattagaactcaggggtgccagcataggccagggagaaaaagctgaagaggttgatgctatttggggaggtaggtctagaggaatgcagtaatgagaattaagagtgtattggtgttactcgaatgtttgtttggggtattaaattaacactatcctagaaaggagcccrgtgaagccctttaggttccctcttagtgcctcagatccctttgcctgtaattcctgtggctgwtactcagggagagtgttaggcccttctcatacagggaagaactggtgagccccctggaccaggaggaaggataaagacacctacatgtgagcccattcacttctaagacaggtggccacctaagcaagaccatggggtgtctttctgctaaatgtgaaaaggctggcccaccagcccagaagcataaggagactgtcaatttaatatgagcatgagtggtggcatctgcagctagggggtgtgtggggactgcaacagggaagagatgaccggttccaattgctaaatcctcttcagctatgtccttgcctttttcctgttagcagagctgcatgtgggtgcacaggaggctcccccactgtctgccaatttgtctttcttgactagtttctgcgtttcctgccctgtctgtttctttctgtttacgtattttttattctagttcaccatcctgggagtaaaataaagcgctctgattccagctcttcgatttccagtcagtctcccataggttggcttttaagctttgtccctcttcctcacaccctagcccattgagaatggctttgcttcttaaactgtaacatctcttggttctgtgtatctgctgcattcatgaatgcttgaaatggccaaaccatagcttttctaactactcaagttgatggtgcataaaatactgttgagacagtgtccatggaatttgttttgagtttctatttaacaaatacttatatagttttatgtgccacacactattacaagtactttacaagtaacacatttatgcctcatatgaagtgtagatgctcttatctctgttttacagaataggaaattgaggcatagaaaacgtaaataatttgcccaaagacaaacaactagtaaatggcagagatgagattcaaattcagggcaatctgggtctggagtatgtgcccctagtcagcatgttatatctttcagaggctgacacacctttktgtatgtttattattggatcacctgcataattattaaggtttatttataaacctagcagaaatgtttgctgtacagtacataacttctttggaaatgatttatagtcatattctgaagcatttagtgaggacagagctaaagatagcagttttcacatgaattcagatatgcccctaagtagttcctcttattttaactcattctgtgtttactacagtaaaccagagtaaaaattcagcagtaataattttcattagaggttccttttttaaaaaaattggggccaggtacagtggaatcccagtacattgggagcccaaggcaggaggattgttgaagctcagaagttcaagaccatctttagcaacatagtgaaaccccatctccacaaaaaaaaatttaaaaattagctaagcatggtggtacacacctgtgtagtcctaactactctggaggctgaggtgggagtattgcttgagcccaggagttcaaagctacagtgagccatgatcatgccactgcactccagcctgggcaacaaggcaagactcttgtctacaaaaaagtaattttgaaaacacttaaaaacttgaaagtatttagttttagaatttaaaagctgtcttttattgctttaatgagaaacaatatatgccattttaactttaactcagtaaaacaactttattcctttccaaatctatgaataaggtcctatttttcctgtcatgtatgatcagactaaataaaagagatattgcatgtggcattttggaatccttgattgcctgtttatttgctgcctgctctatttatgataacatcatgctgctggccaaggagaacactgcttgctttgtccttatcttagtatctaaaatttggaaccccaaggaaattggggagggccatctagaagctattttctatgaaagctagtaaccttttttagcatcccttggaacaagcaaggtaagactttcctgtgtctctccaggagtgctctcctggaactcagtaatcatctcaatccattgactgtggagagaactctccagaagttttaaatttcgtaactctgtcagtgatgggcaggatgagctatttttaatcaaataaaaaatggtgctaggcgatgaacacctaaggactaggatggattataataagttagaagggtatgaaggatgagaagagaacaaagttacttgaaactatattggaagttctataaggattaatgtggcttctggaaacagtgcttatggtaggttttgtactcatttatgttgcatatttccttgggtctctggaatgtagagaatgctatactgaggacagtacaagatgtgtgacaaggttcttaacaccagtgtgcactatcatttcttacctccttttacacagctattttaaaaggtagaagatatctcaaactgcatgtagcttttagtcatgtgtaaaaaaatgaaaatattttactagctagatttgccagtctcctggtactgccaaaatcagatatttcagtttctgaatgtatcygtggcacaggaaatcatgatgttttggatagagagaaaaaaagtgctcctgcctaaataatgggtatacttgtacctaaggtactgtgtatgtttttgatcattagacatattagctcccccagataagtgaacatctaggaaatttcatttatgaagatttaaaagacacattttgaaatagaactcattttttttttcagattgttatacagataaaatttaccatcctaaccatttttaagtacaggactaagtatatttgtgtcatactaccgtcaccaccgtccatccacagaactctcttcatcttgtaaaactgaaactctatacccattaaacaatagcttagaactgaattttaacatgcccgcatcagccagtttcaggtrgccagcataactcccttagcaaagacagcctctttggtggtcaatgaactgaacttgaggtggctgccgtcatgtctggttctgtaggttcaatggtagatcttttctccagtgaaaagaatggtgagggggaaaatcctatcacagtagtcaaccaagtactaggaatcttctcttttttttaactttaggactataatacccaattttgggaaatatttgaatcaatgtaaatattaagagtacctttactactaaattcaagtgctagtacataaattttgcttaatcagaatttggtgtttccttctagttcgagaaaaatgtttactttttacttgtgggattgctccagaaatcaattttcacagcttccaactgtttattgtttgttgtcgcctcctcccatcccagccttttctattatcaaagtaaaagtattaattgcccccttaacaccttttttaattcttaaaattggccgctttaagtttatttckgaagaaagagctttcatttcttccaagtgatatgtatataaaatgttccttaccaagaatcgtttcattgccttgcatcttcaaatattttcttttaaaatgcaaatatccatgggagttgtagcatattaagctaatattagctaggcatggcttgggataaattaattattcattggtctcttgaccgagatgagagcaccagaaatgtgggaattttactattgtgagcttaagagcataaggaccaagaagatggaaattacagagagaggaaggaaaataaaagggagaagacaagcctctaaagccccaattaaagtaagccattatttttcacttgagtttagaccttcttaatgaggcctcatggaagcgtgcaggagctagctaaccactgtttacagtctcagattgccttaatgcctatgttgcgtgtctttggcatggctgtagtaacctggaaggatgacgttagagaattgttcacacgtctttgcatctctggccagtgaaatactatcccaagaggtgaccattggctggagatttccttatgaaaacagagactgtctcattatgtttatttgtttcgttatgacgtgtaagcgtaccctgagaaaattatgaactgtattttcccagcatcctgcatgcacccagctaggaaagcaagtgagacaccctttgggccctcagcagtcatttaatgaggcgttacaatgtacctacctcatggtggcctctggggctaacagggtcatgatataggagatcagcataggatcctgtgatagaattaaacaggtcctcagatcacaaaatgcaaaggttgctgttaacatgggataatcttcyttcttgtagtatctttcttatggaaagctattctatctgctcttttaaattgctttaatattctatatatagtaggtgttggcagtcacaaatttaactttgtggtttcagtcatgaaaattcatggatttgcatttgtttctgstgtgcaagagagccggtcacacagcgagagagtgagccccactggccactgactcctcactttaacacagcttggtgcttctgttcttcatccccrtgaaataatgagcacttctcaatggaagcacttagtgagttcatgaaggttgcgagatccattccttgaaactgttgagagactcttgttttcagaggctatttcagagaaacagaggctactctgtttcacacatacttactgaaaccctaaatgcaagcctcgcactgggatccaaaggtaaattaagatgatggtccctgcctgcagaagctctcagcctagtgcagggaacaaacatgtgaatacatgcccttctatttggtaaaatgaatggttgagagagcaagaggggaagagatgactctgcccatgaagatggagaaggtatcaggaaaaggacataattgggctgggcatagtggctcacgtgtacaatcccaacactttgggaggcctagtagggargatcacttcaggccaagaatttaagaccagcctgggcaacatagcaagaccccatctctgttttaaaataaaatacaggccgggtgcagcagctcatgcctgtaatcccagcactttgggaggccgaggcgggcagatcatgaggtcaggagttcaagaccagccgggccaatatggtgaaacgctgtttctactgaaaatataaaaaaattagccgggcatggtggcatgaccctgttgtcccagctactcgagaggctgaggcaggagaatcgcttgaacccaggaggcagaggttgcagtgagccgagactatgccactgcactcygtcctaggcaatagagggagactctgtcgcaaaaaataataataaataaatatatggccaggcacagtggctcacacctgtaatcctagcactctgggaggctgagccgggcggatcacccgaggtcaggagttcaagaccagcctggcccacatggtgaaaccctgtctctactaaaaatacaaaaattaayggcctggtggtgtacacatgtaaccccagctactcgagagactgaggcagcagaatcacttgaaccggggaagcggaggttgtggtgagctgagattgtgccactgcactccagcctgggcaacagaacaagactccatctcaaaaaataactaaataaaaataaatgtttgtgtgtgtgtataagtgtatgtgtgtatatactgcgctccagcctcagcgacagagtgagactgtatctcaagaaaaaaggttttgaaaaaggaaaaggaggtgttgcttcagccacatcttaaaggaggtaacacttgaccagaaggaaaagggatctggatgttcttggtacagaaaccacaagttcatatgaacagaagtgtcaacagctgaaaaagtaaggggacaagtagtcccatgggactgcagccaaatgtacaaggttagcgaccagataagactctggacgggtcagcaggaggggccaggtgatggatgccagaccactgggtcctgggtacttaccacattgtgcttcctagtccccaagatgtggtcctcaaaaaaacgaaaagtcacggtcaaatgaatttgggagatgccaagttaaagctctcccaagcagggaaatatagaggaccaaaccccttttgtaggaaaaccctagaaaacctcacttggggaattctgctataagcagtgaaacaccatggaaggattctgagctgttgacaacagattttcatttagaaattcattctgcaaaatacaaaaattagccaggcaaggtggtacatgcctgtagtcccagctacttgggaggctgaagtcaggggatcacttgagcctgggaggtcaaggctacagtgagccatgtttgtgtcactgcactccagcctgggtgacaaagtgagaccctgtctcaaaaaaaaaaaaaaaaaatgcattctgcagaatgagaaaatgagtgagggctgggtgggtggtgagatgagaaacaaggagaccagtaggaaggctgctacagttacccagtggggaggaggtgctccatgaaacacctgagtacaagggggcatgcacaggctcagggattcaagaggcatttgaaggtagaatcaatagactgaactgcccttgggagggagagacctacgttggtgccagggttttggttcctgactctggtcatgcctaatcagttgctggatataacttctggcatccagcaggaaggcctgccctactaatatatttggagttgggtgtgactataatggtagcactgaagcctcagtggatgagctcatcaccaggtcaagtctaaggggagaacaggactgtggacagacccagcagacatccatgttttagaagtgggcagggaggagtggtcagcaagggagcaggcgtccttgaagccaggggaggacagggtttcaaaaacaagagagcagtgtgtagtaaccctccacatgcaagttacaacagcagagagatgtttttacctaacaaattgtcagacttttttcctgtatgtactcatgctcatagcacaataattggccagaatgaagtaaatttaatatactcatattattttggagagtgtatgctagtaaaacattttggaatcagctggcatctatcaaccttgacacatggttgacattcatcagttgatgtttttaccttaggtatgcatcctttctccccagaaaatctacatgtagatatttatcctaggctgggcgcggtggytcatgcctgtaatcccagcastttgggaggccgaggcgggcagatcacgaggtcaggagatggagaccatcctggctaacatggtgaaaccccatctctactaaaaatacgaaaaattagccaagcgtggtggccacgcgcctgcagtcccagctacccaggaggctgaggcagaagaatcacttgaacccaggaggcggaggttacagtgagccaagattgggccactgcactccagcctgggcaacagaacaagactctgtctcaaaaaaaaaaaagaaagaaagaaatttatcctaaggaaatatcgtggatacatgcaaaatgttttacaaattgtcacagcattggctacaatgtttaaaatatttaaacaaaaatgcartattggactggttaaataaattcacatccatatgatgaaataatacttagcagctagttaaaattttgcatgagacatgtagggcatggagtaaagtttctgatttttttaatatatacaagctgggcatggtggatcacgcctgtaatcctagcactttgggaggctgaggcgggtggatcacctggggtcaggtcagtgtttttgaaacactgtcctccccggcttcaaggacgcctgctcccttgctgaccacttctccctgcccacttctaaaacatggatgtctgctgggcctgtccacagtcccgttctccctcttagatatatatacacacacatatatacacttagtgtatatatatatatatatatatatatatatatatatatatatatatayayacacacacatatatacacttagtgtatatatatatatatatacacacacacacacacacagatgtgcaaaggagtaagacacaccattataatagtgatgtcccttgggttgtgagattaagcgacttttgttgttgttttggtttttgagacagcgtcttaatttctcacccaggttagagtgcagtggtgtgatgacagctcactgcagccttgacttcccaggctcaagcaatcctcccacctcagcctccagagtagctggatctgcaggcacatgccaccatgcctagctaattttttaattttttgcagagatggagtttcatcatgttgtccaggctggtctccaacctgggctcgagcagtctgccctcctcagcctcccaaagtgctgggattacaggcatgagacaccacacccagccattaagcaattttcattgccctcctgagatagaggttgtcagtgacctttgccagagcaatttccatgagtggtggggatggaagcgtgagtggtctgaggggaggagtggagacagcgaatgtaggtggtgatggagagagctaggctgggaatgtcttgggggtcgggggacaaagaggacaactcaagtggaagacgtgggttctaggtccacctctactgccactttgcttgacctcagcctctgtgagtacttmagtgtctctgtaacatagggatgctaattacagtcagctgcattattgcacattctgtgaactgtgcagtgcatagggaacatatcaccattatggcattagagaatgcccttcctaaaacatttaaaatgtcacttccttcaactgcaatgcaatttcaaagttttcctcttatatcttttttttttttttcctggcaragtttgctcaraagtgaatttttttttttttttttttttgaratggggtctcactctgtcacccaggctggagtgcagtggcacgatctcggctcactgcagcctccgcctcctgggttcaagtgattctcctgcctyagcctcctgagtagctgggactacaggcatgcaccaacatgcccagctaaattttttatttttagtaragacggggttttgccatgttggccaagctggtcttgaactcctggcctcaggtgatctacctgccttggcctcccaaagtgctgggattacagacatgagccacttcgcccggccaagggtcatgtattgttgaggcttgaggaggaaggaaacactggatcatggaaggaaacagcttagcatttcagggaccattaagtcataratcatccagacaacagggctcttagagatcggttgacctgatcgcctctggtgagcctgaggaaactgaggccagagcaggaaaaaaatcacagttggcagcagagcttggactrtaactcagaggttttggtatccaagtgagtgcttttaacctgatactttgatatgttctgtcaacatataatatattgagaagaatttggatttgatttaggaatttggaaccatgctgcttggacacttatgcaacctgatttaaaacactgattctaccaaaattcctcaaattccttaagggacatatggggtagcacagatgagaargtggacaaaatttcctgccaccttctagatttatggtttctgaccagttaaacatctgttatagaaaagaatgacaaatattttgttcataatgatkcccttttctccagcagtcccatttgtttagctgtgtctagtacttcataaagagtgcacagtttagggtggatgaggaggtagagggtttctgcaggattacatcttacagtgagaaataatctaagaacatattccagagggattatgtcttttaaattagtagcatctttcgcatttaacatttttgttggctgtgcgtgagatcttcctatggaatccacattttaagttctgggtgtgcagccccagaaagccataagacagcgctaactggcttnccgtgccgactccacgttctttgcatcttgatgttcctcctacttgcagttactcctttggccttttattgctttcagtttttcacttaacagtttctcactagcaagttttgtgcatggtcttgatctctttctctctccccaccgacatgtttacttcttaatgattctctcctgatctttttactgtcctgagttcctggactcctttctttaggattgttactgactgaattcaaatagaagagtctagacaatatcgatttcagtaatgtttttctctactctttcattaccacatatcctgcaaaaattaagcaaaaagtacacatgtactaagagagagaaaagaggggttttgatttaacttcagaggtttacgaactgttgcatctgctttacctcaagyagtcagtgtgcttaccccagggacagtggcaaagcaagacgctagcagcagagtgggctggtcctttatacacagagacttgcttattatacagttaacatatctgctatgggtaggaaycttgacaaggctgatgtgtcatgaatttatctctatttttgaagaacccacagatggtactaaacccatataacttatataactgttatcatggggtcaagccgctgtataaccgtcaaaaatatattttttagaagaactgacattgtgtgtgtgtttatttcctttttagcacgaggtagaactaacattgaacttagagagaaattcatcctaccagagggagcatcccagggaatgacccccttccgctcacggggtcgaaggtccaaaccatcttcccgggcagcttcccctactcgttccagctccagtgctagtcagagtaaccacagctgtacatccatgccatcttctccagccaccccagccagtggaaccaaggtatgtactgatctccattatgcccttcttccccaatcccaccctcacagatgttcattgttcacggtagcctctgaaagactccagtgaggagaagaaataaaaatgaaaacatgttttctattttagaaataaaacgtgaaaacacacagatcaagactgccctgttcctagcagtacacagatatatggcctttaagatgactccaaaggacatttattaaaatatgcactcagcctggttatgtcagaaatgtttatttcctcatgttctcagtttaagtttgagcccatccagtgttactacttttgaaaatccaggctggacacagtggctcatgcctgtaatcccagcctttgggaagctgtggtgggaggatcccttgagaccagaagttgaagaccagcgtgggcaacatagcaagaccatctctacaaatttctaaatttatcatctctaatttttaaatttagcctagcatggtggtgagcacctatagtcccagctactcaggaagctgaggcaagaggattgcttgagcccaggaatacaaggctgcagtaagctatgaactgcaccactgcactccagcctgggcaacagagtgagactctgtctctaaaaaataaaaattaaaaaaaaaaaaawtaaggaaaaaggacagaaaatccaggcactggctgtgcagtggagctaacagctaagtttgatgttatgatgggttatgtgtgaatgatgttagtgcctgcctggtccttctcatcctgatggaccaacatgcattttattttgttttctgtttctttaaaatttagtatcttctatttatttttttctgttcccaatgtgcaccctttttgttcctttttcaattgttcctgtccttccctttgratttccgtttcacagacttcacttcagttctctcgctgttatgacaaaccctggttggtaaacagtaaagctggcacccctatcagggacagccattctcctgacctccagctgcccacccccgaggtagagtatggctttgctgactgaggacacagtcaagacgaggccctcgctactggacttgaccagctcttcttcctgacacgaatccctgcactctttcatctctgtggtgcttgctgtcacagctgattcatctartccagtgttttcaggggtttctaactcggattcaccaaaattggagagaaataagagatgcctgaaactagattaataactttataacaatcttgagaatgatatttgctgagaatggtaaatgatggtcattgctgtagatttgtttattgatgtcatttataatcaggcctcttggaatctccaaatgtcagatactcagacgagttatgaacacttgaaattcaactatggcgcatgttctacaatgttctgtctttgcttagaacagaagagtggttggcgccacctgccctgagacacatgtccagggtggttggtattgccacaccacactggtccgaggcgtgggtgctgtctccttcagccaagcacagcaccagtgaacactgacctgaggctcacattctagcttctgaatttcttggcctaggcacttgagtttctgtagccttgatttgaatacacatgccagcaattaagcatgttcaagtgcagccattaaagtgcctgaacgcttttggaagagcagtgttttagaaataaaacatggactagtggcttgtctgatagtagtgcagtttgcattccagctcctaccaagaaacattggattcttgtgcctcaagacartgttgccttcagtcttggaaagccttagccagggaaacaagggatgcacaagaagtcaatggctatgaatgagctgctgttttgaggttcatttcacttcaagctaaaactccagttcagaaatatatctggtttagaatatgatctggggacctactgccactaaactactagactcaccctgcttatcttgcttttcttctttccttaatggctccagtttcataaaaatctcagttctattttaaattttagatgtttaatgatgtacaaattctcatacagttctgataaatcagggcttttgttctgtcttaaggttttattttctgtttcatttcattttgaggcttcatctttccttacttattggtgttctgtagccaggccatctcctgacttggaattctagcccgggttctagctgtggtcttccagcagcagtgcgcaggaaccttagcttctgaaactggtgttcttcctcctatgtggccaggaaattttgtgcttgagtgttaatcactttctatcgcttatgctttttctttataaatttaagaagtacagcaaacaatgagatggattgcttttctcttctgtttgcataaacgtcttaaaggtcctggaaaacaatttacataattgatttcaaagaaaaattagaatggcatgctgtagcatgtggcataagtaatgttttgggggtttttttgtttgtttgtttgtttgttttttcattttttaaaaagcraagtagagacaaggtcaaataatggatgtttaaaacatttaaggatcagcctggtcaacatggcaaaaccccatctctacwaaaaatacagaattagctgggtgtggtggcaggcgcctgttgtcccagctacatgggaggctgaggcaggagatcacttgaacctgggaggcagaggttgcagtgagccaagattgtgccactgcactccagcctgggcaacagagtgagactgcctcaaaaaaaaaaaaaaaaaaaaaaaacccacacagatttaaggctggacatggtggctcacccctgtaatcccaacactttgtgaggccgaggtgggcagatcacttgagcccaggagttcaagaccagcctgggcaacatggagaaaccctgtctctacaaaaaatacaaaaataagccagccactagggaggctgaggtgggaggattgcttgagcctgggaggtcgaggctgcaatgagccatgaagtatgccactgtgctccagtctgggtgatrgagcaagactctgtctcaaaaaaaaaaaaaaaaaaaaaaaaaamcccacacatttaaaatactctttttcctccagttaagcctactatctaaaaaaccaaaaaaaatcactcaaataggaaacatagcacctattggtagcagtgataataatatgtagctcttttccagtttgggaaatgcttctattcatcatttattcatgcaagtttttattgagttcctcttctgtgctgtgcagaacacaggaagcaggggagagaatagaagtgtacaagcagtgttctgagtagtgagacaagacctctctactaaggtcatcctttcaatagagcccctgcagggaatgagggggtgagccacacgtgtatctggggtaggcttggggtgtggtgattgtgcaacaacagtccaggcaaaatgaacagcaaggggacaagactggtggaccctcactgggccattggtggaacagcaaggaagctagtgtggctgggatggactgatgaggagtgtggtagaaatgaagtcaaagaggcaggatttaatccctgatttcccaagagagaagcaaagacacaggtgttaatttcaatcagtcctggaacccagactcaaacccaggtctcctggttcttcatgcacagacttgttcctgatgtctcagtcccacagtcgtgtgcttctcatagtttatttgatccacaagttaagtaattttatctgcattttaccagtaaggataatgactaaaagatcttactaaagttactgcacctacttagtgttaagagattggggccaggtgcggtggctcacacctgtaatcctagcactttgggaggctgaggtgggcagatcacaaggtcaggagatcgagaccatcctggctaacacggtgaaaccccgtctccactaaaaaatacaaaaaaattagctggacgtggtggcgggtgcctgtagtcccagctacttcggaggctgaggcaggagaatggtgtgaacccaggaggcagagcttgcggtgatccgagattgcaccactgcactccagcctgggtgacagagcgagactccgtctcaaaaaaataaaataaaaaaagattggagtaatacttgaatctccatatcaaataggtgggctaaaactcatttcaaatttttaaccccaaaatcttgatacctagtattatttgaatttctttttcctttactcattcaccataattgtttgttgtaactattgtattcttactgaggattttttttttttcatttctaggggaaattaktaaaacaaaaggtatttgaagacattttgaaatttttatttggaayataaaactttgattttgggaattatcaaaatatatgacctaggatactttaagagaaatctttgttttcctggacttttaatttgcttttcaactaagcaaatataaggaggtgtaaggagaccttttaaagttgaatttctggcaaagattttaccaagtaaaatgtgacctttttattattttttttaaggttatcccatcatcaggtagcaagttgaaacgaccaacaccaacttttcattctagtcggacatcccttgctggtgataccagcaatagttcttccccggcctcyacaggtgccaaaactaatcgggcaggtaagtacctgccccgtgacctacaagccaggctgagaatttggaaacaacagcctatgtggaatgtttcactgctcccaaggagcgggtaatgagagtggcacttagtgtgatgcccagaaagacagacctgcagatgctcaagtgacctttactttttctgtcattacagctagctttaagctttccttctgagatgagatgcttccacagccaaagctgggccatgcgttctcatcagaaatgatcacatttgagagaatgtaaaaggaaatgtgggtcttcctcagacaccagtccagtgttgggatgagcagcttgctagtaatttttccaacacgtcatacttactatggctgctgttgaaccaagaaaggcaggggaagatcacatctgttctcctgctactgttcctcatgggaacctaggaatcttccttcatttcctggctggctgcttcccctcattttgcctctatccatcctgcccatggattagcccggctggcaggctcacccacctgtgctgaggtggttgagcaaccttgcttgcctccactttggggccatggaaggtgacagtgctgctgatagagtggctttctaatccccaggaggcagcttctcaagtagaatcacaaagccagaaaaggcttcagcaacttctgtatggatgaggaaactggggtgcagaaaggctgtgagatttgcttaagatcacacaggatcagaaccctagcttctgctcacttgttcttccaccccatgccatctctattaagtctgctgttttattcttgaattccagaccctaaaaagtctgccagtcgccctgggagtcgggctgggagtcgagccgggagtcgagccagcagccggcgaggaagtgacgcttctgactttgacctcttagagacgcagtctgcttgttccgacacttcagaaagcagcgctgcagggggccaaggcaactccaggagagggctaaacaaaccttccaaaatcccaaccatgtctaagaagaccaccactgcctcccccaggactccaggtcccaagcgataacactgtctaagcacccccaagccactatccactttgaatcctgctccatacattgggtgtatatttattctgaacgggagaagttatattgttaaaagtgtaaaagaataattgtgttatgaagctgccttattttttttctttttgtaagttactattttcatgtgaatatttatgtagataaaatttgcctcctggtaaccctgtaatggatggggcccagaaatgaaatatttgagaaaaacaagtgaaaaggtcaagatacaaatgtgtattaaaaaaaaaaaagcctattaatagggtttctgcgcggtgcagggttgtaaacctgctttatcttttaggattattcctaaatgcatcttctttataaacttgacttgctatctcagcaagataaattatattaaaaaaataagaatcctgcagtgtttaaggaactctttttttgtaaatcacggacacctcaattagcaagaactgaggggagggctttttccattgtttaatgttttgtgatttttagctaaagagagggaacctcatctaagtaacatttgcacatgatacagcaaaaggagttcattgcaatactgtctttggatattgtttcagtactgggtgtttaaaggacaaatagctgctagaattcaggggtaartgtaagtgttcagaaaacgtcagaacatttggggttttaaactgatttgttgctccctatccagcctagacaccagtaactcttgtgttcaccaggacccagacccttggcaagggataggctcgttggtgacattgtgaatttcagatttgttttatccactttttttgctatttatttaaatggtcgatcaacttcccacaaactgaggaatgaattccacgagcctgttctgaaaatgtggacgtaagacaaacacgtgctcgtcctttaatggagttcaccagcacacttgttaaccagtcctgtttgctttcgtctttttttgtgcgtaataaagtcaactgaccaagtgaccatgaaaaggggctgtctggggctcctgttttttagctgctgttcttcagctccgaccatgttgctgtgtgattatctcaattggttttaattgaggcagaaactgaagctctaccaatgaactgtttagaaacaagacacacttttgtattaaaattgcttgcagtaacaaatattttgtatttcctgattttcttttcaactattaccttatctataaatgttaccctggggtataatcatgttgtaggtacttaaatrcattccgcaaatcaaaatatcttgatggataaattatagagcttaatagatcttgttttatttcatccttgttaatyttgtttaatatggctgggcatggtggctcacgcccataatcccagcactatgggaggccaaggcaggaggatcacttgagttcaggagttggagaccagcctgggaaacatagtaagaccttgtatctactaaaactaaagaaacmattaggcatggtggcacatgcctatagccgcaactactagggaacttaaggtgggaggatcacttgagcctgggaagtcaaggctacagtgagccacgattgcaccactgcaccccagcctgggtgacacagcgagaccctgtctcaaaaaaaaagacaagmtattaacatgaacatgtaggatatctgtcctacttacatgattaaacaaatagtattatgtaaaaagatactagaaatcatggagatcctgggttctcagaatgggaccagtttgtcacactatgtcacagtatgctgaaatttctggttaaatggtagaatttcagaggtggaagcaaaatcggtcatcatatctagctcctttgttttacagatggagaaactgggatgggaaagtacaagagaaagtgatttccctgagctcacaaaatgaataaatgacagaagtgaaccttgaatccagtcctcgactccctgttcaagtctggcacttctatttcctccagcctctagtcagttggctttataatagagcagccaaatgttaacttagtaataagaagaaaagggctagaggcttcggaggtaaaggggctaagactcatgccacctgtgttcttggtcattaggccgcattccttaggacataggcatttggtgagatcgatgcatgtttgccaaagctgttaaggccaaatacccagattaaaaggaatttggagcctaatggattctgaaggaagtgcttactctgttctccatggaactggggaacttcaggctgccaggactttgtataggatagtgttttcaccctaatttgcttccccttctaggcctcttggcagcagaagcatgtgagaccagcttgacctccatcttcccagattgtgggttatggtccagaatcttaccaagtaattaaggttttctggggttttgtggcaaagttcagctggcagcggcaccaacgaaaagtgcatttctttttttttctttttttttttttcttttttttttttttttttgagatagggactcattctgttgcccactggagtgcagtggcgcaatmtgggctgaccgcaacctccgcctcccaagctcaaactattctcctgcctcagcctcctgagtagctggagttacaggcacatgctaccatgcctggctaaaaaaaagtgcatttccattcaacaaatgcctgtacacaagaccatgtaggaaataacaagatgctaggaaaagggttaaagtataatcacagtcctgggccgggtgtggtggcttattcctgtaatcccagcactttgggaggctgaggcgggtggatcacctgaggtcaggagttcaagaccagcttggtcaatgtggtgaaaccccgtctctactaaaaatacaaaaattagccaggtgtggtggtgggcacctgtaatcccagctactcgggaggctgaggcaggagaattgcttaaacctgggagacggaggttgcagtgagccaagattgcgccattgaactccagcctgcaagaaaagagaaactccatctcaaaaaataaataataagtaaataaatatatatatatataatcacagtcctgtgatagaaatgctaaatgaggaaggraaatttggtgtctgctggggccttgaatgatgcaataactagctcatatttattgactgcttactgtaagccagtgattgtgctaagtgctctatatacattctcactgaatacscttaacagttctatgatcattagcccccttttcttgataagacactgagcctgagagaggttaagatcacagagttgccaggtggctagggaaaacccttgttttgacactactttctccaagaaacctaccccacctcagttcccttccagtcctaatgttctggattccactcacatgtggtctgctcccacttccccgctcctctgcycttmcagccactttgctggctcctctgggagcacagctttcattttgctttgggaaattgccgtgttcaccagctgtcacccctgttgctgtgggggctgctcaggggcagggggcttgtctgctccatctctggttcagggcacagcacagagcagctcacggtggttgttgctgaactgaagcgtgggcagaggcccttggaatggctaaaatctgctgtttaggtttatgggaatgtgaagcccgttgtttakaaaacacagctctatctccacatcctaaattgagaaatgatttctgttataagaatcagcccagcactgggcagcttgcagtctagctgggagcccagaattgcacaaaacaaacctgagaattgtacaggctggatctagggcctcaagtgatgtgcagtggattcaaaaggggcgtgcasagaggacagtgaagggggtgtgggcaggagattccgagactctgaccaagatgacatggggacaaagccctgtggattcagcctcctaaacagctttctcctctgcccctccaccccatcaccattagagactcatggtcattgtacccacccccacatctgattgctgtacctgcctccaactgcagggccctgactcctgtctccctctgatccatattccgctctgcttccaagctctggtcttgggtactttcaacggttattctgcattatccttagctcagtatccttatgggacagtcccagtccgcrgggtagccccggcttctaggcggtggcatccacatstgctctgcccggagctgatgcaggtgcctcatggggggcgctctggggaccgcgcagaaaatttacgagcagtgtggaaatatacctgttgggtaaaagacaaactaggcgtgtgtttaaggcaccagcaaatgactatttagattaagaatttgttgtagaaaattttattgaagtgatgacttcmaaatgtgattttgrgggcattatacacttgcttcgaggtttaatcttcaatccacatggcggggcaccataatctctggtgcccagggccctcgtctagcccctgtgaggccctttgcggtgcctcccttgccagcccctccagcctccgccrtttgccccctgggctctccagtttccactgcccccctgcccgagcscagctccactgctgtgtgacctggcgtaagtcccttaaccgccgtgtgcctcagtttcctcatttattaaaagaggaggttccagtggtatgtaccccctaacgatgtgcgagcatcacagaaatgacacgagacacacactcakaacatgccttggcgtggcaagtgctgactgttgccattattaggctccccagccggggtctcagggccttggcacaagctattccctctgcctggagcactttcctccactgacctttcctggcgctccaggtcaactccaggagccttcccagtgcagtctaggtgccttctccttccgcagcgcctgaaccacacaggaataagtaaggcgagagcgcgcccagggaagagcaggtgtgcagaaagggactgagtcagtcgagacgtttccgcggggatccttctcttggcaggcctgcaccggggccgtggggactgagaagatgtgcacaggtggctcccgagtgctcgggaagggccccagagcttctggcccagctggaggcaggaggcggagcctcctccgcaaagctggatcagtaccggggacgcagggcgcacagctagggctggcgggggcggcccgactggggcgctgcctgggctcacgcgggagccaggtgggggacgcagggagaagcagccgagcaggtgccgagaaggaggcgcccgcagaagcgcatgcaggggccacggggaaggcgccaggaggcggtgaggggccgcggtggccggaacccgggccggctgctgcgggcagaggaacaggccccacccgcggggcttggctggcaccgcccggctctccagacggggctacggccgcgtgtcgggcccggtggcgaccacggcacaccacggcgaggcagccgggtggcaccactggcgggaccgggacggcgccgcggccttaggatctctgcgccgaggcccgcggcgggagccacgacggccctgaccacgctgacgcccaggctgcgggctcctcgcccggaccaaccgccagccacgccgaggtcgcacctcggggtcgccccaccygcaacacctgccgccgcccggggctcctagcgggcgcggcctccgcgcccaggccccgcccccgcgcccccattggtcagtcccgggggtgggcgggcrgcacagacggctgagccggggcaaggactcgcrggaatcgcgccgcccgggtcgctgccggagctcgccggtcgcccctgcgctgcgcggaccgcagccacagccggactggtgggaacggcggcgacagacggattggctgacagtcccagccctcagaacagccccggcctcgaagcgttggcgtctgcgtccgcgtcagcgtccgcttgtcccggagccggggcaggtgcgcgcggggggcgctccagggaccgcgctgaggccgcagacgccgcccgccgagccccgccccctgctcgccgaactcagctccccgttcgccgtcggggcgtccccgggcccaggggcggcggcggagctgatgtgcgcccgmtgagcgcccccggcccgccatggccgcgcgccccggmccgctctggctyctgggcctgacgttgtgcgcgctgggcgggggcggccccggcctgcgacccccgcccggctgtccccagcgacgtctgggcgcgcgcgagcgccgggacgtgcagcgcgagatcctggcggtgctcgggctrcccgggcggccccggccccgcgcgccacccgccgcctcccggctgcccgcgtccgcgccgctcttcatgctggacctgtaccacgccatggctggcgacgacgacgaggacggcgcgcccgcggagcagcgcctgggccgcgccgacctggtcatgagcttcgtcaacatgggtgagtgcggccgcccgcgcggggaccctcggagtaarctggctgcaggggaggkgcgcgcatccgcgggcggtgccgggccstggccgaacggggartcacagacggtggacgcgaaccacagkggagtgggacygccgtggttagggaaggtctaagggtcatgggggccccctgggctgcggrgtggtcaggagcagagtgtgggggactgtggactcccaggcgctgccttcaccctgccccaracacacccaggagtaagaatyagrtgatgtctttgcccacctgggctgccccgggaagacagcctggtcctggggagacaggtgagtaaacagaggccgggatgctgtcactgtgataaggrcagtactgaggagagggacaaagttcagcgtggaaacctgtggtcacatcatcggagtgaccagagctgagtcgcgtgccctgagtccacagcaggctcttcyctgtgcggagcctgggtggggtgcggctgtcaggggrgcggctggggaaggagcagactcagctcgctggggcagggactgtkgccttgtcaccctgggccctgcacttagcatgtggcctggtatagggtgagtgtccggtcctgtggaatggcccagtgggcagctggacccactgtgttctcccaggcaaagccgggcttttcctg

SEQ ID NO: 13275 - DNA, 57073 bp, Homo sapiens
taaggtggaaggattgcctgagcctgggaggtggcagttacagtgagccaagattatgccattgcactccagcctgggtgacagagcaagaccctgtctaaaaaaaaaaaaaaggatgaagaacggctctgcccttggcaccctctagagcagatacgacagtggtaccaggcccttagtcagtgaccctgtttcagaggttagagtggaaataacttgccctccgttgcaatcatttttaaggtcagcaattagcagaactctatttttaaacattccttctagttttaaaggttaaaagaaaaaacaaaaaccctttaaccaacaagtcagccaccagtgaccagaaacaatgaagtgaccagcaaaacagaaatacagtatcttgagtcacactcattctaagtacctttacttgaytcttgaaaggtttatatttctgtgtgtcccgaatcttcttttttggatgatcaagaaatagtacctagaaaaataaaatataatgataatcattttcatttttggtttgtagtagcagaaccccctccccccgccaccttttgcaagtaacatctttgtktgtgtgtgtgtgtgtgtgtgtgtgtgtgtgtgtgtgtgtgtgtgtgtgacagagtcttgctctgtcacscaggctggaatgcagtggctcaatctttgctgactgcaacctccgaccccaggtttcaagtgattctcctgcctcagcctcccgagtagctgggattacaagtgcccgccaccatgcctggctaatttttgtattttttagtagagacagggttttgccatgttggccaggctggtctcgaactcctgacctcaggtgatccacccgcctcggcctcccaaagtgctgggattacaggtgtgagccaacgcggctgccctgcaagtaacatcttgtagggaatccaagtgtgtcacacacacatggaaacaaggcactgatatgaatttcaactccagaaggaaatttatygcactgacttaagctgatgcccaacagtcagagacaataaaaacaaaatcttgaaatcaaggaagtaggagaaaaacagtcaacagttaaccagcaaccaacttattcctatattatacttgtattttgagttggttctacacatcaggaagttgcaaataacacattttaacagctcatcttgcaatcttagcatgcaattttttgttttgttttgttttttgataggatctcactctgtcacctgggctgcagtgctatagggtaatcatggctcactgcagccttaacctcctgggctcaactgatcctcctaccccagtctcctgagtagctgggacaacaggcacacgccaccacacctggctaattttaaaattttttatagagatggggtctcccctrtgttactcaggctggtctctaactcccggcctcaagcaatcctccagcctcagcctcccaaaaagctgcgattacaggcataagccactgtgtctggtccttagcatcatcttcaagaaagacttgaacatgtgctgcgcaaggtgccagggatggagtcagagtcaggagggaaggacgagtccccacggcagcagtctctgagggggtacagcaggagcacacagaagacctttctgtgaggacactgcccrgggrgttctcacctcagtttcaccctctgtaaacaagcatgaacacctccrgcatcttcaatggattcaagggatctctacagtgccgtcacgggagcaccatagcaaaggctgctgcctgaacattagcatctctgtcacttccttctgaacggcttcaagttcctcaccacacycaagtgcttcaagccggtgggcagaggtgacaacttaagtgtctctcccatctagcagactggcctccccrctgttcccactgtgtcctttaaaccaacatccaggcatttgcccataaactcaaagtgacccccaccctgttctcctgtaaatacacacgtactcgctctgcctgactcttcattcctgcctcgggtgaccaggagatggcaggctgccctccccacccatgacgccttccctgcccagggtctgtatatgtctttgaacttgtttcccacggtggtggtgtctgaatttgcactttccatctgaagaaccaggggctgccccaggcgggattttcctcgggacgccagraagaaggcaaaggcaagctcccagggccagggtgatggttaggcaagcgtaacctgaacatgggccacagggcatctgccaggataaacttgtttcctgtggagggaccctggtcacggatgggacaactggacattaggccttcctccaggtaaaaggggtatcagcaccttcatttctcattagggcggggttgccagctgctctggtatgggtaccccagtttcgctgggggctctcaaaacaagagcctggcatggctcctaaaacacagtaagaactcagcacgcggtatctgatattattaccaaagtattcccaacatagagcacaaacccacacattgttaaaactccccaacacagcaagggcgtgagtgtaacacccacggagcaggggcaggctgagtccccaggagagagcccagtacctttaggtcattatgcagagcgtgccccactagaattctgcccttcagcatctctgccacttccttctgaacaacttcaagctcttctcctggaaaatcaacacaaagaagcggttttttgcaacacacacatcaccatcattctgtgaggaggcagccccgctcctacccctggtcagacctaagacaaatggtcaggcctgcaatgccactacggagggtgactcgaagccaccacatccacccacccccctgggagaagtgccttgtgggcccctggcaggggtggctgcgagaaccacctctgaggagaggaataaagtgctccacacagtctgcaaagtcggctcatggctggaggagagcatatgttgagtgtaggcactgagaaacttttagagccgcctggcagcgyggttctgcctattcaacctcatgatttacttgacaatttcccaaatggaaataaaaacaaaactgcccccacaaaaatgggyagagatgtgttgccctaggccctgggctccagaggcagccttgcctgcttctggggaccaccccaccaccaaccccacttgtaccccccgaacagggstgattagaccaagggtggcccgagccaagtgggaccagctaattttttaaaaatattttttagaaggccaggtgcagtgggtcatgcctgtaattccagcactttgggaggcggaggcaggcggatcacctgagttcgggagttcaagaccagcctgaccaatgtggagaaaccctgtctctacttaaaatamaaaattagtcgggtgtggtggcatatgcctgtaatcccagctactcgggaggctgaggcaggagaatcgcttgaacccaggaggcggaggttgcagtgagcccagattgtgccattgcacttcagcctgggcaacaagagcaaaactccatctcaaaaaaaaataataattttttttagaaatgaggtctcgctatgttgtccaggctggacttgaactcctgggttcaagcaatcctccctcctcagcctcctgagtagctgggactacaggcatgagccaccgtgcccagctactggcctggtcttgaagtcagcggacaggaggcaatgaagtgcaaggcataaatgggtgtaaagccgtctaaggatgccttttgtattttaaaacccatcgccccaaaaggagacaagacgcatcaaaaccagctgcagtgagtggtctcagacagaaaagggaacaaaagggagaaaacgaatccagttactrctttcccttctaagttcctgagctgtggatgacataccctgcttgaggttctcaggccgaatcccactgaccgctgtcctatagtccgtcacgggctcrgytggtttgacgtacttgtcataaacgcacttcccatactggttcacgatggacacacgggcggccatgctctcctcccccttagggcccacgcccaccatctcacagtccaaggctaaggctcttgtcaggctgaagggtaaccaaaggctgtagtttaataaacacggcaggccacagggcwccaggtcagagccccagggatccatggactaagtgtcagcagagaaaagctctctgcccctcactcatttgcacccacgtgacaagctctgtgtggtcctggttcttagcaggaccctgggaggtgcttgcytcattcacctcagggagaggaaagcatcctcttccttgaagaagccccgccctccacrgctaagcatccccagcagaycccactccctgagaccagcgtacccgccgaaggcctgctctttcacgaggctgaggctgacgctgccctcgctctgacccaactgtttcctcgctatcttggccgcctctggacctatggcagcttcgatatccgctgggtccacgtcgtcaaaccagatgtcttccctaaaaggcaaagataacaggctgatcaccagaagaccctagtgcaactggtggggtggggctgtggggctgactgtgcaggtgagtggagcgatggcacagcctgcctctcccacaggctggccccagacaccccgactgctggccctgctgcttctgctattttgatcatcttggcattttccttttttttttgagatggagtctcactgggtcacccaacctggagtgcagtggcatgatcttggctcactgcaacctttgcctcccaggttcaagtgattctcttgtctcagcctccctagtagctgggattttacaggcgcccactgccacgcctggctaattttttgtattttcagtagatacggggtttcgtcatgttggccaggctggtcttgaactcctgacctcaagtgatccacctgcctcggcctcccaaagagctgggattacaggtgtgagtcacagcacctggcctcatctcttttctttttaattagaaaatacactcattattcaagatttaggaacacagacaaacacaaagaatataaaacagaaacacataacccaccacccaagtgtaatgagtgctaacattttaattatgaaggtaacacgttcattattgaacacttaggaaacagacagacagaatgcctgtawgatggaaacacagaaccccttgccctccgtactaggaagctcacacaggcacrtaacacctgcctggggaatctgtctcttgggctaaggttaaatgtcatktccttagaaaagccattccyggccccactgaatggacacgtccctcttgttccaggcrcccaataccttctcctcactagatttatcctgaccacacttaatcaacagctgcagtttacagtctgtctactgcacttgacaataagcctcaagagggaggagcaggcccacctcactgaactctatcccagacagcctgcctagcacaacacagggaggcccccaaatggctcattcctcagccatcagcgactgtgtcctgaacacccaggcaacatgaagccagctgtaacttatgaacacrtcacctccagctgaaccattcagagaaggccactgactcccggtccaccccacgtgggtggccagcacagggtttattsttttcacttgtttttttgagagtcttgctccgtcacccrggctggaggcagtagtgcaatcacagctcactgcagcctcaacctcctgggatcaagtgatcctcccaccttggcctcccaaggagctgggatcacaggcaacarccaccacacctggctccatcacagggttgaagtaatcaccaggcactgagccaagagtgccaacctcacaatctccttatgatgccaccatgmctaccacaaggcacagaggacgtcagaaacttgccccaaaccacccaactggcgagaagcagggacaggcctcatacttgggtctttctggcttcagcacgctttccttccacacacgtgtactggcacccactaaatgctgagctctgctcaacgctcggaagaagcaggccctgccttatcatgcgcacactctaggggaaaacaagtaacagcgagtaaacaaaggaacagacgacatcagggtaaagtgatggagagactgcggtgaggccaccagcctccataaggagacaggccttggtgaagtcgctgtgcctcggttctcagtggtgaggtggcccatacttactcggtgggtggggctggggctgcctccttagctttccgcttcttatgctcgatgtcccctcgttctggaacaatatcaccatttgtcctttccttggttcctttcttattgtgctctgttccactggccttggtgcgaggtactggcgccytcctgtccatcttggaacctgaaggaacagagcccctgctggcctcctggtcttttcctgccggcatctcctctcccttcacttgaggcgaggtctcttttttgttttgctggataattttgggcttctttttggaacccatctgagagatgacaagaggcttttctggggcctgagatttttgtttcagcagccactgggacccaaaataaaatacatgctgcatttgaatttggaaattacacacagcagattgaaaaaacttacgtgtgtatgtatatacacacatatacaccaaacacatctatacaattcccatccgcatcactgaaattcattttcaaacggtttggaaaaagctctttttcattctcatgggtcacttgtggtgaaatgctgtttctttgcttatcttattataatgcattttgcacctgctccttcatgcatacaaaatgtcaaactcattctacaccttgggtacctgttgagtggctggacaccacagaccacttcccttttcagcttatctagaaagaattttggagttaacttccctcacagcttgggccaacatcctgctacacagaaatcgctttttttttttttacaagattccctggtttgctactgctgtgaagatctcaggaaggtggggggtgtcataaatgaaaagaaaagcttctgtcaaactggagtggctgaagaactgctagcagccacacaccttggctgtcacccaagcagaggctcctgtagtcttagagcccagcttcctccctgtgttcaaatccccagtgggagtgggcgccaccacagtgcgatgatgaggcgggtgctacttacctgttctgtgataggtaaagaactgaagggctgactttcttggatgaattagaaaacactccaaagtttccctatagcacacatcccttccattcacttattttgcttttctttcttgggagaaggaagaagagttggtgttcaagaaatcccacagaaccctggggctgcccacgggaatttgactggtcctgtgtgttaagacaggaatgtctgcactgagatactgtgcagagtattaggaggttcaagaagcrctcggggaggctgaggtgggaggattgcttgaggtcaggagttgaagaccagcctgggcaacaaagtgaaaccccatctgtattagttcattgtgcactgctataaaggaatacctgtgtttggtaatttataaagaaaaaacrtttatgtagctcatggttttgcaggttgtacaagaagcatggtgccagcatctgcttctggtgaggccgaaggaagcttcccatcatggtgtaaggtgaagggggagcaggtgtgttgcgtggtgagagagcaagcaaaaaaggtgctaggctctttttaaacaaccagctctcaaatgaaccagcagagtgagaacttactcgttactgaggggagggcaccaagtcattcawgagggatctacccccatgacccaatacctcctatgggccccatctccaccactggggatcacatttcttttttaaaaaaactactttttacttttatttagagatggaatctcaccatgttgcccaggctggacttgaactcctgagctcaagtgatcctcctgcctgggcctcccaaagtgctgggattacacgtgtgggctactcgggaggctgaggcaggagaatcactggagcccaggcagcagtgagctatgatcctaacaggaggtagctccaagggagctccaagggatgtggtaagaatgtatgagtgacgcacgtggaagagtgtctrggagagagcaggcaacctctacagaagtgcaggtcactagggagacagcaggtacaacacagccttaaaagcatggactccagagtcagccacctggttcccagccgcaatcttagatgatctatttaaactyttccagcctatttcctcatctgtacaatagmgatgatgraagtgtccacctcacagtcttattgtggggattgcaacacrcatggcatagagcacatggcagagtgcacatttttaggagctcaattagtatttacttcaagaccgtaagtgtcgctagaaccccatcacatgtctgctatctgcttttcacttctacacaggaatcttytttctccctgtcttgctacacagaccagtgtgttctttcgttgttgttgtttgagatggagtctcgctctgtcgcccaggctggagtgcagtggcgcgatttcggcttactactgcctctgcctcccgggttcaagcgattcttctgcctcaggctccccgagtagctgcgactaccggcgcgcgccatcacgcccggctaatattttttgtacttttttagtagacacggggtttcaccatgttggccgggctggtcttgaactcttgacctcaggggatctgcccgcctcggcctcccaaagtgctgggatcacaggcgtgaggccccgcgcccggcctggtttcgggattttaagctaaatttctctttgtaaaatccattctagttagttcattatgcaaaaggtacaagggtttatctttgcttttttgtacttgaaataattctttcatcaatttctttcaagcaaacaagttcgagacctccctcaacaggccacctttcttgtgaaaagctgtttacaagatttcgattcaaatctgcctttacaggtcttttggggctacccaagtctttccctccgtcgcgttctgcgggaatgagctgcgcagcgctccgcccgggccccctcaagcctcacctcttgcagcgccttccagttttgagaaaagtcttctggtgcctttggaggtcgcaccacagcaccggggccgcttgctggcttcttgcttacttcccgcgccttgcttttccaaaacctttttttcttcttgtttttcttccgagtgagcgtcttgacaggacccggcttagccacggggctgctcggggcgcgcttggaggcggggaccttcgccttccccatcctgctgccgtccagcgcmtgggccggcggccacccgagaccccggcctccccgggcccggcgccctggcagcacaagcgcctgcccaggccaggccgaaacacacccaccgcagggaccccgtccagkaaaagactccggaagagaccccgcacgcgttgcgcatacctcagcacgcacgctccagtccccggaagcgctcgtctctccacaaccggctggaaaccggatccctgcctctggttccgcgcagcctgggcggttcacccgcacgggacttgggccgccgccttagccagcggcatccggggtcatcgacctcgagtttgactggggcaagccgaggacctccccaagatccgggatggggatgrgagatgcgaacgccggaagggaactggggggccgctgtgtgtgtagcaccyggtagggcagctgagctgggggcactgggcggtggggctagtgagagccgggctaggtcgctcgcctgcgtcctggactctcgagcctttcccgccttgggctgctccttgctcagcctcacagcggctcatcttccacgtacagtggggaaactgaggcccaggcaccgggaggagttcctgccagttcactctgtagcaggacgagccgcagacaagaacccctcagacaccgaattgtagaaggaaagggctttatttagtggggagcatcggcagactcacgtctccaaaaaccgagctctctgagtgagcaattcctgtcccttttaagggcttacaaccctaagggggtctgtgtgagagggtcgtgatcgattgagcaagcagggggtacgtgactgggggctgcatgcaccggtaatcagaacgcaacagaacaggacagggattttcacaatgcttttccatacaatgtctgaaatctatagataacataaccggttaggtcaaggattgatctttaaccaggcccagggcgcggcgccgggctgtctgcctgtggattttatttctgccttttagtttttacttctttatttggaagcagaaattgggcataagacaatatgaggggtggtctcctcccttacttctgcckcctgggttcaagcgattctcctgcctcagcctcctgagtagctgggaytataggtgcacgccaccactctctgccaatttttgtatttttagtagacctggggtttcgccacgttggccaggctgtcttgaactcctgacctccagtgatccatccgcctcggcctcccaaagcgctgggattacaggtgtgagccaccgtgcccggccgggagtgggtagatttgatgtgcgtgtgtaacaggcagaggttgatggagtaacagggaagtgaggctcctaggattttggtctgagcaattgggtgtggccatttatcatctcaataaatgtctgcggggagcagggtgaagtatgggggtggagccatgagctccttttcacacttgctgagtttgaaygggccgtcagtcaccaaggagagacgtctaatcagcagcaggatataagattcctaagcttagggaagggtcagtgctggagatgtaatttggaaatcgtcagcacataattagtgttgaaacatgaacctgggttagttcatccaaagagagagtaccaatatagggagtgaagggttaagaccagatagcaggtgctgggggctctccaggggcgaagcagcagaggaggctgagggggagcagtcagtgcagtgggaggagaagcggatgtgagtggcatyagagaatccagggggagaataaaccacatcagatgctgctgagaggctgagaaggacgaggacagagagatgggaaccagatatggcactgagattgtcagcaagtccaccgaaaagggttttctttttttttgtttgttttgagacggagtcttgctctgctgcccaggctggagtgcagtggcgtgatatcggctcaccacaatctccacctcccgggttcaagcgattctcctgcctcagcctcctgggtagctggaactacaggtgcacgccaccatgcccagctaattttttttttttttttgagacgaagttatgctcttgtcgcccargctggagtgcaatggcgcaatctcggctcaccgcaacctccacctcccgggttcaagtgattcttctgcctcagcctcccgagtagctgggattacaggcatgtgccaccacgcccggctaattttgtacttttagtagagatggggtttctccatgttggccaggctggtatggatctccagacatcaggtgatcctctcgcctcagcctcccaaagtgttgggattacaggcgtgagccaccgcacctagcctaatttttgtatttttgaaaagagacggggtttcactatgctggccaggctgatctcgaactcctgacctcatgatccgcgtgcctcgtgatccacctgcctcggcctcccaaagtgctgggattaaaggcgtgagccaccacacctggcccaggttttctttttaaaaaaggaaaaaaactttgttccagcagtttgtaaaccagggcaatgcagccttctgtacaaaggtgcattccagggaacaaagagaacaaagaaagaggtcgtcttttgtagagaacttcctgcccaggttcccactttggtccacttatgcaaatgaggaaggcacacttgcttagttctgattggttaatacttgctgagttcagattggtcgatgcaggtcacagtcgatgggttgattctggcgrcataaacaggaacagatagctgtgaaaccatcccagagttaagtgagagtgggggctttccaggaacgcagaatgtgtgtgtgaccctagtcagcaaatggctgctaggtcctactttgaatttaggcccagttagtaacttgggatccatcaagaaggattggctctttcagggttcacaaagttattggtgaccttttaaagatcaatttcaatggtatgtgggaattgaaggcaaggaagtggagatagccactgaaaataatgtttctaagttcttaaagacagccagaaacagggctatggcaggaggacagtgtgggtcaagggaaggttgttgattgtaatcaagagacaccagagtgtctgggcttggtggctcatgcctgtratcccagcactttgggaggccgaggcagtcagctcacctgaggtcaggagtttgagaccagcttggccaacatggcgaaaccccacctctactaaaaatacaaaaactagccaggcgtgatggcgggtgcctgtaatcccagccacaagggaggctgaggcaggagaatcacttgaacctgggtggcggaggttgcagtgagccgagatcgtgccactgcactccagcctgggtgacacagcaagactctgtctcaaaaaacaaacaaaaaccaaaaagagacaggagagtcattcatgctgatggagtgagccaggtaccaggatctcgatatctaagcatgcccccttctccaacagcctccttaccttcctgcatgaaagcacacccttccctccagtcccccattcctttattctgctgtatttttctccataacacttaccacctttgaacatactacatatacaacatgtgtctgtctagcaactttgctgtctggctctcttccctagaatttaagctgtgagaggccgaggctgctgtctgcctggcttggggctgctttcctggtgtctagcacagagcctggcctgtttcaggggctcagtgaaacatttgttggctgaaggaatgaatgaatggctctagcagaggggcagaaactaacgatgcaggaggagagagctgggaagggatccagagccagggcctggcaggaagtgtaggtgtgtcctccctgatcgcagargaggagagaggctgcactttgaggggtggaaagacaaggtgaatccccctgctggtcatcagcttgtgcggctctgtgggtgtaaaagagtggtttggagcatgtgaagtgagtcttccaggagatgaaggggattgccaggccgtttgtgatgatgctgagatctggtgccgtgcagcctgcttctgcgactctcctcatcaggcgcaggcacagagtaggtggagagttgagccagaaccacgatgtctttggcacagcctctcatctgtcagatgggagcggggaccccggagagggagtcagccgaggtcctggcattcctygtgaacccccgtctgtgggtttctggtccagtgtcccttctccagattagatggcttaggcctcctctaagggggtgggcgtgcacatccggagagctgtctggtgtgcaggactgggctgcaggttaccctgaactgcaaccatcttagagcaaggcccagcttgcagcaggaggagctgcaggccgcccaccctagccacggcccctgccctggcaggaagcttccaagagtaaacactgcctaatcgtcccgcccagtagtgagcaggcctgtcccattccatactgaccagattcccagtcaccaaggccccctctcactccgctccactcctcgggctggctctcctgaggatgcaccagcgtcaccccygggcaagatgccctcccctctgtgtggccggaatccttgcctgtggctttctcctgggctgctggggaccctcccatttccagcaggtgggctcatttgcaggagcgggggtattctgggagcctctgggtggggtattctgagctacctggggcgaggggagtgccaaatagctgactacatcagctttggggtttgcgctgggcaggggagtctgtacttggggctttgggggatgaagtgtgctcactgaagagggagttggtgtctcagtacgacctgctcattcggtgaagctgaacagacagatactagtttgtcccaaactgtgtaggttgctcttctctgcctctcccttcctctccctgtctctgatttccccctctccttcttggttggcctcacccacctcctgcctcctgtctccctcttcatccatctctttttgttcttttttctttctctctctctctttttttttttttttttttttttaagacatggggtcttgttatgttgccccagctggtctcaaactcctggactcaagtgatcctcccacctcggtctccccaagtgttaggattacaggccagagccactatgcccggccccatccatctctttttgtcttgcagagttgtcttcaggctttggagccacaggccgtgtcttcttacttgagccctggtgctcccttaaaaggtacttgtcctggtgtcttctctcccggggggagtttctcaggactttcaaggggtatctcaccactgagtcagtggtctgggatttttggtggatctggaaggagaaggtcagagaagctgctgtcaaccctgttaattaactctgttacttcctgccaagttgatataagctggtctgggtgttccagccaggccagggttctcaccctagcttctgttaaatatcacaagggaacggtcaccgattggctggcccctcctgccccatggcctctgctgagctggctgattttcaggagctcttgtggtttctgaccgtggatgtaaatatttattccttctgtgggaaacaagataggtactggctcaggctacctcctaaggccatggatttccttatgataaaggcctgtccccattgcccacaggcccatgtctgtgaccttctccggtgcgagcccccttcccagtagggccattggcaacttgactaatggctgatggggrccagaggcaggtgggctagtggtcaggggcaacaggagggcaaggcccactttgtgacctggttctttgtggtctaggccagaggcacactgaccagtgcctggggccacgctgggggctggatgcagccgacgctgtctgggtatcccatagcctgggtccttccagcgctgccgctcctgaaaggctgggagatcattgcccagggtccctgaccctctaagggctcccttgggagaggacagtgagggctggcctgggcccctgcttcccaagagaccactgggctccactcgtgttcagtttcctgtcggggtccatgatgttacttgtgaaacacctgtgcccagagcagggtccaggaggcagggcaggggctttcccctttgggcagagccaccagggcagtgggaatcttgtcttgatggggtgasccaaagcacacaatagcccaacagctcctcctgggccctgccctttgcgtgcctagtcactratggggtctggctcttggggtgggggtgacacgcaatgtcttgacttcggaaggccatccttccaagacctgccagcccctytcctgttagctttccactrcttgctctctagaaccatcgccctctgctytccctctccccctccaggccgccctccttcccctggcttccagaggcagaggcagaggcagaggcgggctgcaggcggcatcctacacctggagctgctggtggccrtgggccccgatgtcttccaggctsaccaggaggacacagagcgctatgtgctcaccaacctcaacatcgtgagtgccccacgctggactgtgcaggtccccacggccagggctggtgaccaatgtctgtgggctggtgtatctggtagtctgaatacagtgggttaaactcaggtagaatggctcggggttcttcctcttctccctccctcccmtgggtggaggtgggtgaggtcccacaccctctctaggctccatggcacatgcacaccctgcagcctctcactactcaagtcccttcacctggggccaccctcaagcctggcctcttccccagtatccatttgacccccacaaagctcagctaaagcaaccctggcaaatgggatacgggctgctcacactgccctctgcaccccgaccctgccctctctccattctcttgtccccygctcagagtggcgaggacaggtcacccgtctgaagtctaaacagagactgctggcaaaggagatgcccaccttcatttcttgctagcacctgaatccctgcagccccccttcacttgaaagctggggaagggcgggcagggaagcactcccccactagccgccgtctcagaaagacaaacaaggccaggcgcggtggctcatgcctataatcccagcactttgggaggccaaggcgggtggatcacccgaagtcaggagttcaagaccagcctggccaacatggtgaaaccccgtagctactaaaaatacaaaacttagctgggcatggtggcaggcgcctgtaatctgagaggagcctgcgatctgagaggagcagcgtttgaccggaatatccgactcgtgaccatctgtgtgctctcatccccttgctttggagtttgttttccttgcgttagttggccttcctgagccatgagctgaggagcaacagaggcacggctgactgtgcagcacattttaggagccccccgccccgcccggttcccacacatgctggtggagtagcctctccagctcttcacactccgggggcccctgggagtcagcagctgcctggggctggcaaygcccacccgacgggttacctctctcatctgcccttgcacagggggcagaactgcttcgggacccrtccctgggggctcagtttcgggtgcacctggtgaagatggtcattctgacagagcctgaggtaggcatggagctggaactcagcacaccatacagagcgggaagcccaagtcatcgcatctycatcctctttaacctcttgtcccggatgccccaagcagcatggatcacagaatgcattcagccagacagaccagctgccctcccagctctacccagcactcagcacaggctgcctgactacttctctgagcctcagttgtctcatccctaacacgggctagtcatagggttgttaggaggactaactgggaaacaaaccgaccgcagtcagcaccgtgcctggttggggtgtcctaaatgcaggctttgctgtgggtccgcagggtgcyccaaatatcacagccaacctcacctcgtccctgctgagcgtctgtgggtggagccagaccatcaaccctgaggacgacacggatcctggccatgctgacctggtcctctatatcactaggtagccgagctttctgatgggtgctggccagccagcctgggaaggctgctccctcagcctcctgccctctgcaaaggtgaccccagggcaggcacgtgccttgrcaccacccaagtgactgttttctctcaccgaggtttgacctggagttgcctgatggtaaccggcaggtgyggggygtcayccagctgggcggtgcctgctccccaacctggagctgcctcattaccgaggacactggcttcgacctgggagtcaccattgcccatgagattgggcacaggtakgtagccccaccagctgtccccaggatctggcaaggagctgacctgggtacccagggtggaggtggtcttrgcaagcagtgggtccttgtagagtttctccagaggagcctgtacccctcaccccracagactcaggtgtgaggacaggggawcctgatactgtttgattaaaagaactttttttccaaaagacgagcaagacacctttagcaggtagaaaataacttctgtagaaaattcaggtaaagaaagagcaggctgtaaaaattatctcaaatcccaccatttagagataatgtctcttcacattttgtatttaatttcagtcttttctttacatacacacacatatttcttatttgcaaaattgggatttagtttggatccctgaaaaaaaggaaaattgtgattatgctgtgcattgctttgttacctgctatttctttttcttttcttttcttttttttttttgagatgaagtttcgctcttgttgcccaggctggagggcaatgacgtgatctcagctcattgcaacctccacctcctgggtgcaagtgattctcccacctcagcctcccaagtagctgggattacaggcatgtgccaccacgcccagctaattttgtatttttagtagagacagggtttctccatgttggtcaggctggtctcgaactcccaacctcaggtgatccacctgcctcggtctcccacagtgctgggattacaggcgtgagccactgcatccagcctttcttttttcttcctagggtaagtgcaggatttacctgttctttatgtaataatatatcccaaacattatcccaggtatcttagaggtgtgcaccgtaatttatttaatcagtcccctcttcttggatgtctaggttgtctgaacacgtcttcctgttgtgaatgttatgcattcttgtgggcaaaccttcactcttacctataaccatttacctagagtgatgggtttcttttcatttctttagttttttaagtatgaaaataatacccaattgttgtaaaaattcaaacagtgcagagatttctaaagtaaaaagtgaatttccacattccttgcccaccaacccccacccgacccctttcaacccctctgagcctgggagggttgaggcagggttcctgggtgtgggacaaggcagggctccttctccctcagagggagcatagttcccttctgctcctgtgatgcagaagacgtgagcccccaaactggggcttagcctgggrgggttcttggcttcaccgaggaaagaattcaagagggagcaggtggtgttagacagcaactttgattgatgtggcagtgggcagagtgtacagccctgtgactgtatacagcacagcatagccccttttgaagccaggctaccccatagacactgtgcccaaaagagcagctcaaaggcagggctgcagtcctagttaatacccacttctaattatatgcaaattaaggggccagatkatgcagaaatttctagaaaaagggcagtaacttctaggttttcgtcatggaaaaggggcagtaacttctgggttttgccatggcaatggcaaactggyatggcacactggtgggcgtgtcttatggaaaggggcttcccacccctccctgttttagctagtcctctggtccagtgtccaagcggggcctccagagtggagtccacctcctacctcaccggtgcctggcctctcccaccccattaggagtcctccatcagttccgctttgggtaaagcaagctctgttgtgacagtttggaaacggttcaccttcctggcctaggaatgcaaacaatggccaagggcaagcacgttttaactgaactttaaaatcgtgctttcctcacagtaggtgaatttcacgctcaacacatccatgtaaacagtccccagagcagcccttcaaggccccggccagtccccacctccccacagactcctaacaccatgatttaatgtggcttgcacatttttaaaggcttttgatatttattagcaaaagatgcgagagccaccctgctgggctagcgctcccttctgggggaaactgaggcagggcgcacgcgaccctctccactgcgcccagttagcagatggcggcgtcaggggtcgacccgggtcggaaaactcgctggcgctgcggcactagggcgccgggccgctgactcgccgacccccgtcccgcccccacccccgcccccgccctgccggccgccttagcgcaactccccgccccccgaccagcttcggcctggagcacsacggcgcgcccggcagcggctgcggccccagcggacacgtgatggcttcggaacggcgccgccccgcgccggcctcgcctggtccccctgcagccgccsgcagctgctgagcctgctcaggtagcggccgccccgtgggaggggcgcgcgagcctccagtccagcccgctgggcgcgccagcgccacctctctctacgtccgtccccacgtccgtcattgcaggcccttccttcctgtcccaacccctcccgtccaacccagcccctccgtccaaccccgcgcccaccgcctccgtccgtggaggggcgggcgcgcgacgcctggcagccagcccgctgggccgccccgcgccacccctccctacgtccgtccccacctctccctacgtccgtccccactccgcattcagccctccttccggtcctacctctccatcctgacccactcctccgtccaaccccgcgcccacagttccgtcccaccccgctgcgcccaatcctgcgcccacccctccgtcccaacccgtgcacccacccccccgtcccacccacctgccccaccccctgcacctccccccgtgctgtcccactgtgcggccacccttgtgtccaacccctgcgcccaccgctccgttccaccccctccctgcggcccacccctgcgtcctccctcgcccccttgcgcccacactttcgttccagccaatgctgggcacgcacccctccgtccatccccatcccgccccttgactccacatacactccctggttctctcccacttgcctacacccacccctgcatcctaccctcctccatccacccctccatctcagccccctgcacccaccccgttcctgggcccaccctgttcctgcacccaccccctcacttcacccccttacccttcgtctgcctccacccgcccctacccctccgtccactctccacgctccatcagtcccacacccctatctcccccacccgcgtacatgtatccctgcgtccccttcccgccgaccgcaccgctcccgggcctaacctgcatctgctccatcccactcagacccgtccctccgtcgccgctccctctgctggccacccacctctgcgccggcaggagccttagtcttggtcccagccaagagccggctcctggtggggggcgcgggccgagaactcctgttcccactcacaaaaggccacgcttccaaacgcttccatcctcgtgcccactcctccgtcccgcctcctcccggtgtacaccccgggactgagccgggcctgagccgggccttgtcgcagcgcaggacgggcgcgctgcgtgtgggacccgccgcggcctcaacccgggtccgcggggcacccgccggatgcgcagcctggcctctactacagcgccaacgagcagtrccgcgtggccttcggccccaaggctgtcgcctgcaccttcgccagggagcacctggtgagtctgcyggcggtggcctgggattggctgtgaggtccctccgcatcacccagctcacgtcccccmaaacgtgcatggtgagaacctgctgggtgccgtgctaggctgaggtactaagccagggcggcttagtttaatgctgtctgtgccctctagaaattatttaaaatgtttgaacaaaagctccaacakttttgtttgactgggccccacaaattatgtagctagtcctgsgagggcccctgtgcccaaggactcctggctgagtgaggacaccaatcttaaacagttaccaaggacttccccatckattgtggctggagtcagactggagggcttcctggaggaagtggcctctaaactgaacccacagcagaagtggggctggtagggggaggggagatgaaggagagcaggcaccccaaaagacagacttcctcgcaggattgcataggacattcatgggctccaggcacttttgccttgatgggccccttcctccacaaaaaaattgagaattatgttttaatattcttatacaatgtataaagttttatgtgttactataaatacaagtctttttttttcctttttttttttttttgagacagagtctccctctctgctcactgcaggctccgcctgccagattcacaccattctsctgcctcagcctcccgagtagctgggactacaggcgcccgccaccacgcctggctaattttttgtatttttagtagagacggggtttcactgtgttagccaggatggtctcgatctcctgacctcgtgatccgcccgccctggcctcacaaagtgctgggattacaggcatgagccacagcgccccgccaagtctttttttttaaattmttttgagacagggcctcgttctgttgcccagggtggagtgcagtagcacaatcatagctcactgttgcctcaacttcttgggcacaaacgatcctcccacctcggccttggagtagctgggactacaggcacatgccacaatgcccagctaatttttaaattttttgtagagatggggtctccctttgttacccaggcttgtctaggactcctggcttcaagccatcctcccacctyggcgtcccaaagcactgggattacagacatgagccaccacccacgcctgatcagcaaatctattaatattatatattacaacattaattttgacctggaagttcattttttcatttttttttttttttgagacagagtctcactctgtcacccaggctggagtgcagtggcacartcttggcttactgcaacctccgcctcccaggttcaagtgattcccgggcctacgcctcccgagtagctgggactacaggcatgtgccaccatgcccagctaagttttgtattttttagtagagacagggtttcatcatgttggccgggctggtctcgaattctgacctcaggtgatccgcccgccttggcctcccaaagtgctgggattacaggataagccaccacacccagcctagttcatttttttcttctgattttattttatttatttatttattttgagacggagtctcgctctgtcacccaggctggaatgcagtggctcaatcttggctcactgcaagctctgccttcagggttcaagccattctcctgcatcagcctcccgaatagctgggactacaggtgcctgccaccacacccggctaattttttgtatttttagtagagatggggtttcactgtgttagccaggatggtctcgctctcctgacctcrtgatttgcccgcctcggccttccaaattgctgggattacaggcgtgagccacagtgcccggcctttttccttctgattttaaaagaaattaggccaggtgtggtggctcacgcctgtaatcccagcactttgggaagccaaggcaggcggatcacctgaggtcgggagtttgagaccagcctgaccaacatggagaaatgccatctgtgctaaaaatacaaaaaattagccgggcgtggtggcgcatgcctgtaatcccagctactcggaaggctgaggtaggagaattgcttgaacccaggaggcagaggttgaggtgagccaagatcgcgccattgccctccagcctgggcaacaagagcgaaactgtctcaaaaaaaaacaagaaagaaaaakaaattaaaacatttgcctcttragcttcaagtcagtgacaagttaagaaggaaaaaaagaaaaaagacacaaaaaacacatttccatgggcccccaaaagtgtgacaggacctggtcatggtcccggttccccatcgatgggtcagtcatgccttgtcctctgagggcaccagtgcccacggtgcagagtgttggctgtgtcagtgtgtcctgcagtctgggagggacagttaaggttggacactggcctggaaggccctggtggcccctgagctcgccacccacctgtccaccctcctaggatatgtgccaggccctctcctgccacacagacccgctggaccaaagcagctgcagccgcctcctcgttcctctcctggatgggacagaatgtggcgtggagaaggtcagagccaagagtgaatgagtgggctcctgtgagcacgtgcacgtgggtgcctccagccaggccrccctattcctaggtcaggagrcaggaccagtatggggcagagagtcttggagttggccttggggactgtcctttgggttggtggtctgacctctttcctttagcatttgctcccatgcagaatgggaatgtgggctgcctgttgtatggggggtgcccatgggtgtggggttcctttgggtggggtccctgtgtgaaggtccttgtggatatggggtgtctcgggggggatccctgtgtaaggggtccctgtgagtgtagagtccctgtgggtggggtccttatgtgtgtgttggaggatccctgtgtgttgaggggtccctggggggttctgtgtgtatgttggggggtctctgggtgttggaggatccctgtgggtctgggggatccatgtggctggggtacctgtgtgttggggggtctctgtgtgtgttggagatccctgtgtgttgggggatccctatgggtgagttccttgtgtgtgtttgggggtcgctgtgggtggggtccctgtgtgtgttggggatccctgaggatgttgggggactctctgtgtgtgttgggagtcctgtggtggggtcactgtgggatgggagatgaagccatccttgccttgcagtggtgctccaagggtcgctgccgctccctggtggagctgacccccatagcagcagtgcatgggcgctggtctagctggggtccccgaagtccttgctcccrctcctgcggaggaggtgtggtcaccaggaggcggcagtgcaacaaccccaggtaccgcagggagggtgcttttctgtcagggagtgtggccataccatagtccctagttgaaggcagtggtcaccctgctstctcaccctcctgtctgctgggcattttcagacctgcctttggggggcgtgcatgtgttggtgctgacctccaggccgagatgtgcaacactcaggtaggcctgcttcctggggtaggagggggcagctggtggcaccgggccctgggggagccaaagtgaccatctgtggttcacaccaggacacatttgagaaggacattggggccaggtgaggtggcttatgcctgtaatcccagcactttgggaggccaaggcaggtggatcacctgaggtcaggggttcaagaccagcctggccaacatggtgaaatctcgtctctacagaaaatacaaaaattagccgggygtggtggtgggcgcctgtagtcccagctactcgggaagctgaggcaggagaatcacttgaacccaggaggtagagcttgcagtgagccgagattgggccattgcactccagcctgggcgacagagtgagactctgtctcaaaaaaaaaataaaaattaaaaaagagagagaaggacattgggaccccagttcataaaccaggccagtcctgctgatgcccacagagcccctgaagcgtcccgcctccctccctgagtgccactttgccctccagagcgcatctctgcagggagaacctccccactaggaatacagtgygctgctgcatgcctgcaaaggaattttttaaatattatttttatttttttagacagagtctctccctgtcacccagactggagtgcagtggtgctatctcagctcactgcaacctctgcctcccaggttcaagcgattctcctgcctcagtctcctgagtagctgggactacaggtgcccgccaccacgcccggctaattttttgtatttttagtagaggmggggtttcaccgtgttagccaggatggccttgatctcctgacctcgtgatccgcctgcctcggcctcccaaagtgctgggattacaggtgtcactgcgcctggccgaaggagtcttttatttataaattgaggtgacattcatgtagcatgaaatcaagcattttaaagtggcaactcagtggcctttagtacactcacaaggttgggcaagtactgcctctgtctagtttcagaacgtttccagtactctggagtactctggagtgaaccccatatggtaggctgtcactccccatttctcctccgccactcagcggccattggtttcccttctgtctctgtggattgacctgttctagacatgccacgtacctgaggccagacaacaggtgtgcttcctgcctgccttcctcccccagcggcacgtccccaaggctcacctgtgttgtagcctgtgtcagcgcctcattcctctttctggctgaatcatattccactgcagggatagaccacattttcatccagtcgtctgctgatggacatctgaggtgttttcaccttttggctcctgtgaacagagccgctgcsaatgtgcttgtacatgtttgaatccctgttttcaattcttttggcagtatgctgaagagcggagttrctggatcgtatgggaattgtatgtttgacttttttttttcttttttttttttttgagacagagtcttgctctgtcgccaggctggagtgcagtggtgcaatctcagctccctgcaaccttcgcctcctgggttcaagcgattcccctgcctcaccttccggagtagctgggattacaggcacgcgccaccatgcctggctaattttttgtatttttagtagagatggagtttccaccacgtcagccaggatggtctggatctcctgacctcaggtgatctgcccgccttggcctcccaaactgttgggattacaggcatgagccaccgctcccggcctatgtttgactttttttttttcttatttttttctttctttctttatttttttttttttagagatggagtctcgctctgtcgcccaagctggagtgcggtggcgygatctcggctcactctaagctccgcctcccaggttcaccccattctcctgcctcagcttcccgaatagctgggactacagacgcccgccaccacgcccggctaatttttttttgtatttttagtagaggcggggtttcaccatgttagccgggatggtcttgatctcctgacctcgtgatctgcctgcctcggcctcccaaagggctgagatcacaggcgtgagccaccgcgcccagcatgtttggcttttaaagaaactgccaaaccgttttccacagtgcctgaactgtttcacattcccaccagcattgygccagggttccagtttccccacatccgctgcagcacttgctgttttctgttgttgttttttcttttctcttcttttttttttttttttttttaatagagatggggttttgtcatgttggccaggctggtcttgaactccgaccccaggtgatccgcccaccttagcctcccaaagtgctgggattacacgygtgagccatggcgcccggcctgttttctgttttttgattttggccatctcggtggtatgaaatggtagaaagattctttttacattgagttaaattctatctcctgcttcgatggccctgggtgtgggtttgtccctggctgtattacagttctgcatgtggtgagaccctccctttcctccttctccaaatggaccaccaagacctccccagaccgtgaggggagggtctttggctggagcacagggtggtgggatttcgtggaggcagtgtggtcagtgtggctgtccagggagtcaactccggttatcttctgtcagcccataaaagtccaagacgcctgcctgagtgcagaggcttcggtggtgaggtctttgctccatgctttggttacctgcctctaggtgcactacctaaagaatacacatccccgtccctgttttattgagttcaggccttggaagcagaggctctgagcgtaatgctctttcctggctttcttcttcgttgctgccctgtgttctttacggattccccggggttttcccatcaatagagagaggcaggcacttttgtcaccccagtttacagagcagggaaccgaggcacggcctggagctgaggccacacccacatcttgatcctgtactgtagggtgccatgtagtctcccagtgacaacacccgccccccgccccaccgccatccccctcctctgcctcctcctggccaggcctgcgagaagacccagctggagttcatgtcgsaacagtgcgccaggaccgacggccagcygctgcgctcctcccctggcggcgcctccttctaccactggggtgctgctgtaycacacagccaaggtggggcctgcggagtgtggggttgggggaggagccagccctggagaccctcggacagggcagagtcataggggggttggcctactatccctccagcactgggcaaagtggttcaggctctggcatcccacaraccatggatgacatagtggccaggcctcgctggtagatcaggcactgacatcccatctctgagtctcaatttcccatctgtgaaatggagataatagcagtaggtccctccctgggcgctacaaggattcagggagataatcggaaaatgccaagtgtgttccttggttcatgatactttttttgtgagacagagtcttgctctgtcgcccaggctggagtgcagkggcgtaatctcagctyactgtaacctccgcctctgggattcaagggattcttgcccctcagcctctcgaatagctgggactacaggcttgcactaccatgccggctaatttttttgtatttttagtagagatggggtttcgccatgttggctaggctggtttcaaactcctgacgtcaggtgatccgcctgcctcggcttcccaaagttctgggattacaggcatgaaccattgcgcccagccttggtycctaattcaataccattaattattagattagattaggatcgtgattaggattattgccttaggaggtgggatgtggggaagatagaaacccttgccccagatgcaaaggatgaagctgggtgggggctgggggacttgcccctcctgctcggttcaggacaccctttttcactctgccctcccaggggatgctctgtgcagacacatgtgccgggccattggcgagagcttcatcatgaagcgtggagacagcttcctcgatgggacccggtrtatgccaagtggcccccgggaggacgggaccctgagcctgtgtgtgtcgggcagctgcrgggtaggcgtgtgtggacattggcgatggccctggggcctacctgtcctatcggaaggctcctgggggcaggttggtgggtgctggccctgatggagctgcagtgccstctgcaggggagtggtgctggggaaaaggatctggacttggagtcagcctgggttaagggctgcagtgtgaccttgggcaagtcactgagccctctaagcttgcttcctgtgtagatggtggggtgctayagaagtgttgctggttttgtggatcccagaatctcagagctggcagggctgcagagtcattgaggccagcaccctccagtgacacgggccctctgtccttccctttgcatagacatttggctgtgatggtaggatggactcccagcaggtatgggacaggtgccaggtgtgtggtggggacaacagcacgtgcagcccacggaagggctctttcacagctggcagagcgagaggtaggcggcctccctcggggcagaggctgggcttcccccagcctccaagatggccacagcccagagcgttggtgcaggggctgctcaggtcacagggcctgcacactcactcagccctggatgcctcctgtggtgtcagcgtctccctcttccacttcgccacccttctgtggcaggctcaggttttggccttgatgctgctgggactgtggtgcctcagtaatggtcactcactgtagccgtgctgcaaaaaaaacacagacattggccgggcgctgtgctcacgcctgtactcccrgcactttgggaggctgaggcgggtggatcacctgtagtcgggagatcacctacagcctggccagtatggtgaaaccccatctctactaaaaatacaaaaattasctgggcatgatggcgggcgcctgtagtcctagctactcaggaggctgaggcaggagaattgcttgaacccaggaggcagaggttgcagtgagccgagatccctctgcactccagcccgggcaacagagtgagacactgtctcaaaaaaaaaaaaaaaaaaagtatggacgttgtgcattctgtggcagctaccctcttctctcctgctcaagaaatcccactgagagggacacaagtgaatgagagggwtggtagttacatttggaaaatctttgactttggtgtatatatgaggtcaaaaaccatttgcaaatgccagtgcttctatggagagcagagacttsagccctgcctccctctggcttgccccactgtgctggagaaccttggacccggtcccttctcccagccagggcagagccttggcaggtggtcctccagcctgcttttaattgcccccatgacaggggactcactgctgctggagccagccccatggcattgttcaatttttcccgaccagctaagatcagctccctttgtctgtggtgtggtggctgtgaggtccacgcatctctccttcttttcttctttctagaatatgtcacrtttctgacagttacccccaacctgaccagtgtctacattgccaaccacaggcctctcttcacacacttgggtgagttgactggaggactcccacccagttagctagactgcaaaggtgcagagcactgttgccaagatgccctcacttctgacatcacccgcaagttcagggggttccccaaaccaccctcaggcttgatagttgactaggaagactcccagagctcactsagagctgtggcacatggctgcggctccttccagaagaacacaggttagaattgtccaagggaagagatgtaggcagagtctgggagggtccaaccaggaggcctgatgtctcagggatgtgacacccttctagcattggagcgtggccatacgcatggagtattgcccacacagaaagcccactgagtgggagttgagagtttttcctggggtttgagtgcaaagacatgattgactaattggccaggtggatactctcagtctcttggtgacccagcccctaycctaaatcacatagttggtctttctggtacagccagcccctgccctaaaggaggacacttctgcctggtgtgacccgtgtttcctcttggaagccaacagcaaaagctggacttctctttgggcaaggcccgcttctttgctattgagggccacagtgggtctttctggagtgtgtctgcacctaacctttgaagccttggttgccggcacttgccatggggtccctgagccctgagcctgttgagttctgtgcgtgagtgcrcttggtcatagcactcaccaggttgtggaaagaggcctagagcctccgctgtggggaagcctctagctcagatgcctgtggctccttagaggagggctggggaccccgggaaggagagtcactgacatgtgcctgtgaggaggatgggtgctcagctccacacrgctaacagggctggttccycgacagcggtgaggatcggagggcgctatrtcgtggctgggaagatgagcatctcccctaacaccacctacscctccctcctggaggatggtcrtgtcgagtacagagtggccctcaccraggaccggctgccccgcctggaggagatccgcatctggggacccctccaggaagatgctgacatccaggtcagcaggagagcctgggggaggccagtgggggcttcttctygggggctatggctgcttgctcgtttgtctatccatccattccctgattcgttcatttattcattcagcggtcacttacaggggacccactatgtgttgggccctgtgctaggcaaaatgtagctagctcctccaggggcttagggtcccacaaatatccaaatgtgyctgtgcccagagcccgtgggagaaggccctgcagttctgggatcaggtaaggttggagggcccaatgcaggggtccagggctccctgggaaagagtgatggagctgaggtgtcagatgagcagatgttgctgggccaagcagggaaggaagcgtatggctgagggaacagtgtcagtgtgggagggatgaaggaaggtcctactgtgtgggtttgtggggagatgaaggcatggacgcaggtgcagtggcatctggggagtaggccttggtgctgaggaagctgagaacagatgctggctctcactgcttctttggtgcagtgtgtgtgggaaccggaaggccttgttcaggcgtgtcctcagtgacgtgtgctcgcccatgtatgtccccattggtgcttcgctgaggaaggcacgtggagggtggagagacataagcgcaggctgaaacagacctgagaaccttgggagaggggcccagtctcagcggccggagcagcgtcctctgcccctacagcagccagagacaggagggcctcccacagatcaggccaggccgggccaaagcaagcccctgtgagcggcttatcccttctcttcccctgatatggttcccttcctcccctccccttgcctgggacattgtatccagatgctagctgccgagtggctctcccatcatcctctgcagtgtgtaaaaaagcagattcccgggtcctctgcatattccctgaatcaggacttccctgtgttgggcctgagaaaccgcaccgtaaccaacacaggcttgcggcactggccagatgtgggcatcgagggggcaggtgcggaatgtcacctcgccctgggctctggcctycaggctggcctctttcttgggctggtcttgggcacaggacccagttaccctcctgaagagccttaggcccaggaacctgctgaagttcttcctagtgctctccgggccagtcccaagccagtagctggccacaggtccccagggatccagtttcttcctgccgaccctaccacaggtccccagggatccagtttcttcctgccgaccctacgggcctcagctctggctccagaagcactttctgtgctggccctgccctagcccttcttgggctccttagcccagcctaaggtgggcctgcctcctccactgcactttatcctctacccagccagcttagggaaccttctctgtgctgcccaaataccctatcrtgtaacccaccaatgacttggtaattacctccccgagccctctatcccaacccactgagagctccttgcagctcagccagtgtcctgtgcactgtgctatccccagagcctggtacaggtcagtgttggtgattgcttcccgttatttttgtctttgttgtttttttagagagggtctcactgttggccaggctggagtgctatgttgcccaggctgctctgaaactcctgggctcaagtgatctgcctgcctcaggctcccaaagttttgggtttacaggcatgagctaccgtgcctggccagtgattgcttgctgarcgaaagattatagggatgcaagaagaagttggaaggcttcccaggggaggtggccatgacagtgaccctcagggaacccactggacaaggcctgaagctctttgtctgcaggtttacaggcggtatggcgaggagtatggcaacctcacccgcccagacwtcaccttcacctacttccagcctaagccacggcaggcctgggtgtgggccgctgtgcgtgggccctgctcggtgagctgtggggcaggtgagacctggggaaggctcatccacagcacggcttgcccctgcagggaggcggcctagccctccctcttccctcccagggctgcgctgggtaaactacagctgcctggaccaggccaggaaggagttggtggagactgtccagtgccaagggagccagcagccaccagygtggccagaggcctgcgtgctcgaaccctgccctccctagtgagtgtggtgctgtctgcgcagctccaagggggagagagggttccgctggggctgctgggctctgtccctggcctatggggcccatgtggcagggccgggctgagctgctcctgtgcaggctctcattacccctgcccacagccctgcaaggggggctctgtgagtgcccccattctgcaggtgaggacactgaggcttggggcagacatggtgacaatgtcagcccagtgggacccacacctgctgccaccttgtctgggccaccgaggcctctcttgagctcaggtactcatggtgagatggaggtgattgcctacctggagggttgtagggagacttgcggagctcctggtgcaaagcccctggctgtcaccacacctgacggggcacactgttagggacgaggccattcctgctgggtgcaggacagggcagctgctcaccagcctgtgattcggttgtcctcaggctcagccgtctggcagcctgggaacacctggagaggctaggctggccgtagtgcccattgcttgtcccagaccgggggagtacatcagcacctgccaccccatcaccccaggccagcctgggacctggccagggtcccgacgctctgtctccttcctcagctgggcggtgggagacttcggcccatgcagcgcctcctgtgggggyggcctgcgggagcggccagtgcgctgcgtggaggcccagggcagcctcctgaagacattgcccccagcccggtgcagagcaggggcccagcagccagctgtggcgctggaaacctgcaacccccagccctgccctgccaggtgagcccagggctaggtggggctgggagagggccttcctggcagagctcgtccctgcgctgagcccccatccttctgagaatcccctcctcctgaggcctccggcggggcctcaccatccagggtgatgggcagtgtcacctggcggttgtaagtgctgctgtcagagttccttactacccaggagagcctgggcccattgtttccctctctgagcttccgagcccctgctctgaaatggggatgccgacctgcctggggagggggggcttcgaggatgaggtcaaactgaacggagtgggagatgtcactttctcatcaccaccatctcccccgtgcccacgtggctgcatctcatcccctcagtgtccaagttgacagtggcttatcatcctgccctgccactaacgagctgagtgacagggcaagtcccctcctctgtgggcttcagttttgcgacctgtccggtgggaggggattggtctggattgttggtggcccactcatagctctggactcctttccccgcctcgtcatccgtggcagacaaaacagtcaccactcttccccgctgaggccagatagggcctcagaatccttctcacacagctctccaggcagccactttagcgcagggctgactcacagctgaaacccattggccacccttgaacctggtgatccaattccatgtggcacctgtttctctgcacctgctatggtgcatggagtcagtgattacctggctggaggtcggcctctgcctctggagagtaggagggatgggttctcttttttttttttattaaaagacagagtcttgttctctcacccaggctggtatgcagtggcatgatcttggctcactgcaacctcctgcctcagcaagtgtgcgccaccaagcccaactaatttttgtattttttgtagaaacagggttttgccatgttgcccaggctggtctccaactcccgggctcaagcagtctgctcacctcagcctcctaaagtgctgagctaccgtgcctggccagggataggttctgtctctgcaccctgggtgcaggtggggtgcctgactgttgmgcagcgagtgcttgttgaatgggaacctgctggctgatgaatggggaacccggtgcttcagggagagaccctgwgcttcacttctctgtggggctcctctttgggctcctggatgttggggagcaggtccccttcctccctgcccctagcagctgggctataccttcccctgggtggcagaggcagggcctgatgactgtctcatgccatcctcaggtgggaggtgtcagagcccagctcatgcacatcagctggtggagcaggcctggccttggagaacgagacctgtrtgccaggggcagatggcctggaggctccagtgactgaggggcctggctccgtagatgagaagctgcctgcccctgagccctgtgtcgggatgtcatgtcctccaggctggggccatgtgagtgccctgggcatgagggtggctggggctgttgagtcctttacctggctgggagaacraggagcacccattgccaccgtcctccaggccagagcaagaacaccatccttctgtgggaatgctgtctgagggccacccctgctcagaaaagaagcttagaaagagggctcagggcccctgggaaggctcccattccccttgcaagccgggctgagggaagcatctgaggagagtgtaatgcagctgctgtgcagagaaatgctgccaggctcccgcctggcgtccaggggctggaggctgactggccttgctctctggcctgggtgctggcaaccctcgcccctcatggctggggggattgcagggccaggcatgctcccatgtcccactcttggtccccagctctcggccaggcccacagtgagcactcatgctgctgaggagcctgcaaaggtggggtgtgcagcaaggatacccgctgcgagaccggggagccgatctcgccaagggaggaggggagggagcccctggtgcacacacgccacttcctggtctctctgctgctgcctgagaagatcgagacggggatcgctgggtcctcagaggaggcccagacccaccagcttgttgctattccccacagctggatgccacctctgcaggggagaaggctccctccccatggggcagcatcaggacgggggctcaagctgcacacgtgtggacccctgyggcagggtcgtgctccgtctcctrcgggygaggtgagggcccccgggatgctcctggggaccagcactcatggtaactctcctgtccacttgcatcttgcctcgttctraaaagcatttgaggtggattgcagaaaatccagactatatgggaacacgtggtaatacacaaggagactaagcatagtagctgacagccacttcaaatgtgggtgttgattggctgaaaggtaggaaaagacaataacgccyggcagtgtggcacgagagccattccttatggtcctagcagagcggccggggggtccccaattgatgacccgagcagagaaaccttagctttaagatacacagcgttcttctattttcccaatcttgttttattgcagtataacacagatattataaaatttaccatccaaactgtttctccctgtgcaggtcagtggcataaaagcacagtcacattgttgtgcggccatcrccaccaacctctccagaacttttccagtttcgcaaactggagctctgtccctgtgaaacacgaactcccatttccccctccgcagcccctggcaacctccattctcctttctgtctccagattccacaattctagggaccttgtagaagtggaatcatatagcatttgcctttttgttactagttttcactcagcatgatgtcctcacagttcatccatgttgtagcatgtgtgagtgtttccttcttaaggctgaaaaagattccattgtgagtgtatcctttacakgtttatccatttattcatcagtggacacttggcttccttccacactttggctattgtgaataatgcttctgtgaacatgggtgtgcaaatatctgtttgagttcctgctttcagttcttttgggtgtatatctagaagtgtggtagctgggtaagatgagaattctatgtttaatttttgtggaactgctggactgttttccccagtggctgcaccattttacatttccactaatggtgcataagagttccaatgtcctcccatccttgccaacactttttatttctatggttttttttgtttttgtttttgtttttgagacagagtctcattctgttgccgaggctggagtgcagtggcatgatcttggctcattgtaaccttcgcctccggggctcaagtgattctcgtgcttcagcctcccgagtagctaggactayaggcgtctgccaccatgcctggctaattttttgtttagtagagatggggtttcaccatgttggccaggctggtcccaaactcttgacctcaggtgatctgcctgccttggcctcccaacgtgctgggattacaggcgtgagcccccacacctggcctatttctgtgttttttttataatggccatcctaatgggcttgagaagacacaccatgttcttaaacgaaaaccctgaccacttgctcagtaaaatgtcagcctgtttaaaaccgagaccaaaaagagatttctttttctcycttttcttttttgagacaaaaaagaaaacctctgtcaccrggttggagtgtagtggcacaatcttagctcactacaacctccaccacctgggctgaagccatcctcccccctcagcctcctgaatagctactataccctgctaatttttgtagttttggcagagatgggatctccctatgttgcccagcctgatctcctgagctcaagcgatccttctgcctcggcctctcaaagtgctgggattataggcatgagccactgtgcccaaccaagagattttttttctttttcttttttttcttttttttgagactaagagttttcctctgtcgcccaggctgaagtgcagtggtgtgatcttggctcactgcaacctccgcctcccatgttcaaacgattctcatgcctcagcctcctgagcagctgggactccagctatgtgccaccacacctggctaattttttgtattttattttatyagagagggggtttcgccatgatggccacgctggtctcaaactcctgacctcaggtgatccacccgccttggcctcccaaagtgctgggattacaggcatgagccactgagcctatttcttttgaggatattcctaaaagagagacttgagaaaactggccctaataacatctttatgatagacacaatcagagattttcatattgtgatttttttttcttttttytttttttgagatggagtctcgctctgtcacccaggctggagtccagtggcgcagtcttggctcactgcaacctctgcctcctgggttcaagtgattctccgtctcagcctcctgagtagctgggattacaggtgcgcaccaccacgctcagctaatttttgtatttttagtagagacggggtttcaccatgttggtcaggctcgtctcgaactcctgaccttgtgatccgccgcccaaagtgctgtgattacaggcgtgagccactgtgcctggcccatattgcaattcttataatgcctctcggtcaacaataacagctaccatttgtcaagtgtctactgtgtgccaggcacttgttatcttcccttttaaaaatctttataaatgattctgcaaggtagatgccattatctttttttctaaatctaagattcagagggttaagtcagttgtctgaggtcacacagctggtaagtggcagagccgggattgaaacccatgcgggccttatgtgctagaggtgtccagtgagcctgggctgcagtccttgctgagcctgtcccttggggctctgggtctctgctttgtccacgcaggtctgatggagctgcgtttcctgtgcatggactctgccctcagggtgcctgtccaggaagagctgtgtggcctggcaagcaagcctgggagccggcgggaggtctgccaggctgtcccgkgccctgctcggtgagtgaggggagcaagactgtgtgctggccttctccctgtaagtgggagaccygagccttggctccatgcccggtgacctgcggaggggggcaggtgctgctggctgtgcactgtgtgaggctggaccatggccgccccatccccctgcctcactccaagtgcaggccagagccccggcccagcccctttgaggactgcaacccagagccctgccctgccaggtgggccccttcccaaggagacagggggtgctaggtctgcatcctggctctttcctcacctccaagccagaccttttgaccctcagtgtcctcaccagtgggagcaggtcattttgtgcccccagaagactgggggagtttaatgaaaggattagatgcatgtaaagtacatgctaaatgcaatgagtgtaaaatgcatgctcgatgcaacgcgtgtaaagtacattgcacaggatctgggatgctgtgggtgcacatggttgctggtgcgtttcttcatcgcctgctctttatggagcamctaggccccggggccgtcctggagctaggggacacagcagagaacaaggcagacaaatgtccctgacctcctggagcaaatgcagggggaaagggggacagataataataggacaggyggggaatgcagtttgatggatggtgttcagtgcgatgcagccaaacacagcgggaggggaggaggggagggctggcggggtgggctccagggcggtggtgctgggatcactgttgaagacagacatgcagggcccttgggtgcccggacccctgcccccactgtctctgggatacgacatctgtsgtttgccctcacctttctcttctgtaaaatgggtttgtccaaatgttctgtccactctgccaagcctcttggtgaggacacaagggggcctccagaaagagaacctctccgggcccttcccagcttcctgtctcttcctagtctggggaaatgaaggggagacctggctcccctgggttcccaggccctggggctgtttggggtccctgactccagtttgctccaggtggcagtacaagctggcggcctgcagcgtgagctgtgggagaggggtygtgcggaggatcctgtattgtgcccgggcccatggggaggacgatggtgaggagatcctgttggacacccagtgccaggggctgcctcgcccggaaccccaggaggcctgcagcctggagccctgcccacctaggtgagtcagccggtgatgggaggggcagctcctggtgtgtgcagatgccaggccaggcgctgtggtgtgtgcctgtaatcgcagctacttggaaagctgaatcaggagaaccacttgagtccaggagtgcaagtccaacctgggcaacacagtgagacctcatctctaaaaaaaaaacaagacggggccaggtgtggtggctcacgcctgtaatcccagcgctatggaaggctgaagcgggtggattacctgaggtcaggagcttgagaccagcctggccaacatggtgaaaccccatctttactaaaaatacaacaattaggctgggcgcggtggctcactcctgtaatcccagcactttgggaggctgaggcgggcagatcacctgaggttgggagttcgagaccagcctgtccaacatacagaaaccctgtctctactaaaaatacaaaattagccgggtgtggtggtacatgcctgtaatcccagttacttgggaggctgaggcagaatcgcttgaaccggggaggccaaggttgtggtgagccaagattacgccactggactccagcctggctaacagcagcaaaactccatctcaaaaaaaaaaaaaaaaaaagaaaacccacaaaaattagcctggcgtggtggtgtgcacctgtcatcccagctacttcagaggcggaggcaggagaatcgcttgaacccgggaggcggaggttgcagtgagccgagatggcgccgctggcactccagcctgggctacagagcgagactccgtctcaaaaacaaaacaacaaaacaaaacaagacggggtggggggctcagtggcccaagarccagtctgtaaggaatagggctacctggcaggctgtgctagttgtgggaggtgaagtttaagcaccatgcaggcagggtgcagtgtggggaggcctgggggamagaggaggcagcatttgagcagaacctaaagctgtgagcaccagcattctgatgtggaagacgggagggatggaggtctccacagggacacacacagccacactaggacacgggacagaatcatgttcaagtccgtggggtccggagcccagtggtaaagggcgaacatttgcctacctcatttacaattctttaatggtttctttttgtaggtttgcatttttagtaaagaaatacttttctatatcatacagaaacgtccagaaaagaatgtaacagacatgtatgttccagcactccagtttaatagatagcatcctactgccatgtttccttcmtgtccacttacttttatttatttaatttatttattttgagacggagtctcgctttgttgcccaggcagtgatgcaatcttggctcactgcaacctccgcctcccgggttcaagccattctcctgtctcagcctcccaartagctgggaatacaggcacccacaaccacacccagctaacttttgtatttttagtagagacagggtttcaccatattggtcaggccgatcttgaactcctgacctcaggagatctgcctacctcagcattccaaagtgctgggattacagatgtgagccatcacacctggccagcctccttagttttaaataaatccagttacagataagatttcacttaaatttaggctggtcatggctcacgcctgtaatctcagcacttcaggaggctgagatgggtggatcatttgagcccaggagtttgagaccagcctggacaacatgccaaaaccttgtctctactataaatacaaaaattagccgggcatggtggtgcatgccagtatccccagctactcgggaggctgaggcaggagaatcacytgaaccttgggargtcaaggctgcagtgagcagagatcamaccaccactgcatgccagcctgggcaacagcatgagaccctgtctcaaaaaaaaaaaaaaaaaaaaaaagattttacttaaatttaaaccctgtactaatctgtgatttatttggagtatgttgcaaagtagggaccaaaggatttttttttttttctaaattgttaactagcatctgttggacaagccctgatgcctccaggtggctccttggtggtattggtgtgtgttagaatctatgtctgggctttctactgggtttttttcttctccttttttttttttgagacagtttttctctgtcacccagggtggggtgcagtggcgcgatctcagctcactgcaacctccgcctcctgggttcaagtgattttcatgcctcagcttcccgagtagctgggattacaggtgcccgccaccacccccaactgattttgtgtttttaatagagacagggtttcactatgttggccaggctggtcttgaactcctgacctcaagtgatctgccaggttctgttttttgtgctttttttttctagctattctcttgcccatacaaaattgttttaaatgttgtagctttataaccatttaacatctgtgtcactagtgtgtcctgatttctttgcctatgctaaagtcccttggctgtgtgtcccatttatttttccacatcacatttagagatgatctgggattttatgggaattgcagggtttttcacactgcacgctgcctgcatggtgcttaaacttcacctcccacacctagcacagcctaccaggtagccctgttctctacagaccacctcttgggccactgagcctcccctcacttttttttagagatggggtctcactatgttgcccagtctggacttgaattcctgggctcaagtgatcctcctgcttcagcctcccgagtagctgggatgcaggcacacactacatgagctctggccatccctctgacgttgctgtagccacgctggcctcattgtcctggaacattccagggatactcccctgacttagggcttctgtgctagctctcgctgcctgatgtcttctgtggatatcctcgaggccctggatatccctcccccaggctcggctcagacaccacaactccaaagtggcccagtgccctccctgagcgtcggtccagaacggcactctcgtccctcctgtgacgctctgcttggcactttgggaggctgaggcgggaggattgcttgagcccaggagttctagaccagcctgggcaacatagtgagaccccgtctctacaaaaaatacaaaaattggctgtgcgcggtggcttatgcctgtaatcccagcactttgggaggcgaaggcgggcagatcacgaggtcaggagatcgagaccatcctggctaacacggtgaaaccctgtctctactaaaaatacaaaaaattagctgggtgtagtggtgggtgcctgtagtcccagctacttgggaggctgaggcaggagaatgacgtgaacccaggaggcggagcttgcagtgagctgagattgtgctactgcactccagcctgggtggttgcagtgagctgagattgtgccactgcactccagcctgggcgatgagtgagactccatctcaaaaacaaaaacaaacaaacaaaaattacaaaaattagccaggcatgatggcacatgcctgtagtctcagctacttgggaggctgaggtgagaggatggcttgaaccctggaggttgaggctgcagtgagccgtgatcacaccactgccctccagcctgggtgacagggcgagaccgtgtctcaaagaaaaccattaaaataaaataaaaaataaaatttctgcgatgcacacgacagcctccacagcaaatcagcatccagttgctcatgccagtgatgccccaatggagaacaatccacgctctgagaggaggtggggtctggtttggttcactgccacctcccagtgtcatgtagaacagtgccaagccgcggaaggcacgggtccaagaggcagcgctgcagggtcatgggggagcacagtattgcgatgaagatcccagctcccttgcaggctgcctgggttygtgtctgggctctgaagaatgcgggccataattagttattgattgattacagatcaacatgggcagccttcccttgcccaagggaagggaactcggccttcccttgcagaacgtggggtgttgagatctgtctcctgttacccaggggctcgcttcctgttgctgttacttgggtccataggcaacccctggggtgctgacaggtgttctgtgataaaggcgactagagggggatgtgcaattagggaaacaggggcctcttccccctagggccttttggtagctctcctgtggccgtgagccctggccccagacaggaggggctcagtggctgcactttccatcttgcctggccacggaagctgtctaggcaactgtccgagtacacgtgggtggagaggggcctgcgtggggcagtacygtctctrgggagacctagcctctctctggggtcttctcttcctgcaggtggaaagtcatgtcccttggcccatgttcggccagctgtggccttggcactrctwgacgctcrgtggcctgtgtgcagctcgaccaaggccaggacgtggaggtggacgaggcggcctgtgcggcgctggtgcrgcccgaggccagtgtcccctgtctcattgccgactgcacctaccgctggcatgttggcacctggatggaggtgagcacagcgggcactcggaatccctatggggctggggtgggcatcagctgtggctcctcatgtgtgagggagtctaggaggcattggctcatcgtgtcccctgaaaggaaggagagagctgcgcccgttggtgagggggcacctagaggcagagagacagagggcctagagacctgcgggcagctaggacttaagaggcccttaggtttggggacgctggaagatgaatggcaggccactcagctctacacagatgagggaatgccagctgtgccacgcacctggcaaggcaggacagacaagggtaaatggggttcaggctgccccctggaggggctcgctcatggtgtggagggggcataggggcacagcagacagagatgagcygcagccccgcagacctgcttgctctaaggcttggagggacagagaggccgtgagggtgacagggacccagacttgaattatggctcctcccacctatatgacccatgcaaggtgccctctctgagcctcagttttctcatctgtggaatggagacacttaactgcctcccagcttgtacaaggattatattggatcactcctggcctgtggttaccactgtccttgtcaccttctggcagggtcagctgtgactcctcctcccctctcttggcagtgctctgtttcctgtggggatggcatccagcgccggcgtgacacctgcctcggaccccaggcccaggcgcctgtgccagctgatttctgccagcacttgcccaagccggtgactgtgygtggctgctgggctgggccctgtgtgggacagggtacgcccagcctggtgccccacgaagaagccgctgctccaggacggaccacagccacccctgctggtgcctccctggagtggtcccaggcccggggcctgctcttctccccggctccccagcctcggcggctcctgcccgggccccaggaaaactcagtgcagtccagttatgtcctgtcctccttcctgtcaggcagctgctgcaggaggggtgggcaaaggcatcttcctctgggaaggactggcacaagcacttggtccctgggttgtgtgcctgggaggccggratcagggctggccctctttctccctggcaaagcaaaacctcccttttactactatcaaggggaagtaacttgaaggtaggaacccagcttgtgagccccctagcctctgggctgctctgcatgtgccccctcttgctggatcatctggtagcagccctgtgccctgagggtgatgctctgacctatgcagcccccctccctgtcctgagaaggcttccagctgggccttggaggacagggtccacccctacctcctggtctccttcctcagcttggaagccccggagcctgccctgctgggaatcggggaagcactgcttacctgtctcctgctcccttttcaggtgcctgtggcaggcagcaccttgagccaacaggaaccattgacatgcgaggcccagggcaggcagactrtgcagtggccattgggcggcccctcggggaggtggtgaccctccgcgtccttgagagttctctcaactgcagtgcgggtatgtctagggccatgcaagcgatgctgccagttatgggccctgccaggagccagcacgacgctgcatgccccattcctggcaggagcccatgtgcattcccacctgtagtttgcatcccatctcatgactggggagtgatgatctgcattttacagatgaggaaactgaggctaggagagattaagtgatgtgcccagttacttagagtcacatagccagcagtgggagaggtgggacttgaactcggctcagtctaccctggagccactcctctgctgaccaggcgtgggagtgctggaccctcactgccctgccgcttcctaggggacatgttgctgctttggggccggctcacctggaggaagatgtgcaggaagctgttggacatgactttcagctccaagaccaacacgctggtggtgaggcagcgctgcgggcggccaggaggtggggtgctgctgcggtatgggagccagcttgctcctgaaaccttctacagaggtatggccaggccttctccacctcccttgggtgctccagtcctggcagggaggctgggtgggtgctgctggggatggggccagtcccagtggggcagtgggaagatacggagggaactgactgagatggaaggaactggggttggccagtgtcagtctgcacgtgccagggaggggtcacaggatgaatgctatatccctcctttttgggaccgtgcagcaagatggacggatgtgggacatggtccacatcctcagtcagtccctcaggcctctgccccacacccacctgccccgcccccacccctccagcctttcaagggcttttagggttttgtggaagccactgtccctcagccctgtttcagtgcactggtgtaagcagacatgcttgtacatgcatgtgcacccacaagcacacctcaggcagaggatgccacctcagggactccagccttgcccgtggccccctcgatatcctctgatagccctctcggttgtcctggggggcttgccctctcccaacagcccgagctggccgaagttggcttccctagctggttccagaggttcctcggctcccccaggtgtctggggcttagtggcaacaggggcttagcctctgcagagacctagtgcgccgcctccttgccccagacctgcccgggcagagagccgtgtatgtgtcycagtgcacaggcgctgctgggccctgccaaaaggccacaagcccactgtcaccgttcacattgcttctcgcttcccggcccagccccgcccacacaggcatctgccttgaaagaggtgcaggaggtacaggcaggtgggggctccagtgagctctgaggaacagcagtggccgccatgggtggagcctatctttgttgccagtttcagtgttaaacactcttgcacgtgtgacatcattgagtcctaaagaccactctgctcagtgcatgccattgtttccttcagttacagaggagggaaccagagcccagaacatttagcctttgcctaaagtcactgggccaggaagtggtagaggtggggttcagcaggatttgcctgggaaccccaatattgaccacagtgccatgctgccctgcacggctccctggctgtgagttgtcctggcctctggcaccaccggtctgtctgggttcctatgtccctatgtcccacctgcagaatgtgacatgcagctctttgggccctggggtgaaatcgtgagcccctcgctgagtccagccacgagtaatgcagggggctgccggctcttcattaatgtggctccgcacgcayggattgccatccatgccctggccaccaacatgggcgctgggaccgagggagccaatgccagctacatcttggtgaggcccagcatggggacttgtgctgtgaytctggacagctttccctagggcgtgcagggctaggggacccccttcagtttatttcagactaaaaccctcaaaatcattagtgaaagaatgggagaagatagcttcctccacatattcaccaagaaatgttttttgagctacctacaagagtgaaatagtggctcacaactgtaatcccagcactttgggaggcccaggagggcagatcactcaaggtcaggagttcgagaccagcctggccaacatgatgaaaccttgtctctactaaaaatagaaaaagtagccaggcatggtggcgtgtgcctgtaatcccagctacttgggaggctgaggcacaagaatcacttgaacccgggaggtggaggttgcactaagcccagatmgcaccactgcactccagcctgggcaacagagtgagactctgtctcaaaaaaaaaaaaaaaaaaaaaaaaaaaaagcgaaatggtaaagaatggtaaagacctttctgatgtagactgacagctaacccargactgaagcataattttacagtctgatataacttggacagaatagcaccctgcaccctccccgaggtttcawgtgtcctgggagaactgtsttctgcagggtatcagcttccccagaggaggcagcctggccccgctctggcaccctgactgtgtgtccttggggaagtgatgtaacgtccctggacctcggttttctgggtagagtaatggcgtattcctagtagggctttgtaagcattaaatgtgatccggaatctgtgagcccttgcacacgaaggcttccgtgagtgctaattattacttgtggccggtccttctgggctgccccttttctctcagatccgggacacccacagcttgaggaccacagcgttccatgggcagcaggtgctctactgggagtcagagagcagccaggctgagatggagttcagcgagggcttcctgaaggctcaggccagcctgcggggccagtactggacmctccaatcatgggtaccggagatgcaggaccctcagtcctggaagggaaaggaaggaacctgagggtcattgaacatttgttccgtgtctggccagccctggagggttgacccctggtctcagtgctttccaattcgaactttttccaatcttaggtatctactttagagtcttctccaatgtccaaaaggctagggggytggaggtggggactctggaaaagcagccccyatttcctcgggtaccaataaataaaacatgcaggctgaccggcgtttttttcttataagctgtccagacctggcttgaaaacccatcccatggcaaggcagggattcgctggccgcggttggctctatcttgatctgagcaagccgctggacgtccctagttatcttcttcctatccaggaagaaaatccaatcaggattccactccgaggatggcgcattagccagctccctgcgaagccccacccgtgtgtcctggtgtgaggctctgaccgctaaggtgtctgcgcgcctccaggccccgccccstatgctaataagcgcccgcctcctttgggagcaagtcgccgcaaactgcgagcccccgccccctacgctaatgacgcccgcccccctcgggcacacctctccgatgcctgcgagccccgccccgtatgctaacgagctccccacccccagctcctcgccgcagcctgcgggtcccgccccctacaataatgagcacctacctcccctcaaacgcccctagtcgcggcatgagggtcccgctcactatgttaatgagcacccgcctcccttcgggcgcgcctcgccgcagcctgaaagccccgccccctatgctaatatgctccctctcccacaaggcagcgcgccggctcggacgcggccggctaccgagccctttgtgagrgctgtgagctgcgcctgacggtggcaccatgagcagctcaggtggggcgcccggggcgtccgccagctctgcgccgcccgcgcaggaagagggcatgacgtggtggtaccgctggctgtgtcgcctgtctggggtgctgggggcagtctgtgagtatccagtcggggagaggggccggccccgccgcgcatgcgctcctcgccctgccctgccccgccccgccccggcggccccaggggaaaggacccgctgggggtcgggggtctgccgggcgcctcccggggcggaggaatggcggggcygccgggagccggcgtcctggggttgccatggttacccgctcgggcctgggcgccttggtaccccgggctgggctgggctggcgcttctgggaacattcccggagggaccagaaaccccakggcgggggggcggcgggggcgggggggcggcgggggcgggggggcggcgggggcgggggcggggggtggggcaccggcctggggcacgtgactgagccctccccccgctccccaggggcttttgtgagactttctcggtgatgctcacggggcgcatgcccacctggcccgtactaaagcgtcaactgttgacttgggcgtaggtgacggcagccacattgctaacctttgggcaaggattgtttgtaagggaggcgggtgcacggctggctagatttctggcaggaagccactgggcggaagtttgctgagggtcaggtggtgtcagggcacaggtggcccctggggccgcggggcagtgagctsagggcccggcctctccctgggtcctctgtccgctctcatatctcccccgttgctgctgccttagccgcctgtcaccggccttcctccccttctccgcacgcatcccagtcacagaccctgaccttaggctgccagggaagctaggctcttaagcacagccagaaaaggacaaagagggaggcaggtcagctccaggagtgaatggaagccgtacagctggccttccagggaaagacaagtctgtctgagtgataccctttcctttcctgtctgccctcaatcttgtggattactggagtgggcaaggtcttagagaatgtctgtcgaggatgtctgcaggktttaaacagtgcctgcctggcagagagggctagctctgggcctgggcagggcaggccccatcagcaatcctgccagaaggaccaccttttcagggtcaccttgggttccacagcctttccaggtgggtagagggtggagggaggttgaggcaggagggtgctgggctaggagtgtgctgccctcgctaggcatgcccttatccagaggcaacggatacggtagggcaggccctacccccaaatcacaaaaaggccccgagtttgtgtcactgctcttcagggcaagtacgcttttgactttgtagkagagactggtgggtttgaagttaggcattggatccagtcctgtcatgtctggttagctgttttccctgcagattagggtgggcagtgcagtggggtgacatggtcagtggtgagaaaggaaaggtcctgactatggcctgtaggccacacctccttccttcttggtcagtggccctgccgactcccagatttgctgtggagtcttactcagttctgtgcctctcaaagtgaggtacctctgcctttcctgggagttcctggggctctgttgggtctacagatgaagcttcaggagaaacttgyggcattgccctgagttgtcagttgcatctgcagatttttgggggcatggttatgtgaacatcaaaatgctgtattacagggtagaatgcaaaaatgcagggtgttttagagatgcggcaggagttcagacaagggttgtgtgccgggctggtccttgggtaaggttttcctcctccagggtgaggggatcagagagagtacctggagagggtctaccctgggtcctaagagcatctggaggtgataccttgggaggggacaggattgcatggtgacagccccctcacgtggaagatatcagcattgaggcccccaagtggacatcctccagccctttattgctaaaggattcctggctggagcctgctggtctggcttgacacctggtcctcccccaaggctggctgtgggttggacagctggggtagggttggagctggaggccaaatgctgactgcagcaggaagcacagccgagctgtcaggtgaggccaggcacagcagagaggcagggagccgtgtcaccctttgggcactctgctaggacaggcaggcccctgtgtacctgtggttctggaacaccttgctgtctgaaggcagatgtctaaggctgtgctgaggagcagtgcaacgcttgagtcctttgttttagaaggagaccctgggggcccatgaagcagtcccattgcagttcggctcactttatctggcttctttgcctgctgtctgcataaggttacctgggaaaatggaaaacagcagaattccagacccaggtggagggatcaggtgcagaggagctgctgcaagtttaatgagctgggtgctaattgctgcctccaaggcccccctcagtgatggcctgggcttgctccctgcccagcagccacctccttggacctgccttgaaggctcctggagttcctggtgaagccaggctgcaggctgtgggtggaggagggagttgggtgcaagagaccctgctggtgaggtgcagctgggaggcggggcgtcaaggctgcacatctgagcatcagagaagccacgttctggggtggaaaacgatgccccctccccttcctggccttatggcatttcagcggtgggtggctgggctgtgggacttgctcatgtgcaagaggagaaacgggtctaggaagatgaagatagcgtgccagtggcacagggctggtgaggaagttagagctggaactgctgctcagtcttacctggttcccatctctgttctgagagaggcaccccttgtcccaaccaaaatccaagccacattttctgagtcagaggacttcttgtgtggccggccctgtgaatggtggcaagtgacccttaccgaaggctgagtcttgggggagcactggcctgaatccttgagggacattcactctttaatccttctttaatcctaacctccctttgaggtggatattgatgtagctggggtcagagggccagctcctctgagccctgaaacggggagaggatgctgtgagatccacctgccaccttgctgccaccttgctgtggggcctggggcaagcaaggcactgcacctctctgcgtctcctcacctgtctcagacgatagagggcaggcttctgggtgctgtgagaactgtgtgctgagcatccgcagagactctcgtcctttccagtcatctcccaaggccgccttcccagcgggctccgcctgcctccctgctgactcctgcccgtgtctcttgtttcaagcttgcgcgatctctggcctcttcaactgcatcaccatccaccctctgaacatygcggccggcgtgtggatgatgtgagtaatgcatggccgtcccaccccgggggtcttgctggtcgggaatctgctgggcacctcccgggacagaggagtggcaggggccgtgggagtgggcatccttgtggttgccatggctactggctccagcctgggtgcctcgggcatgtgagtttctggccacarcatgcggcttcttccccttcatacccccaccatgtttagtttcctaatgagaggtcaaggcccagggaatgcccaccccggccttcatccggtgcaggggcaaggccatcagtgctccagacatttctggagcatccactgagactgcagatgccaagtccactatactggggccctcgccctctgggagctcccaggactggggtggggaaggctgttcattggggctggctgaggactgggttgaatggtctgctgggagagggcactcgagctcggagctgtgccaaagatagatgggagaggcgggtcggagttgtcacgggaacccgtggtcagaacaccctcatgtgcgttccatgcccacctcctgccagggtttcgccatcccatcggaagggaaggcggggtgagggcaggcccgtgtggcttggggcacgtgagaagtggcggtgcaccaggaattgatgagtgtcctcatggggcttggtgccttgaggggtacagagctagacgagattcaggtcccgtccccagtgacctatggccagtggagagcctcgggggcctgctgtggtggggtcctcagtgcttgtgctggccagtggtggatagggaagggggatggacagagaggcgcccagcccagcttcagggggtggagtcggagcctggccgagtttgaagtggaagggctggcccagcacagagtgagcccgtgcttggaggcctggtgtgtgggaggctcggggcgggtgcagtggttaagagttgtgaagagagtgcctgccccgggcttggggtggctcttaggtgtcctgagcctgcatttctgttacacaggcataatgatggcacttttctcccaggcctggggacagaagggcctggctcagtgtctgctaactgattgttatccatgcatagagaataccaagaccacagcagacaccttccgtcaccagtggcttagctgttcccaccccaaacatagggctggatgcaaggacttgctaaagttcttcctccccagcgtgggcttcccctgggtgtccccgggcctggggccggtggcatcaggtgtgtgggcagctctccgtgactgtttygggactgcgtggctccagctctctgcctccctggtggggcagccttcctggtgctggtgccactgacggcttttggtggccatggcgataatactaacagcagacagaggacacagctgccagtgctccatctgtggatgaacctgccgcagcgttgtagcagtgccatgatgtggggtcccctttcctccatgtcacacaggaggaggataaagggaagcagaagcccaggggcttccctctaggagtgttcagttcagctggggagatgggtgtgcaggagcagctggggagtgctggagtcttcagcagaggctctccgaggggtacgagcaggtgccctggagcagccgggcggcttcccagaggaggagggatgagggcaggagggtgagggaggtggcattccttatggcactggcactgggggccgccctcatcctcctgggattgtcagtcgctgctcttctcctgccctggtccctgcagcatgaatgccttcatcttgttgctgtgtgaggcgcccttctgctgcc

SEQ ID NO: 13276 - DNA, 46878 bp, Homo sapiens
aggtgatctgctcgcctcagcctcccaaagtgctggaattacagtcatgagccactgcgcctgtcatgttttcttctttttctgcattgctattaaaaattttggctggggccgggcgcagtagctcatgcctgtaatcccaactctttgggaggccaaggtgggtgaatcacctgaggtcaggagttaaagaccagcctggccaacatggtgaaacccctgtctctactaaaaatacaaaaattagctgggtgtggtggcgggcgcctgttatctcagctacttgggtggctgaggcaggagaatcacttgaacctgggaggtggaggttgtagtgagccgagatcgtgccaccgcactccagcctgggcgacagagcaagacttaatctcaaaaaaaaaaaaagaaaagaaaaaattgtttcctcataatcgtaaagctgttatactcactgcaggcacagctagtacattttgctcaaccccacaggctccgttccctttacgaggtatttatttatttatttatttttatttttgcgacggagtctctctcctctgtcatcctggctggagtgcagtggcatgatctcggctcactgcaacctcggcctccagggctcagtcggttcttgggcctcagtcttccaagtagctgtaagtacaggcatgcgccaccacgtccggtgaattttttgtatttttagttgccatgttggccaggcttttactagctatttataatatgcttgagtcactcacaggaatgaaatactgtcagcatcaatagttagcagctctttcaaaatacattttattgcctctataagaaaccttaactattctattagtccagtaattccaaatggtcttattatttcttgggttttgtttgtttgtttgtttgtttttgagacgttgtttctctcttgttgcccaagctggagtgcaatggtgtgacctcggctcactgcaaactcctccaaggttcaagtgattctccggcctcagcctcctgagtagctgggattacaggcacgagccaccatgtctggctaattttttgtatttttagtagagactgggtttcctcatgttagtcaggctggtctcgaactcctgacctcaggtgatccatccgcttcagcctcccaaagtcctgggattataggcatgagccaccgcacctggctcgtcttattatttctatacataatatatgctcttttggctgggcgtggtagctcaagcctggtggcagacgcctgtaatcccagctacttgggaggctgaggcaggagaatcgcttggacctggaaggcagaggttgcagtgagccaagactgaaccacctcactccagcctgggcaacagagtgagaacccatctcaaaaaatactgataataataagatcatcttcagaactcagttcctggtgcatgaagagattcaatacagccccctcactctcagttcttagaaagaagaatatgccagcctgaccaacatggtgaaacccccgtctctaataaaaatacaaaaattagctgggtgtggtggcgcacgcctgtgatcccagctactcaggaggctgaggcaggagaatcgcttgaacctgggaggtggagattgcagtgagcccagcctgggagacagagcaagactcattctcaaaaaaaaaaaaagaagaagaatatgaaagagataggatcaataactaccttcattgtttaatagcctaagagtgaaagcccagcacagtggctcacccctgtaataatcccagcactttgggaggttgagttgggaggatcacttgagcccaggggttcgagaacagcctgggcaatatgtcaaaagctcctctgtagaaaaaatacaaaaattagccgagtgtagtggcacacacctatagtcccagctactagggaggctgaggtgggaggatcacctgagcctgggaggtcaaggttgcagtgagccatgattatgtcactgcattccagcctgggagacagagccagaccctgtctcaggaagaagaaraaaaaaaaaaaagccaaatctttttatcccaggatgtctgaaaaggacagagtctatggagcatggatgcagaaaagtagttattcctaccagaaaaaaaaaaaatgaaatgtggacacagccactcaagatcagagactcaaccagtgaaagcaattagcttcaatttcattgtcaccaggagggcgcacaccagagaacctgggagaaagcctgggctagagcccttagcattctcagtgttactggtgctgtggttcaacaacctttgtgggaatgaggagaaccagagaccatcaccatcacacgtaaaaaggatcctatagcaacaatgtggctgtcaaaaatcagctggaggccaggcgcggtggctcacgcctgtaatcctagcactttgggaggccgaggcgggcggatcacctgaggtcaggagtttgagactagcctggtcaacatggtgaaaccccgtctctactaaaaatgcaaaaaattagctgggtgtggkggtgcatgcctgtaatcccagctacttgggaagttgaggcgggagaatcacttgaacctgggaggcaraggttgcagtgagcccagactatgccactgcactccagcctgggtgacagactgagaccctgtctcaaaaaaaaaaaaaaaatcagctggagcttaaattatacattgtttgcaatccagactgtacttgctttcttgtcaatggcttgagatatgtgcagaggccccttaaacatgtgtaggtgacctttctctgtcgcccaggctggagtgcaggggcacaatctcagctaactgcaacctccacttcccgggctcaagcaatcctcccgctgcagcctcctgagtagctgggactacaggtgtgtgccatcaagcttggctgatttttttgtactttttttttttttttcgagatggagtctcgctctgtcgcccaggctggagtgcagtggcgcaatctcagctcactgcaagctctgcctcccgggttcacactattctcctgcctcagcctcccaagtagctggtactacaggcgcccgccaccatgcccagctaatttttgtattttttttagtagagacggggtttcaccgtgttagccaggatggtctcgatctcctgacctcgtgatccgcccgcctcggcctcccaaagtgctgggattacaggcgtgagccactgcacctggccgattttttgtatttttagtagagacagggttttggcatgctgcccaggctggtctggaactcccgacctcaagggatccgcctgtctaggcctcccaaagtgttaagattacaggtgtgagccaccacgcctggcccagaaatactctttttttttttttttgagatggagtctcactctgttgcccagcctggatggagtgcagtggcgcgatctcggctcactgcaagctccgccttctgggttcacgccattctcctgcctcagcctcccgagtagctgggactacaggcacctgccaccatttttttttktatttttagtagagacggggctaatttttttttgtatttttagtagagatggggtttcaccgtgttaaccaggatggtctcgatctccttacctcgtgatctgcccgcctcagcctcccaaagtgctaggattacaggcgtgagctaccacacctggcccagaaatacttctttatcagaaatattactgrcgggtgtagcagggcacgcctataatcccagcactttgggaggtcgaggcaggcagatcccttaagcttaggagttcaagaccaacctgggcaatatggtgaaagccgtctctacagaaaattagccaggcacagtggtgtgtacctgtggtctcagctcctagggaggctgaggtgggaggatcacttgaacccaggaggctgagattgcagttagctgagatygtgcccctgcactccagcctaggcgacacggtgagactctgtttcaaaaaacaaaaaagaaatatgacttatttacaaatatttctttcttttttatttttagagacagggtctcactattacgtaagtattataaattatatatatatgtttgtttgtttgtttgtttttctgagacagagtcttgctctgtcacccaggctggagtgcagcggcacaatctccactcactgcaacctccgcctcttgggttcaagtgattctcctgcctcagcctcctgagtaactgggactacaggtgcccgccacaatgcccagctaattttttatatttttggtggagatggggtttcactgtgttagccaggatggtctcgatttcctgacctcgtcatccacctacctcagcctcccaaagtgctgctaggattacagacgtgagccagtaagtccgacatcttttttttttttttttttttttgtggaaacagggtctcactgtgtctcccaggctggagtgcaggggcacaatctcgactcactgcagctttgacctcccaggctcaagcgatcctctcacctcagccttccaaggagctgggactacaggcaccaggcccatgctactggtccctgctgtttacaaatacactagacttgggttttagctgctctctcaacaccaggtgggaaatggattgttcggaaggtagaggaatagaggagggacctgcttaggaaggtgggggtgctctagatgagagaggaggtgctgtgacctcaaggtctggggaaagtgggtgagtgcagggccccatcaaggctctcaacaaggcctctctctctggagctcagatgtgaagcccagaaggcaggtcagaggcctgaggtcagaggcaggtcaaaggtgggggtcccacctggtccccttggcgccttcccytggaatgcagtgaccagctgcctggaagggtgggcaaggggacaacaggatggggtaaaggccagttacaagtagaatcctggaaggccgggcgcagtggctcacgcctgtaatcccaacactttgggaggccaaggcgggcagctcacttgaggtcagaagtttgagaccagcttggccaacatggtgaaaccccgtctctaccaaaaagtacaaaaattagccgggcgtggtggcacatgcctgtaatcccagctactcgggaggctgaggcaggaaaatcgtttgaacccgggaggcagaggctgcagtgagccgagatcccgccactgcactccarcctgggtgacagagtgagactctgtctcaaaacaaacaaacaaaaaccaagtagaatcctggatagacagtggctcagggamtcagctgtccccaaatcacctaccttagctctttgtgcaggggatgggggatccccaagatcttcaaagatagggaggtatcctcaagatcttcaaaggtggccaggcgtggtggctcacgcctgtaatcgcaacactttgggaggtcaagatgagaggaggccatcttaaggccaggagttcaagaccagtcggggcaacatagcaagactctgcttctgtttctgtttttgtttttgttttttaatgtttcctcgaaatcccaccttaacatctacacaatggtgcctacagttttccccattaacttcctctctggggacagaatattcccctacccacctaagttcagccagaaggagatgcctcatcccccccacccaggcttcccagtgctgagaacaaaagaaaccagtttagttagcatttcctgtgaattcaaatgggggccagcagtgcaactgggaccagcccattccctgggggagactcagcagtgctggccactttgcagagccccgtctgggtcccccaccctggcccccaagggccacagcatccccttccacccacaggcctgggcaaggtgcagtccccagacttctgcaatcttaaccgctgtgcttccgtcgcagtgggaggccccgccttttcccctgcctgcccttcgggcacctcaggaaggcaccttcctctgtcagaatggcyaccatggtaccatccgtgttgtggcccagggcctgctggactctgctggtctgctgtctgctgaccccaggtgagaccagtcaagccggggagggctggagagggctgcgttttggggatcagtagagggtagaggaatagaacgcaacgctgttcacatcctgccacactgcgacctggccgctgactctgtatcctcgggagaaagttctggttccttagttcagccttcaggtggtcaggccccagcataggcttgtacgccatccctctcccctaacacacacacacacacccctcatgcttcctgctccatctgaactcctgaaatttgccctttgcgtatgtgcttccctctgccaggatcacctgtccctttcacttgctaactcctacttagccttcagtttcgggctgcaatggtccccgcttccaggaagccttccctgactcacctcctcctatgctggatcagagcctcttctggcctccttctgagttctcccyggtctctgatggattctacctttcccmctggaccatgaaggcaggaacccttctgtctcggcacaaggagagaggtgttaaatggtggggcctgttgatgcgtgggttggggracaaggaaacaaacaccaggacttcttcatgttcctgaaggtgtccaggggcaggagttccttttgcgggtggagccccagaaccctgtgctctctgctggagggtccctgtttgtgaactgcagtactgattgtcccagctctgagaaaatcgccttggagacgtccctatcaaaggagctggtggccagtggcatgggctgggcagccttcaatctcagcaacgtgactggcaacagtcggatcctctgctcagtgtactgcaatggctcycagataacaggctcctctaacatcaccgtgtacrgtgagtcracgtgtccggaggtgggactggtcttgggtagtggtgtgggcaagtggccaatggctcaggagagtggggaccctcagtttgcaaagaatggaccacrgttctgacccagagctcagacctggacatttgtgtgtgagatacaaagayagacagagacagagacacagagacagagacagagatatagagacgcatctcaatctcatgccaaggcagcagttgtgaaatcaattaacttgggccccaacaagcattttttttttttttttgagacagagtttcgctctttttgcctaggctggagtgcagtggcacgatgtcggctcactgcaaccttcgmctcctgggttcaagtgattctcctgcctcagcctcccgagtggctgagattacacatgcacgccaccacacccagcaaattttgtatttttagttgagatggcatttcaccatgttggccagtctggtcttgwactcctgacctcaggcgatccgcccacctcagcctcccaaagtgctgggattacaggcatgggccactgcgcccggccccaacaagcttttttttttttttgagatggcgtctcttactctgtagcccaggctggagtgcagtggtgcaatctcggctcactgcgacctctgcctcccaggtccagctaatgcccagctaagttttgtatttttaktagagacggggtgttccgcccacmtcagcctctcaaagtgctgggattacaagtgtgagccactgcgcctggccccaacaataatcccaacacyttgggaggccraggcaggaggattgcttgagtccggaaatttaagaccaggcagagcaatatagggacaccccgtctctacaaaaataaataaaaaatattagctgggcatggtggcacatgcctgaagtcccagctacttgggggaccaaggtgggagaatcgcttgagcccaggagttcaaggctgtagtgagctataattgcaccactgcactccagcctgtgcaaaaaagcaagacccttgtctcttaagcaaaaaagggggtacccctttcagtcagcagtaggcaaatggaggttttacatttacacttttttatacctttattttagagacaggatctccctatgttgcctaggttggtctcaaactcctgggctcaggcaatcctcccacttcagtctctccagtagctgggattgcaggcctgagccactgtacctggctayttttttttttcttttcttttctttttttttttttttgagacagagtctcactctgtcccccaggctagagtgcagtggcgcaatcttggctcactgcaacctctgcctyccgggttcaagcgattctcctgcctcagcctcctgagtagctgggattacaggcgcatgccaacacgcccagctaatttttgtatttttagtagggacaggatttcaccatgttgcccaggctggtctcaaactcctggcctcaaatgatctgcccgccttggcctcccaaagtgctgggattataagcgtgagccaccakgcctggcctactttttgacttttyttttctttgagacgcagtcttgctmttgtcccccatgctggagtacaatggcgcgatgtcagctcattgcaacctccgcctcctgggttcaagtgattctcctgtcttagcctccttagtagctgggattacaggcgtgtgacaccatgcccggctaatttttgtatttttagtagagacagggttttgccatatgggccaggttggtctcaaactcctgacctcaagtgatccgcctccctcggcctcccaaagtggtgggattacaggcatgagtcaccttgcccagcctttttttttttttttttttttttgacatagagtctctctctgtcgccaggctggagtgcagtggcactatctmagctcactgcaaattttgcctcctgggttcaagcgattcttgtgcctcagcctcctgagtagctgggattacaggcacgtgctaccatgcctggctaatttttgtatttttagtagagatggggtttcaccatgttggcaaggctggtcttgaactcctggtctcaggtgatccgtccaccttggcctcccaaagtgctgggattacaggcatgagccacagtgcccggcctgaggcccagcgttttgtaggtgtactggggagggcacccagcctgggagtgtcaagtctcctgtgactgtgccggagtatcttgagaggctgccacagggctggtgaaccaggaaagccctgagtgtctgaacctgattggagagaactgaataatcctgacctyttgatccacccaccccggcctcccaaagctctgggattacaggcgtgagccaccacgtctggccataaacaggaatttttaatattcatatcatagtcataaacgttcatcccttccatcctcatttttttttattktgccatctttgagaacagaaagttttgtttagcgccttgcaaggtatctgacaacacaggaaatgataatcactgcgctaatgataatagcaaacgcttcgactggcccagctctaagccctctaagtttattaactcaaagctcacagttctcggcaggacyaccctgtctcctccccagtccctggggtgagtgggtgggtttgcaggacccgctaagtgccatcctcccctcctctctcagggctcccggagcgtgtggagctggcacccctgcctccttggcagccggtgggccagaacttcaccctgcgctgccaagtggaggrtgggtcgccccggaccagcctcacggtggtgctgcttcgctgggaggaggagctgagccggcagcccgcagtggaggagccagcggaggtcactgccactgtgctggccagcagagacgaccacggagcccctttctcatgccgcacagaactggacatgcagccccaggggctgggactgttcgtgaacacctcagccccccgccagctccgaacctttggtgagagaaggggcttcagacggtgggtgacgagctgagccagggtagacggtgccctgaccttggggttcctgagagtggggtaccccggacctcacaggcttctgggaaggaaagcccccggccactgggcaaggtggccccggaagggaggcccgagccgtgggatctttgaagaaggccgttttcatggccctgtgtgtgtgtcctgygaagaagggtgacccagtcagcaagatatcctgactgggggggatgagggtgtcctggggaaggcacagtcctgggggttgtactatgcccacctttctccccagtcctgcccgtgacccccccgcgcctcgtggccccccggttcttggaggtggaaacgtcgtggccggtggactgcaccctagacgggctttttccagcctcagaggcccaggtctacctggcgctgggggaccagatgctgaatgcgacagtcatgaaccacggggacacgctaacggccacagccacagccacggcgcgcgcggatcaggagggtgcccgggaratcgtctgcaacgtgaccctagggggcgagagacgggaggcccgggagaacttgacggtctttagtaagaggaggcgtgggaagggggcrcggcctcagcagtctgggggcgtggcagagggggcggagactagccgaaaaggtggggcctggcttgccccaatagcagttgcaacgtgggttgggcctgagtgcccgaagctggacacagcgcggaaagagggcgaggcttgaacggccgaaagcgtggcccggatatyccgagaggaaaggggagggcggagggagcggcttgacccacaggaaggtcctgttcattaagctcctgggcaatgccccgcctttaggcttcctaggacccattgtgaacctcagcgagcccaccgcccatgaggggtccacagtgaccgtgagttgcatggctggggctcgagtccaggtcacgctggacggagttccggccgcggccccggggcagccagctcaacttcagctaaatgctaccgagagtgacgacggacgcagcttcttctgcagtgccactctcgaggtggacggcgagttcttgcacaggaacagtagcgtccagctgcgagtcctgtgtgagtcggtcaccctgacctttaatccctccacccctkccctggaaagattagacgctcctctgcaccactgtgcctcgggtgtgttgggtgtctgatcacacatggtggttccacagatggtcccaaaattgaccgagccacatgcccccagcacttgaaatggaaagataaaacgagacacgtcctgcagtgccaagccaggggcaacccgtaccccgagctgcggtgtttgaaggaaggctccagccgggaggtgccggtggggatcccgttcttcgtcaacgtaacacataatggtacttatcagtgccaagcgtccagctcacgaggcaaatacaccctggtcgtggtgatggacattgagggtgagctaayacggggctgcgggtctggaccsgtaagccggggggcgggggggttggagacagaagggacgcatattgacttagcgctttctctgcacagctgggagctcccactttgtccccgtcttcgtggcggtgttactgaccctgggcgtggtgactatcgtactggccttaatgtacgtcttcagggagcaccaacggagcggcagttaccatgttagggaggagascacctatctgcccctcacgtctatgcagccgacagaagcaatgggggaagaaccgtccagagctgagtgacgctgggatccgggatcaaagttggcgggggcttggctgtgccctcagattccgcaccaataaagccttcaaactccctaatctgtggtttgattccacccgcgctgcaagtctctcccacccaggtgcacatccactgagtagcgtcgctgcgacggaagggggcggggcctgtggcgcgcagacgcagcttgaactcttgagaggtgggctggggcttagccaacggggcaaggggggcgggaaggaggtggggtttctcccagccaatcgacgggcgcgccctcgttgccgctctatgccgctccgccccggctcgctggtcccagaaggcgccgggtttcccaagatggcggcggacgtgtcygttactcaccggcccccgctgagccctaagtctggggccgaagtcraagccggcgatgccgcggagcgccgggcgccggaagaagagctgcygcctctagatccagaagagatccggaaacgcctggaacacaccgagcgccagttccgtaaccgccgcaagatactgatccggggcctcccgggggacgtgaccaaccaggtattggggggggcggtgtaggagcgtggcgggaaataccacggtgcgcgtgcgcggggggaaccgggcgacaccaacgctgaggtgcgcgggggtcgttggcgggggcgcccaagcaccggatccacgcgggatcgggagagaccaagagcgggacgtgggggggcgatgatgaaaggggaaaccgactgcgaagtgagggagggcgttgctaggggcgaccacaggcttgggcgacaccaagtgatggaagcgggcggggaatggaagggggcggacagctttggtcctgttggggaattgtgaatgggctggtacattggaccaccagttgccccctgcttggatgatgcttttctccacccactctaccacagggtggcgggrcctcacatccagaagtttcaggactgcggagagtacgcccctccatatcacgcgtttattcactgctctcagagataaatccggaagttaacagcagcccctgggtctcagcccccaaaacctcaggattaatttgggaaaatggggtcttctgccaccagcctacagacctacaggaaggaagcgaggcctgtgttctatggagcccctcgtggctaatcttcctgctaggagtgcccttctcatggggccagcatggggcagcgcttcccaatgctctttggacccagggaaatggcatctatactgccctgccctatggckgtgaaataggttctcgcttcctgctgctgagattccctgctctccggcccaccagcacaccgggtgggcacgtggctagtggaaccccagggatgttgggaggggctgaatttggggacagatcgggacagggatcattaaggatggtcaggtttctttctgggtcttcctctcagtgtctgcagtctctcagctgggaacacattgtctctcctgcaagatgcacagtgtgtctggtcccagcaggcgccagcactttgccttcaaagctggcttgagaggctgggcatggtggctcatccctttaatcccagcactttgagaggctgaggcaagaggctgtattgagcccaagggttcgagactagcctgggcggtatagtgaaaccctcatctctacaaaaaatttttaaaaattagccaggcatggtggtgcgtgcctgtagtcccagctacgcaggaggctgaggtgggaggatcacttgagcctaggaggttgaggctgcagtgagctatgattgtgctactacactctagcctaggtgacagaacaagacactatctctaaaaaaaagaaaaataaatgagctggcttggaagagggcagctttatcagcaggaggaaattgggaggcatgtgaacccacacaacgtggggcttactagaaggtgggctccccagtcaggtacccatgggtggctgcgctgcccaactgcatggcctccagcagatctcttcacttctcctagcctaagttttctcatatacaacatgagtttgttaatacttcacttacagagttgttggaaacagtgaatcttgcaaaaggaggttcatgcaggttaaatggcttccctaaaggcatactcttttttttttttttttttttttttgagacggagtctcactctgtcgccaggctagagtgcagtggcttgatgtctgctcactgcaaccttcacccctcgggttcaagcaattgtcttgcctcagtctcccgagtagctaggactacaggtgcacgccaccacagccagctgatttttgtatttttagtaaagatggggtttcaccttcctggccaggatggtctcgatctcttgatcttgtgacccgcctgcctcagcctccaaagtgctggaattacaggcgtgagcccggcctctttttttttttttttttttgktgttgktrwtttttttttwttttttttttttttttgagacggagtctcgctctgtcgcccaggctggactgcggactgcagtggcgcaatctcggctcactgcaagctctgcttcccgggttcacgccattctcctgcctcagcctcccgagtagctgggaatacaggcgcctgccaccgcgcccggctaatttttttgtatttttagtagagacggrgtttcaccttgttagccaggatggtctcgatctcctgacctcgtgatccacccgcctcggcctcccaaagtgctgggattacaggcgtgagccaccgcgcccggccttgttgttattgttgttgacagtgtctccctttgtcacccaggctggagtgcagtggcacactgcaacctctgcctcctgggtgcaagcagttctcctacctcagcctcccgagtagctaggattacaggtgtgcgccaccactcctggctaatttttgtatttttagtagagacaaggtttcaccatgttggccaggctggtctcgaactcctgacctcaggtgattcacccgcctcggcctcccaaaatgctgggattataagcgtgrgccaccccgcccagccagctaaaggtataccctctaagagcatgttgcctgggtaatagcacagtctgcagctaggttctgaatcccatctctgccaggtatgagcagaatgaccttgacaaaattactgcatcgagcctcagtttcctcattggtaaaatggggggtggtaattgacctgccttcatagctggtggcagctatgaagcggcactgggttgcccccttccatctccagtaactccctgtcttttgtcttgtatctccacaggaagtacatgacctgctcagtgactatgagctcaaatactgttttgtggacaaatacaaagggacaggtttgtggggccatggggygggccagggcagggagtgaccatccctgaagatgggagggcctrgctcactgtctgctgctctgagcttcaggcccagtattgccccccaggccaacatggcaggttgccccaatctgcctgtcatcctgtcatcttgggacagccttcatgttctccttggagaacactgggcatcgggctgattctcttcctactccactcgcttggcattgagctaattcttgacaacgtttggccgtgggttcattctcttcttacccctcttgcctcactcagccagtcacccctgcttgtgtggtctttttttttttttttttgagatggagtcttgctctgtcgccaggctggagtgcagtggcgcgagctcggctcgctrcaacctccgcctcctgggttcagcccattcccctgcttcagcctcccgagtagctgggattacaggcatgtgccaccatgcccggctaatttttgtatttttagtagagacagggtttctacctgggtgggtccaggttaaccaggtgaggaggtggggctcagtgttccatgctcaagaaacagcagctgcaaaggcccctctggagtgtgcctggcgtggtccgggtggcagcggtgagatgggaggggaggtcagcgagcccgcacaggctgcactgcaccctgcagctagaagccacaagatggatgtggcgtgatcgttttgaacaaagcttcctgcggccgctgggtggatcgcaaatctggggcagcacgtggcagcagggttcaggggcactggtggcctggaaaggtggcaggggtgggcagtgtgtagagtgggcctctggagtccggctgcctgggttcaagtccaggctcccctactcggggcacaggggtgctgctctgggcccgtttcctctctggcaaaatggtgattgtgatgattaagttatatccatttgagagatgaggaaactgatacccccaaagccacctggggcttggggcttaaatctgggccccagtgagcatgggcttaaccactgcccttggtatcacccgagtgacccacagcgttcttaggacagagccaggcccacagttggtgagcgctgctgtgggtgcaggtggacgcagggctgggagagggagtgggcttcgtggagcctagagtcaatggcaggcgctctcgcctgtgtgagtcgccaaggctggcaactgctcagatcagcaggcacctgagatgcccagcatttggaggtcccacctggtttgcagggtggcggggtggaggggcaggccctcagggcccggctgacctcgcactgccctcctcccaccgcagccttcgtgaccctgctgaatggggagcaggccgaggccgcaatcaatgctttccaccagagccgcctgcgggagcgygaactgtcggtgcagctgcagcccacggatgccctgctgtgtgtggccaacctgccccccagcctcacacagcagcagttcgaggagctggtgcggcccttcggcagcctggagcgctgcttcctggtctacagtgagcgcactggccaatccaagggctatggctttgcygagtacatgaagaaggactcggctgcccgtgccaagtcrgacctgctgggcaagccgctgggaccacgcaccctctacgtgcactggacggatgccgggcaactgacgcctgcccttctccactcccgctgcctctgtgtggaccgcctgccacctggcttcaacgatgtggacgctctgtgccgggcgctgtcagctgtccacagccccaccttctgccaggtgagccctgtggagagcattggggagcaggtgccaggcccggagcacctgagagagtctttggagtcatctgccttttcttttttttttttgagacagtctcactttgtcacccatgctggagtgcagtgatacaatctcagttcactgcaacctccgcctctttggttcaagcaattctcttgccttaacctccagagtagctgggattataggcgccccgcccccatgcctggataatttttatatttttagtagagatggggttttgccatgttggccaggatagtcttgaactcctggcctcaggtgatcctcccaaagtgctgggattacatgcgtgagccaccacacctggccaggggatttgaatccctctgcagcctcaggcctcactgtccctctatcagatgcatgcaaggccactcttgtaactatggatctcgaggcttgctcaccactcacctcctcattcgctggtaccctcgtcaaacctcccatggggtcccagacctggaccaggcattgaggaggctgcagaggagcccacagtctatttgagccttgaggtcagagactgaggctttgccagatcccagccccgccctcgagctcgggccagtcactggctctctgatctgcagtttccctcctccataagcagggactcaatacttgcacaatgggttggcaaaacagtcccttgttcattcaagccacacatgccaggcacttctgtgtgtgtgcctcrccctgtaacaggtgcagtggggcgagaacaggccagactcactctctaagagcccccagaaggtcttgatccccagagatcccaaaggggacattcccccagcactcgctgtggactctgagtacrtaaccttcagttgcttcatcctgtagcaaccctgagaggcaggtatcactcccattttcaggtgaggataccaaggcacagaggggtcaagtaacttgcctagagttaaacagccagggtctggcagagctgggatcagaacaccgcagcctagctccagagcttgggccagtgagcggaggccagtgcagaggcttaaaaggggtaggcctggccaggtgcagtgactcacacctgtaaccctaacactttgggaggctgaggcgggcggatccctcgagcccaggagttcgagaccagcctgggcaatatggtgaaatcctctctatacaaaaattagataggtatgatggtgtgcctgtagtcccagctactcaggaggctgaggtgggaggattgcctgattctgggagtccgaggctgcagtgagccatgatcgcaccacagcaccatgacactacagcctgagcaacagagctagaccctyatctcaaaaacagagagacagtcctgggctcggacccccagctctgtgggcttgagtgggtccctctcgtgtaagtggggtattggtgccccatttaaactaggtgtctgttgggaggcagaggcaggaggatcactcgagaccaggagttcaagactagcctgggcaagatagtgggacaccatctctatatttaaaacaagaaacaggctgggtgaggtggctcatgcatgtaatcccagcactttgagaggccgaggcaggtggatcacttgaggtcaagagttcaagaccagcctggccaacatggtgaaaccctgtctctactaaaaatacaaaaaaaattagccaggtgtggtggtgcaggcctgtaatcccagctactcaggaggctgaggcaggagaatcgcttgtacctgggaggtggaggttgcagtgagctgagatcacgccactgtaytccagcctgggtgacaaagcaacactgcatctcaaaaacagaaaaaaaaaaaaaaaaaaaaaacaggccaggcgcagtggctcacgcttgtaatgccagctctttggaggccgagacggacggatcacctgaggtcaggagtttgagaccagcctgacaaacatggagaaatcccgtctctactaaaaatacaacaamaaaaaaaaggtagccaggcatggcgccacgcgcctgtaatctcagctactcaggaggctgagacaggagaattgcttgaacccagaagactgcggttgcggttagtggagatcgtgccgctgcactccagcctgggcgacagagcgagactccgtctcaaagaaacaaaaaaaacaaaaactgagtatccatgagccacgggaaccccctctctgtttacttatcattcatccattctgctgctttctcttggacacctgctacgtaccaggcctgctatgtaccaggccgcctgtgcgggctcaggacagaagatgagttagcacaatggcctcacytttcttttattttattttatatttttttaagacagagtcttgctctgtcacccagkctggagtgcaggggcgcgatcttggctcactgcatcctccgcctcctgggttcaagtgattctccagcttcagcctcccgagtagctgggatgacagcgcctgacaccacacccagctaatttttgtgtttttaatagagatggggtttcgccgtgttggccaggctggtcttgaactcctgacttcaggtgatacacctgcctcggcctccccaagtgctgagattacaggtgtgagccactgcgctggcctggccttaccttcttatgtggagatcaaaggtcacagggtcatgaccagctacaggtactctcctagcctgtttccacatctcaaaatrgggctggcagtgcttcatgatcaggttgttgtgaacagctgcccattcattcctccactcgaacattcactaaacttaattttttttttttttgagacaggttctcaatcacccaggctggaggagtacactccggcctcgacctcctgggttcaagaaatcctcctaccttggcctcccatgtagctggggaactacaggaatgcrtcaccatgcccagctgatttttaaaattttatgtagaggccgggcacagtggctcatgcctgtaatcccagcactttgggaggctgcggcgggcagatcacttgaggtcaggagttcgaaaccagcctggccaacatggtaaaaccctgtctcatggcacggtggctcacgcctgtaatcccagcactttgggaggccgaggtgggtgcatcacgaggtctggagatcgaggccatcctggctaacatggtgaaaccctatctccattaaaaatacaaaaaaaaaaattagctgggtgtggtggcatgtgcctgtggtcccagctatttgggaggctgaggcagaagaatcacctgaacctgggagacagaggttgtggtgagccaagatcccactactgcattccagtctgggtggcagagcgagactccgtctcaaaaaaaacaaaacaaaaaacaaaaaccctgtctctattaaaaatagaaaaaaaattagccaggcgtggtggtaggtgcctttaatcccagctactcgggaagctgaggcaggagaattgattgaaccagggaggtggaggttgcagtgagccaagatcatgccaccgcactccagcctgggcaacagagcgagactccctcaaaaaaaaaaaaaattatgtgaagatggggtctccctatgttgcccaggctggtctgaaactcctgtgctcaaacgatcctcctgcctttgcctcccaaagagctgggattatagattcgagccactgggcctggtctcaccaaacatttgttgagcatctgatgagtagcaggcgttgaagtgatgtcctccgaggagcccacctttaatgttaggtgacccrgctgaatggagggtgggcttgacagtgaagcagcttgaggttcacacatcagtccctcgacttaggaattgtgtggccttgatcactctgtgacccctctgagtctctctctgttcatccctaagatgggtgtgtttatggccgggcacagtggctcacgcctgtaatccagcactttgggaggccaaggcaggcggatcgcttgaggtcaggagttcaagaccagccttgccgacatggtgaaacctcatttctactaaaaatacaaaaattagctgggcgtggtggtgcacacctgtaatcccagctaccaggaggctgaggcaggagaatcacttgaacccaggaggtggaggttacggtaagctaagttcacatcactgcactccggggtgacagagcaagactctgtctcaaaaaaaacaaaacaaaacaaaagccgacaggtttggttatgggagatctgtgcccagaccttggcacagggcgtgggcagaggtgaagggctgctacctgcacctttgctgcccgggcattcagcaagtgccggtgcccagcccaaccacttcccttagcactgctacctggcttggccactgtctggaaygagagcccttccttccccacccgttgctgattatctcttttttttttttttttttgagatggagttttgctcttgttgcccaggctggagtgcagtggcgcgatctcggcccaccgcaacctctgcctcacaggttcaagtgactctcttgcctctgcctcagcctcccaagtagctgggaatacaggcatgtgccaccacgcctggctaattttgtatttttagtagagacggggtttctccatgttggtcaggctggtctcgaactcccgacctcaggttatctgcccgcctcggcctcccaaagtgctgggattacaggtgtgagccaccgcatccgcccgtggccttggctttgttggtgaggtggctcccagctccgccctccctccagctgtgtggccttgggtgcgctgacctctccgtgcctcagttgccttctctgagaaatgggtatgatgcagcctcccagggtcattgggaaaatcagatgagctgatgcaggaatgaggcacagggcagtggaggcctggcgtggagttcacccttatggggcagctgagtctggttacggttgtcacttcccggggtggtgcagtcactgctgcccagatgctcatgactgcctgccttcctccggcagctggcgtgcggccaggatgggcagctgaagggcttcgcggtgctggagtatgagacggctgakatggcggaggaggcacagcagcaggcggacggcctgtccctggggggcagccacctgcgagtctccttctgcgcccctgggccccccggccgcagtatgctggccgctctcatcgctgcccaggccacggtgagcctgtgcgggcagaggtggcggggtggggatgggagccccatggggatgtcagggccccagcggcactctgagctgcttctgttccttcctgcaggccctcaatcgggggaagggactcctccccgagcccaacatcctgcagctgctcaacaacctgggcccatccgcgtccctccagctgctgctcaaccccctgctccatggcagtgcgggggggaagcagggtaaggtggggctggacaggggccccactgtgcagaacaggggctgcagcgctgcccccggcacttcccgaaactgctcatcttggctgcagtgacaggagccccaggagtagggccgagggggagtatggagtcatagcgggggctgctgctgtccacaactgggggccgggaccagggccacacagcagcctgcagtgaggtggggtgctgacaagagggggctgaccttcactggagtagcctctgccccttctaggcccttcctttgggcaagtccactgcccaccccccggccccagagtgtcagtttcctgccccatcaatgggttcagggctgtgtttcgtgaggtggggcagggaggacacagggacccccacacatcctcctatgtctccctccaggcctcctgggtgcccccccagccatgccgctgctcaatgggccagccctgtccacggcgctgttgcagctcgccctgcagacccagggccagaaggtaacacacgcatccccctcacccactgctctacagcccctacaggctcttttcaacacagctggtgcgatcggtggggtggggggacctctggctgtgccctgggggcgcagaaccagggtgagggcgactcccccaaacccctgcctttcccacccacatccccatccccctctggcaattgctcatgatggttcgccatctttccctccattctgagagcgcccctggacttggtgcctggggtggggtcaggggacctggacacgcccatttacagcctgaaactgggtgtgggctgggagcgccgctgctgggcaccagtttgtgaatagactctgctcggaagctctatagacatgcctgggaaaaaactccaggtctatcccctcagtgygtgcrcacacacacacgcacacctagaaacacaggtatacatatagactcacacatacaaagatgcaaatatacacacagagacatagacacacaaagacataagacaaagacacacacatagacacagacacacatatagacacaagacagactcatgcacacagaaacaaagacacagatatacacgcacacacacacacagacacacacacacatagacatacacccatgctccgtcctgtctggtgtggttccctggattctaagtcaggtgtgtctgtctggtggtaactgacagaatatgtgagcctgtgggtctggccttctgtgactaaaagtggctgaaacactgtgtggctgtcccattccatgtggctgcagttgatactgtgctgcaatcattggccagggaactggggcctggagctcaggagaccctcggtcaccatggctgatgggacagtgatagagttggagtgtggcgggcactggggaaccctgtgcctgtctgcccaggatcsgccrtgccctggagttggggtgtgtctgccaagactctgggccacacctgtctgcttccctgggccmccctgcccccatctgcaactgtctgtgctctgtccctagaagcccggcatcctgggagactcacccctgggcgccctccagcctggggcccagccagccaaccccctcctcggggagctgcctgcaggtaacgcagaccctgcccacacggtgtcccccarccacttccccttccttccctgctacgtggcctcgggtgagtgacccaacctctgggtcccagcgcccttgtccatcagttgggtgccctccactcagggcccagggatgagctctgctcagtggccagcatggatttgtctcttgacccctgggccctggtccaggtgggagctggagggccctggggagaggggtcctgtgagcctgggcccctgaaatcctccttccctccctaggagggggcctgcccccggagctgccgccccggcgagggaagccaccacccctgctgccatccgtgcttggccctgctgggggtgaccgggaggccctgggcttgggtcccccagcggcccagctcactcctcccccmgcccctgtggggctccgaggctctggcctcagaggcctccagaaagacagtgggcctctgccgacgccccctggggtaaggccctgccctgcgcgcggcaccacaccagcctcctgttccgcagggttccctctcccgggggccctctcgaatcctgccttcccgccacaggtctcactgctgggggagccccccaaggactaccggattcccctgaatccctacctgaacctacacagcctgctcccggccagcaacctggcgggtaaggaggcccggggctggggaggcgccgggagaagccgccgcccagctgagggccccccaactaaccccccagcccctggaggtggcagcagcagcagcaaagccttccagctcaagtcccgcctgctcagccccctcagcagcgcccgcctgccccccgaaccaggactgtctgacagctacagcttcgactacccctcggtgagtgcctggctgcagctctctgtcccctaaggccaaatcattctccaaactgatatttctctaggattgactatgccaggccatgtgctagggaggcggcagggaacgtgccagatatggtctctgcttttttttttttttttttttagagacagggtctccctctgctgccctggctggagtgcagtggtgcgatcatagctcactgcagcctcaacctcttgggctcaagcgatcctcacacctcagtctcctgaggagctgggaccacaggcaygcacctccatgcccagctaatttttaaatttgtggtagagacggagtctcattgtgttgtccaggctggtctcaaactcctgacctcaagtgagccacccgcctcagcctcccaaagtactgggattacaggcaagagccaccgcgcccagcctcatgcccttaaagtttcccgtctgtctgcacatcaccccctgcttccggtccacctgcctgtctgtccattctcgagccctggaggatcttgggtctcagtctgtctgtcatcctgcgtctgtctttctctcccaagaggacttaggccacactgtctctccccagagacagggcttgccctttctatccctctctcccacctttgattcctgtctgtgcccctggagatttggtccttctatgatgccaacctccttggcaggtcagaaattgcaaactgggccaggcacggtggctcatgcctataatcccagcactttgggaggccgaggcgggcagatcacctgaggtcaagagttcaagaccagcctgaccaacatggagaaattatatattataawatatataataaaatatatatttcatatataatataaaatataatttatgttttatactaaaaawacaaaattagccaggtgtggtagacatgcctgtaatcccagttactarggaggctgaggcaggagaatcacttgaacctgggaggcggaggttgtggtgagccaagattgtgccattacactccagcctgggcaacaagagcaaaactccgtttaaaaaaaaaaaagaaagaaattgcaaactggccgcccacaggtcacctgggtgatgtttggccccctctgtgtttcaaacaaataacaacaggaactaacgccaacacaggaaaactgcaagagtccacacagctcgaattcccagcttgcctgggaaactccaaacacttaggcccatggggggcaccccccttcacagcagccatccctgccaagctgcatccagccccaaatttgcctcttcctggtcccagagtggtggggactgtcttccctgatgacagctctgccatggagttcagccaggggtgaggctgggacagactccaacccaatgtgcttctcccgctttcattcaggacatgggacctcggcggctcttctcccacccacgggaaccagcccttgggcctcacggacccagccgacacaaggtaagagccacctggtatggcatgtgtagcaatcagcttttactacatgacaggctgtgccatgacttagtagcctggaacagcagaccttgtattttgtgtgttctttgtgggtttttttaagacaggatctcactgtgttgcccaggctggagtgcagtggctccatgatagctcactgtggcctcaaactcctgggctcaagcaatcctcccactttggcctcccaaagtgctaggatcacaggcatgagccaccataccatgccaggcattktattacttcttgccactctatggggcagtgggcggtccccggcactcacctgggtctcagtgagctatgtggcctcacatatttggcgtccacaggctggaacagtttctstgtgcccattcgtgcggtgatgatccctgggttcctggaggaggaagaggaggcgggtacccacgtgccagctctcctcagtcctattagccaaagctagtctttgcaaagcccagaactgccgggcatggtggctcacgcctgtaatcccagcactttgggaggccgaggtgggcggatcacctgaggtcgtgagtgtgagaccagtctgaccaacatggagaaaccccgtctctactaaaaatacaaaaaattagctgggcatggtggcgcatgcctgtaatcccagctactcgggaggctgaggcaggagaatcgcttgaacctgggaggcrgagggaagattgtatacaaagggctgggtactacaattgtctgcttcactccaccggcccttyttctacagatgtcccccccgcccagtggcttcggcgaacggagcagcggtgggagtggcgggggccccctgtctcacttctattcaggctcgcccacttcctacttcaccagcggcctgcaggctggcctcaagcagagccacctcagtaaggtgaggaacctctctggccaagcacaggccccctgggacagctaggatttgggggtgcctgccaccggggctctgtaaccctcggtgcccaggccaaagctggggtggtggcagrggttggtcttgctcagggtggagtagcaacagcctattgtcctccatccactctgcatcaagcacctagcactgccagcattccgggctttctgtcacttcctctctctacagcccaggctgtgggtgctactggccccatctgacagatgagaaaaccgaggctcaaataaaatggagcaattggccctaggtcttatagctagaaagtagcagaagcaagatttgaacctgaaactgttcgctttccctcagggctggggggcagtggcaggggggcggggtgggtgcttcctctggcccccagggagtgacctgttccacctctccatttctcccaggcaatcggctcttccccgctggggtccggagaagggctcctgggcctcagccccgggcctaatggtcacagccacctgctgaaggtacgggcagggggtggggacatgcagggctgggaagccccggccccccagcggcccctgacccgccccgccctgccctctgtctccagaccccactgggcggccagaaacgcagctttgcccacctgctgccctcgcccgagcccagcccagaaggcagctatgtgggccagcactcccagggcctcggcggccactacgcggactcctacctgaagcggaagaggattttctaagtggctggcaccagagataactcaagggcctgcaccaaatcgcttttgggttttctgatgttttgttttgtgttttttttaaaccattttctctctttcggtaatagaaaaatctctgaaagactttactgaccaatcagccggagccccaggagcccaaggggtgtgggggagtctggaggcctcattatgtctctggcttgctccccacgctgaaaccctgcagccttaagagagaggggccccggcctgctctccctccctccccccatctcctcctccgctgtgcccgtctctccggagccctcctgcctcattgctcctgtaattttggcctttcgagtgccttggaggtttccctgacctcccgtgaagatacagagactgtctcctttttttttaactttgwcaactgacttctgtttccttttctaagttttatttttcaaaccaccccggacagcccccagctctgattccttcaaggcccggcctgtccgggccaccattccacaccttgcggtttgaaacagctgtttttcccacatttgctgcaggcatggctgtctcctgcccctgcctgcccatctggcctataccccagccgtggggcccggggtccctgccgcagccccctccccttctgatgccttaaaagctgggccccaggccctgctggccagagccacagatgscaagctctgggagcttgactatggaccaaacagctctggcctagggattgggccaccctacccaggatctccaccctggggacagtagaaggggaaagccttcatcttggcgaaccggccccaccaccccctcctacccgggcctccgtgcagagatgggctttctctgccagtcccctgctgtctgtmtgtgggagtcggacattgtgcccatctcccggagcctctgctgtcactcgcttgttgaagatgaattcttgaattctgcctgcccacccccggccagatccctggagctggcctccttccagcccagtgccagaaaccagcactccatgaagataaactctgggcccgcccaccagcaggacctgtcgacctgaggtgaccctgggccttgcccccagccaactgggccaccagcttccctcccttgactctgggggtccacatccactccaaggggactattcccccgaccccaccccagtctccccacacggacctttgctgaattaaagtttgtaagtaaatggttttaaagaaatcagagttggctggttcttgggacaaacagtgggcttgagtgggaggtctgggatggccccgcgggtttacctgagatggattccgccctgctcttcccacctggtcaccgcaggccctaagcaaacatctgcgcttatgttccattgattatgggctttccctcgcctccctggcgcggcgcatgctcagtcggtgagtcacgtgatgcatgtcatggccgcctccatggcccggggaggcgtgagtgccagggttctrctgcaggctgccaggggcacctggtggaacrgacctgggggcacttccgggtcgggggagggggtggcgctggggacaaccagaaagtttcaagcgacaggtayctggggcgcccrgggcgggcagcgttaatccgtcagatgccggcggggcggggctcggcgcagccgctcaccgaaccgtgttttccaggctcgcgcccggckggagaggaggacgcgggcggcccggagcggcccggggacgtgtgagtgcagggggccaagtcccccattcctcatcccacggaattcctctggtccccatcttgccctgtagcttcatctcgaggtcccccttctgctttgccctattcagtacctgtgcgtcaagcctcaattcctacttcctaaccctagattctacccgggccctgagcccatcatccagttcggcattcgcacttycatctgtccccagggtgaacgtggtgttcgtagaccgctcaggccagcggatcccagtgagtggcagagtcggggacaatgttcttcacctggcccagcgccacggggtggacctggaaggtaggaaccgggcagagggaattaaggaggtccttatmcatttgtccaaaaaaaaaaaaaaaaaaammcacaaatyaggtgtgtctcttcacgtctttttcccaccaaatatggactaaaatccaaacccctcaccatggcctcatctgttgccaagctcttatttgttaagcatttattagagatcactaggactcctggctcccaggattttgtgttctcttcccccttcctccctgtattctagccacattggctttctttttgttgttgttgttttgagatggagtttcactcttgttgcccaggctggagtgcaatggcttactgcacctcagctcactgcaacctccacctcccgggttcaagcgtttctcctgccccagcctccagactagctgggattacaggcgcccaccaccaagcccagctaatttttgtatttttagtagagacggggtttcaccacattggccaggctggtctcaaactcctgaaaggtgatccacccgcctcagcctcccaaaatgctgggattacaggcatgagccaccgcgcccagcccacactggctttcttgtggttcctcaaacaaccaagctcattcctgcttcggggcctttacatttgctgttccctctgtctgaagtgctttcccagcaaacattctggctctttctcatccttcagacctcagtgtaaatgtcatgtccctaacaatcccattcccctcagcccagctgaagtacccatgccctagttactctgtcttatcagtgtgatatgatatatagcacttctcactttttttttttcaagagacggagccttgctgtgtcgccaatgctggagtgccatgatgcaatcatacctcactgcagccttgaactcctgggttcaagtgatcctcccacctcagcctcccaagtagctgggattataggcacaagccacaatgccaggctgttttgtttcctactttgtcatctgtcccccagtgagattggtgacccatgtccttattcatgcttatctgttgcctgtcargatgtaacagatgtttgataatttgttgagagaaaaataataatagaaatttcttgtccaggcrcagtggctcatgcctgtaatcccaacactttgggaggccraggcaggcgactcacttgaggacaggagtttgagactagtctggccaacatggcgaaaccctgtctctacaagaaacacaaaaattagctgggcgtggtggcacatgcatataatcccagctacttgggaggctgaggcacaagaatcacttgaacttgggaggcagaggttgcagtgagccaagatggcaccactgcactccaggctgcatgacagagcgggactctgtctcaaacaaacaaaaaaaaaaggccaggcgcggtggctcacgcctgtaatcccagcactttgggaggccgaggcgggcggatcacgaggtcaggagatagagaccatcctggctaaaatggtgaaaccccgtctctaataaaaatacaaaaaattaggtgggcgtggtggygggcgcctgtagtcccagctactcgggaggctgaggcaggagaatggcatgaacccgggaggtggagcttgcagtgagccaagatcacgccactgcactccagcctgggcgacagagtgagactgtctcaaaaaaaaaaaaaaaaaaaaaaaaaatatatatatatatatatatatatgtctttaaccatgttaataaatattcactgactgaatcttcatgacaacttgagtagtagagactgttattccctattatagatgaggcaactaaaccccaggttaagtagacctggtctaagggcaagtgagtgacaatactagactcaccagtccattgtagccactaatctgtgctgcctttctatgaatacctactgcgcgtcaggcagcaatatacaaaacaaataaggcctctgtcatctcacatccatttcggtctaatagggacaataatcccacaggtaaatacataattatgaccaacttgggaagggttgtctggaagaaaatatatagggtttgcttttgggatgaatatatcagggatcctgattttatcattaaaggggaagatatgttgggaggggttatgaaaggcctacctaaagttctgttctggaatccagcrgccaatagtctaggacagggattggaatgtgagatagatttatttgttcatttatttatytgagacagagtctcgctctatcacccaggctggactgcaatggcatgatcttggcttactgcaacctctacctccagggttcaagtgattctcctgccttagcctcccgagtagctgggattacaggcaactgccaccatgcccggctaagtttttgtatttttaatagagatggggtttcgccatgttggccagggtggtctcaaactcctgaccacagttgatctgcctgccttggcctcccaaagtgctgggattacagacatgagccactgtgccgggctagtagaggtaagtggcctggcaaggtgtggtggctcacgcctgtaatcccagcactttgggaggctgaggcgagcggatcacgaggtcaggagatcaagaccatcctggctaacatggtgaaaccctgtctctactaaaaatacaaaaacaaaattagccaggcatggtggcaggcgcctgtagtcccagctrctctgggaggcggaggcaggagaatggcgtgaatccgggaagcggagcttgtagtgagccgagatcacgccactgcagtccagcctgggcaacagagcgggactccatctctaagaaaaaaattacaaaggaaaacaaaggaatgaatgagggggatgggggaactgcaagactaagtgaaggagtttggattttattctgagtgtgaaaaccctttggaaagttttaggccaggagggacatgatccccaagcaccggtctctgtgatcagaggatgtgggggtgtgaccaagggcaggtggtcagcagaaaacttcaggttctgtctctttcaaccctaattcctggtctggtgcagtggcatatgcctgtagtcccagcattttgggaagccaaggcaggcagattgcttgagcttaggagtttgagaccagcctgggccacatggtgaacctcgtctctacaaaaaaaaaaaaaaaaaaaaaaatatggccaggtgcggtggctcacacctgtaatcccagcacttagggaggccgagataggtggatcacctgaggtcaggagttcaagaccagcctggccagcatggcaaaaccccatctctactaaaaatacaaaattagctgggcgtgatggtgggcacctgtaatcccagctacttgggaggctgaggcaggagaatcacttgaacctgggaggcagaggttgcattgagccgagatcataccattgcactccagcctgggcaaagagagcgaaactccmcctcaaaaaaaaaaaaaaaaaaaaattagccaggtgtggtggtgcgcacatgtagtcccagctactcgggaggctggggtgggaggatcgcttgagccgggaggttgaggcagtaagctatgactgagccatggcactccaggctgggcaacagagtgagaccctgtctcaaaaaaaaaaaaaaaaaaaatcctggccgggtgcagtggcttacgcctgtaatcccagsactttgggaagctgaggygggcagatcatgaggtcaggagatcaagaccatcctggctaacatggtgaaaccccagctctactaaaaaaatataaaaaaattagccaggcgtggtggcaggcacctgtagtcccagctacttgggaggctgaggcaggagaatggcgtgaacccrggaggcagagcttgcagtgagccgagatcgtgccactgcactccagcctgggcaacagaacaagactccatctcaaaaaaaaaaaaaamaaaatcctaatgcctgattccttcccccaccacactgactgctgagtcagccggtccatcctccaagagcagyggagaggtggggacacattagcccagcacagtgatagggtcacagcaagggctcacagactgcggggagcctgcctggcctttcccctctcagctacctggcagccaagtccctgctccttaatggttctgcatctcagcctgctagggagtccctgggaaatggggcctcccagatgtccgtttgtaaaccctacacactggggaacagctagctgaggacattgaggacatgacacagtgcctggtacacacagtggagctgcaggcccaggagggagacgtgaggcacgtggtggaagagaggtctactcctctacgccattcgcatagcagccccttcctgactctgccactcacctgcgcccccttcacttcccacccctaggggcctgtgaagcctccctggcctgctccacctgccatgtgtatgtgagtgaagaccacctggatctcctgcctcctcccgaggagaggtgagtgggtcagccctgtctagctggcagcttcaccctggagcattcagcagcccccaccatcctccccacttccagttcctggaatgggagctgcctcccccaccactaccccctgcgctcagtcagcttcctccctccccsacctctggccccccacccacccagctagcttgccctcggctaacactgcccgtgtcaccaccctagggaagacgacatgctagacatggcccccctcctccaggagaactcgcggctgggctgccagattgtgctgacaccggagctggaaggagcggaattcaccctkcccaagatcaccaggaacttctacgtggatggccatgtccccaagccccactgacatgaacacctggaccattccacattgccatggccccagggcccagattgagggaatagccaggtgccagccctgcccagagtgcggacaggcccgggagagacgtggaagcccctgtgaaggacaacacccctgcttgggagagagtcccatgtccaggctctggtggggacagggcccctagtggggtggccttccccaggcccctgagaatcagggtttgagtaggagtggactcatattggagctgcaataaatcgataacacaggccccagcatgttgagtgtccttgggggacagatctggggtctacaggtggctcacacctgtaatcctagcactttgggaagccaagatgggaggatcacttgaggccaggagcttaagaccatcctgggcaacatggcgagacctcgtctctataaaaacagtaaaaattagcgtggagtggtggtaagtgcctgtagtcccagctactcgggagactgaggtgggaggatcacttgagcccaggggatttaggctgcagtggagcggtgatcaggccattccactccagcctgggtgacagagtgaggccctgtctcaaaaaaaaaaaaaacaaaaacaaaaacaaaccacacctgcatctgctgtgctgggcccccggttctcttttccctctgggatctaagatgccgctggggatccaaggcagaggcctgggagcccccatttccgagggggagggctarcgtggaaggccccgccccggcagctgcggagggatttggtggggtccaggccgcccttgccacgcaggggtgcgcggatgacctgaaaaaagccagaaagaggaaaggtgccgccgaggctggtcgctctcagctggggctcatcgcatcctctaccaagagcgctcccaccacacaggtcccgcccctcccaggtgggtttcatcgggtgggcccagcgggacagggccgggtgaaattagggagggggctgggctggggcgcaatggaggccgagccaatcccggactcctcaatgccagcaaagcttctggcgccgccctgtctgaacctggagcggctgggaggatccccctcccaggagaagccgaggaccccaggatgctgcagaatcagtgagaggtgcgtaaggccaaaccccattccccggaccccgctagcacttcaccacctggctcagtgatcaaggggtyatgacctctctttgctggggttatcgagaagtggcaattttataatagttactgaaacttacaaagaggttctggtgcccagagacacttggggtcatctagggatcagaggccatgcaattccatgtctctggggctgatgtaggcactccccagggatcatccaggggttatggagggcaactcaataataatgaaaatgataaaaatcgtaatcatattatggcaagccagcggcgtggtggcgcgtgcctgtaagtcccagctactcgggaggctgaggcggaaggatcggtcgagcccaggagttctaggctgcactgagtcctgatcacgcccctgcactccaggcgggggtacagagtgaggctcggtctctaaaagaaacacaaagaaaaaaagtaacctttttctcgatcctgcagccagaggcttgatatcctgcctcggtcacctagggcggtccctgcctgggtgatctacgggtgccgtaaggggttgattgatgtggagggctgggcgtgcctgggaggcccacagtgggcgaggtgagttgcaattactgcaactcttaaaccttccacccagagttagaaatgactgaacctcaggtggggtgtgtagcctgtccaagggtacacaaagagccggcccaagttggaaccccctggccggctaaacccaggagtcacccaagaaaacgtgaccccactgcccttctccccaggtccctctggcctgcatgccaggagtcggtcaccgccctgtgcttcctccaagagacagtggagaggctgggtcagtcccctgcccaggacaccccrgtcctggggccttgctgggacccgatggctctggggactcagggccgcctgctgctggacagggattccaaggacacacagaccaggatcagccaaaagggccgccgtctgcagcccccggggactccctcggccccaccccagagaaggccccggaaacagctgaacccctgccggggcaccgagagagtggaccctgggttcgagggggtgactctgaagtttcagataaagccggactccagcctgcagatcatccccacgtacaggtaggggccggctggggccaggycgccctttctcccagttacaacgcaaacaccagtgtgggaggtaggggtgctcyctggcgtcggtgtggaccctcacctgtgctctacgttacacgtggcccagtctctggttgacaacttgagctggtgccagatacagtcctgccgctcctgactcagtggctccccactcccaatgtgagacctggtctctttaggaatcaggcctggccttgcttaggctgcagctgcggctgcggtgatttttcccaataatgctaacagctactatttgttggtagtgacaacaataagaggttaacaggcagtattttatgtgtatgggctcattcaaaagcctggggaggccgggcacagtggctcacgcctataatcccatcactttgggaggccaaggcgagcagatcacctgaagtcaggagtttgagatcagcctggccaacatagtgaaaccccatgtctactaaaaatacaaaaaattagctgggcgttgtagtgggtgcctgtaatcccagctgctcaggaggctgaggcaggagaatcgcttgaactcaggaggtgaagtcttcagtaagcagagatagcrccacctcactccagcctgagccacagagtgggactcagtctcaaaaaaaaaaaaaaaactagctgggaatggtaatgggcacctgtaatcccagctacttgggaggctgaggcaggagaatcgcttgaacccaggaggtggaggttgcactgagcagagatggcaccactgcactccagcctgggtgacagagcaagactccatccccttaaaaaaaaaaaaaaaaaagctttgggaagctgggcctggtggctcacacctgtaatcccagcactttgggaggccaaggtgggaggattgcatgagcccaggagttcaagaccagcctgggcaacatagtatgacccccagctctaatttttacctatttattgttattataaaaattataattatgacttttttaatcatgccgccaaaacaatatttttttttttttttgagatggagttgcactctgtcgttcaggctggagtgcaatgacacaatctcggctcactgcaacctctgcctcccggattcaaacgattctcctgcctcagcctctggagtagctgggattacaggtgcctgctaccacgcctggctaatttttgtatttttagtagagatggggttttgccatgttggccgggatggtctcgatctcttgacctcaggtgatccatctgccttgccctcccaaagtgttgggattacaggagtgagccgccaccatgcctggctgcttttttttgcttttgtttgtttgtttgtttttgagacagggtcttgctctgtcacccagggtggagtgcagtggcgcaatcatggctcactgcagcctggacctcccaggcccaagccatcctccctcctcagcctcccaactagctgggagtgcaggcctgtaccaccactcctggctattttttttgtttgtagagacggggtctccctatattgcccagactcccatctctttttaaaaatcaataaatcaaattttcaaagaaaaaaaaactgttgtattgggaagcccattttacagatgaggaaactgaggcacagagtaggagataatgtgtccaggctcacacagcaaggacatggagaactgggattggaacctggcaggctgtccctgtgcttactatttttcaaataataataataataattaggtcgggcacggtagctcatgcctgtaatccctgcactttgggaggccgaggtgggtggatcacttgaggtcaggagttcgagaccagcctggccaacatggtgaaaccccgtctgtactaaaaatacaaaaattagctgggcgtggtgtcgcgcgcctgtagtcccagctgcttgggaggctgaggctcaagaattgcttgaacccgggargtggaggttgtagtgagctgagatgacaccactayactccagcctgggcaacagagcgagactccatctgcaaaaataataataataataataataatwttactaatgagaggcaaagccaggccattcagatattagttgcctcctcgggggatggctgataccttgatactaaatcttcatttcggagggctgttggggacaagctacagatcccccccagtgctaataccttgtctgccccacagcctgccctgcagtagccgttctcaggaatcccctgcagatgctgttgggggccctgcagcccacccaggaggcaccgaggcccactcagcaggcagcgaggccctgggtgagtcctgaaaacccaagagctataaatattttgggggccaatttcctgtcttccctgcctttctccctgccccccccttctccatcttgcttccccatttagagccctcagggaggagtcgcagcacccccctccacttgggctgagtcacccccacccccagcttcctcctctgcggaatgctgccatctgtctcccttcctggctttgctgtggcttagagctggcaactcccagggctgatccagagctaggtggggcctttactgagacccccacaaaatgcccgactccgcacaggcatcccgagctcacatgcttggcctctgacccctgccctttgacctctgacccttcagagccccggcgctgtgcttcctgtcggacccagaggaccccgctctggagagacgctgaagatgggacccctctctgcaacgcctgtgggatcaggtccttagaatggaggagggagttggggcgggggtccccaaatcagtccacgtgtaaccaggatggcctgtggggaaagcaaaaagcaaaacacctacctcttgggaaaagtggtttccttgtggcggtttccgggcccccactgcatcctaaatggcagtttcttgtcccccaaccctaggtacaagaaatacggcactcgctgctccagctgctggctggtgcccaggaaaaatgtccagcccaagaggctatgtggcagatgtggagtgtccctggaccccrttcaggaaggttaaacccagcttcaccctgctgagctgctgcttctgcctccgtttcaccagtgggagaatgggcagaagcagctctcctaggaggattggggaaagagccggcctgcctcctctctgccatytccagattcaaggatcccgggggaagacccaggcctcaggtggcagagcctgctaggggtcaccagccccttctccagtcagccttggccgaggccccctcaggagacgctctcaggaaggatgagcattgttacagcagggacaataaagtacagagatatgccgagagaaaaagcctgtgatttgggatcccgcctcctgtgcccctgtgccagcccaggaaggtggacaggtgttttctcgttggggttgtgaggggcgtgcacacacgtgcgcatgcacagagacacagtcttatccacaggcagcagcccccacacagggaattagccacatttaccacaatgtcccatgcagggaaacagccactacccacagacacacacaacagatacagaaagacacacacaagccgggtgcagtggctcacgcctgtaatcccaacactttgggaggctgaggcaggaggattgcttgaggccacgagtttgagaccagcctgggcaacatagtgagaccctgttatatacagaagggaaaaaaaaagacacatgtctagccaggcacagtggctcatttctgtaatcccagcactttgggaggctgatgcaggtggatcacctgaggtcaggagatcgagaccagcctggccaacatgatgaaaccccgtctctactaaatatgcaaaaattagccaggcgtggtagcatgtgcctgtaatccgagctacttgggaggctcaggcaggagaatcgcttgaacctgggaggttgaggttgcaatgagccaagatcgtgccactgcactccagcctgggtgacagagcgagactctatctcaaaaaagacacatgcaagacagccgtgcgtgctgacagacacatcagcagagacacacgtcgacagggatatgctgacacgtagctgagtcacacacagatacagcccacacaggacacatgcaccagacacacgtaaaacacacaagtagatggcacacactggcagcatataccagtggatccttcatctgtcacccaacccctgcctgcagtgtgtcactctccttagcccctgctgtgtcccctacccccttttaagatctccctaatccagccaaaatgtgtctcccgggcctgaagtcaaaagccccaagtcagaggcatctttcagcaggcgggacacacaggccaccagyactcacagggagggagggaggatggagagtcaagactggtggcgggctgggcatggtggctcacacctgtaatcccaacacttcagaaggcagaggtgggaggatcgcttgagcccaggagtttgagaccagcctgggtaacacagtgagaccccgtctctaccaaaaaatcaaaaaatgagccaggggtggtggtgcatgcctgtagtgccagctactcaggacactgaggtgggaggatcacttgagccctggaggtcaagactgcagtgaaccgtgatcgtaccactgtactccagcctgggtaatagagggagacttggggaaaaaaaaaaaagtagggtgggcatggtccttgctgtgggcgtgagtgagccacaaagccacacacccttatgagatcctctttgtctctcctgggcagccctgaatgggagaactggagtccagattcctctgccctcagatccctgaattatttgatcttacccttccttggcctgaaacaccctccctccacatctccccatggctgacaccttctaatcgcttgaggaggcctggccccaacatcagctcttcagagaagccttccttgaccactcagactaaaatagacacctcccccgactcaggccgggtgtggtggctcacacctgtaatcccagcactcagggaggctgaggtgtgaggatcacttaaactcaggagtttgaggctgggcttggtggctcacacctgtaattccagcactttgggaggccaaggcaggaggatcacctgaggtcaggagttagagactggttaacatggtgaaaccccacctctgctaaaactacaaaaaatagccgggcgtagtggcaggcgcctgtagtaccagctacttgggaggctgagggaggacaattgcttgttatctacagaatgaaaaaaacaagacacatgcccagccaggcagagtggctcattcctataatcccagcactttgggaaactgaggcaggtggatcaccggaggtcaggagttcgagaccagcctggccaacatggggaaaccctgtctctactaaagatacaaaaattagccaggcgtggtggcatgtgcctgtaatcccagctacttgggaggtggaggttacagtgagccgagatcgtgccactgcactccagccttggagacagagactccatctcaaaacaaaaacaaaaacaaaaaactaattaaaaaataaaataggccagatgtggctcacaggctcacacctgtaatccaagcactttgggagcccaaggcagcaagatcacttgaacccaggagttcaagaccagcctgggcaacatggtgaaaccccgtttctaccaaaaatacaaaaattagccggatgtggtggcatgcacctatattcccagctgcttgggaggctgaggtgggaggatcacttgagtctgggaagttgaagctgcagtgagccacgatcgtgccactgcactgctgcctgagcaacagagtgagaccctgtctccaaaaaaaaaataaaatagacattcccactctcaccctgtgtcagcctccggttcagctccttgctggtctccctcttagaacctatcagaatttccattgtctggaagccttccttgaccactcagtctaaaatagaaaggaaggcttatggttacattatccacatccatctcccctactgccccaggagttctcaagtctgaggtcgccacatctatgtccttgcccacgacaggcctctccagtgccaagtatagagaagctctctgcaaggacacaccttgaacacatatctgcaagctcgtggctgtctttacccacttattcaacatttattgagcaactgtgtgtgctaggacccaatgaggaccctcagtggtgaacagaacaaagatccctgctctacyggggctgatgttytaggagacagtaaaaaaaaaaaaaaaaaaaactcagaggcaggacgcggtgcctcatgcctgtaatcccagcattttggaaggctaaggcaggcggactgcctgaactcaggagtttgagaccagcctgggcaacacggtgaaaccctgtctctactaaaaaacaaaaaatcagccaggtgtggcggcatgtgtctgtagtcccagctactcgggaggctgaggcaggagaattgcttgaacctgggaggcagtggttgcaaggttgcagtgagctgagagcacaccactgcattccatcctgggtgacagagagagactccctctcaaaaaaaaaaaaaaaaaaaacctcaggtgtatgtctaagaggatgttaagttgtgagctgggctacagagaaaaagtgtgcaaggaaataaaagagttaaggaggtcgggcgtggtggctcatgcctgtaatcccagcactttgggaggctgaggtgggcgaatcccttgaggtcaggagttcgagaccagcgtggacaaaatggtgaaaccccctctctattaaaaatacaaaaattaggcaggtktggtggcatgtgcctgtaatctcacctactcagggggctaaggtgggagaatcgctttaacccaggaggcagaggctgcagtgagatcttgcctttgcactccagcctgggtgacaaagtgagactctgtctcaaaaaaaaaaaraaaaaaaaaaaaaaatgtcgggcaccatggctcatgcctgcctgtaatcccagcactttgggaagctgaggtgggtggatcaggagttcgagaccagcctggcaaacatggtgaaaccccatctctgctaaagatacaaaaattagccaggcatagtggtgggtgcctgtaatcctattgggaggctgaggcaggagagaatcacttgaacctgggaggcggaggctgcagtaagccaagattgcgccactgcactccagcctgggccacacagtgagactccgtctcaaacaaacaaacaaacaaacaaacaaacaaaaaaaaaaacagaaagaaaaagaaaaagtaattgcagtttttgccattactttttttttttttttttcctctgagacagtctcactctgtggcccaggctggagtgcagtggcgtgatttcagctcactgcagcctccgcttcagggttcaagcagttctcctgcctcagcctcccaagtagctgagactacaggggtgtgccaccatgtccggctaattttttttgtattgttagtagagacagggtttcaccatgttagccaggctggtcttgaactcctgacctcgtgatctgcccacctcggcctcccaaagtgctgggattacaggcgtgagccaccatgccctgcctgccattactttcaatggcaaaaacagcaattacttttgcaccaacctactaaaataaatatctcatctgaaggctctgaaagasaccttgaggtcagtaggagcggagagagatcattaagtagggagggcacaggcagaaaaggtgaggtgctgttagtggcagggactgcacctggctggtgcctttttgggtgttatacctggcccctggctccagcaccgagcactggcctgccctcttgtgccatttccccgtctcatctttgctcattacatgtttgcatgggactggcttccttctctagggctccgtgttcctgcttttgagggaggaggggcagaggaggaggctgtggggaggaggcccagctgctgtgccttatgctgttggggatgaggggggaaggtgccgtgtagtgggggttgcagcggataccctgtgtgtgtctgttctgaatcatgatgggctgagtggaaaggcagggtgggggtaaactgaagcactgtgggtggacacaggacaaaggaggcattgagggcggggcaggggtgccccctttaacagggaggacatgctaagggctgacacccatagcatcagccagtgcctgcccaggaaggtctcaccgaagtctcagggcaggggcacaacggagagggcctccacccaccctggcaaggcggcctcagctctgccggtaaccaggcctgggggaagcacctagcccccacctccaagagtgacccggatcagagggcagtgctgggtggaagagataagtaggaggaaggagtgaggcccccacccctgcccaagggtgtgaagagagcagaaaacaggcactgagagaggacgagctctaggtcacactgagaaaagacagccagccgggccaggcacagtggctcaggcttgtaattccagcacgttgggagaccgaggcaggtgaatcacgaggtcagtagttccagactagcctgaccaacatggtgaaaccctgtctctactaaaaatacaaaaattagccgggcgtagtggtggcgcgcgcctgtaatcccagctactcaggaggctgaggcaggaaaatcgcttgaacgtgggaggcagagcttgcagtgagctgagattacaccactgcactccagcctgggcgacagagagactccgtctcaaaaawaaaaaaaagaaaaagaaaaagacagcttagattgtgcctgatgcatagtaggtgttcaaaaaaagtttttggattttttcgttgtttgtttttagagacagggtctggttctgtcacctgggctggagcacaatgacratatcatagctggaagtggctttgacctcctaggctcaaaggatcctcctgcctcagcctcccaagtagctgggactacaggcatgcaccaccatgtctggctaatttttgaaaaatacaccaggcatggtggcttacagctgtaatcccagcactttgggagaccgaggcaggtggatcaccttaggtcaggagttcgagaccagcctggccaacatggtgaaaccctgtctctactaaaaatacaaaaattagctgggtgtggtggtgcatgcctatagtcccagctatttgggaagccaaggcaggggaattgcttg

SEQ ID NO: 13277 - DNA, 173995 bp, Homo sapiens
tgagatacgtcccatcaatacctaatttattgacagtttttagcatgaagggttgttgaattttgtcgaaggccttttctgcatctattgagataatcatgtggtttttgtctttggttctgtttatatgctggactacattttttgatttgtgtatattgaatcagccttscatcccagggatgaagcccacttgatcatggtggataagctttttgatgtgctgctggattyggtttgccagtattttattgaggatttttgcatcaatgctcatcaaggatattggtctaaaattctcttttttggttgagtctctgcctggctttggtatcaggatgatgctggcctcataaaatgagttacggagggttccctctttttctattgattggagtagtttcagaaggaatggtaccagttcctccttgtacctctggttgaattcggctgtgaatccatctggtcctggactcttttttgttggtaagctattgattattgccacaatttcagagcctgttattcgtctattcagagagtcaatttcttcctggtttagtcttgggagggtgtatgtgtcgaggaatttatacatttcttccagattttctastttatttgcatagaggtgtttgtagtattctctgatggtagtttgtatttctgtaggatcggtggtgatatccyctttatcattttttattgcgtctatttgattcttctctcttttcttctttattagtcttgctagcggtctatcaattttgttgatcctttcaaaaagcagctcctggattcattaattctttgaagggttttttgtgtctctatttccttcagttctgctctgattttagttatttcttgccttctgctagcttttgaatgtgtttgctcttgcttttctagttcttttaattgtgatggtagggtgtcaattttggatcttycctgctttctcttgwgggcattgagtgctataaatttccctctacacactgctttgaatgtgtcccagrgattctgttatgttgtgtctttgttctcattggtttcaaagaacttcttaacccaggaatacagtgaactgataagacagagccctgtcgcagaggcacaatccagtggagaagggaatgctaaccctcctgggtcaccatactcaggactcaggaaccatgtcttcctcaggtttgcattctgagaaagttctcctgcagaaacctatgcttactacatgcttgattatatttaagtaaatttgccatttttaatttaatgaaaattcaaaacatgtaagtcatttcaacatatggtatgttgctaaataaaaacctttattttaaaaataggttttaattattaataatttatattactttcctgatccacaatgwggtctagcacagaggtgttrgccattgcatgaaagataggaactgagcccctcttctctcttcagaaacttggaagcaagaaacaaaagtcagacattcatgtctttactcatctacacaaatttcatattttacctttttaaaatagctttacttatatatactctacatactatacagttcacccatttaaagaattaagtttatcctaaagctgcttccttacgtattttaaatttggcctaaaagtttctcagyatgtagtgaactgtaacctaactggatgctgaaaagactgaaacctactcttgtgccaatcacagagtttcagcatatctaaggtggtcagttgttcaaactgtgttcaaataaggcaaatgccaaattataaccaattctatttctgtacctcatttttgtcttctttacatcactttcctttttctgcccataaatctttttcaaccacgaggcagtgctggagtctctctgaacctattgcagttcagtggctgcccgatttgcacatcactctttgctcaattaagcactgttaaatttaatttgactaggtttgtcttttaacaaagatgtacagttcaatgttttttgtatgttttcaaacatacaaaagttgtgtaatgatcaccataatcaaatgtacaattttttatcatcgtccaattagcagacactaccattccctcctacccctccactctcagcctaggcaatcaaaattctctacagttatgtcactcctgaatatttcatataaatgaaatcatataatatgtcttcttctgtgactggcttctttcaattagcacaaggttttcaaggcacttccatgtgtaacatgtactttattcccttttattgccaaacaatatcctatggtatggagatatcacattttatctattcatcagttgatagatatttgacttatttctgctttggggctattatgaataatgctgctatgaattttcacgtctacatttttgtgtggacatatgttttcatttctaatgagtatatacctaggaatggaattgctgagccatatggtaactctatctatgcttagcattttgaagaattgccactgttttccaaaatggctgcactattttatattcccaccaacaatatatgagggatccaatttctccacattctggacaacacttgttactatctgactttttgattatagctatcctagtaggcctaaaatcataactarttgttcctttgagttgcattttcctgctggctaataatgttgmgtttttttatgtgtttgtctaccttctttagagaaatgtatattaagatcctttgaccatttttaatggtgtttttattatctttgtgtgtgctttattatctttatatgttctatacacaagtccttatcaggtatataatttgcaaatatctttgcacattcttggctttttcttttcactttcttgatacccttggaagtayagatgctgttaatattgatgaaatcaaattaatttacctactttttcttgtatttcttatgcttttggagttgtatctaagatggctttgcataacccaaggtaacaaaggtttactcctacgttttctatttagttttataatttttctcttaagcttgggtctatgatccattttgacttaatttttacatgtggtattataaggagtccaacttcattcttctgcatgcagatatccaattattccagtaccatttgtaataaagattactcattctgcattttttcaacccttttcaaaatctagtggctcataaatgtaagggtttagtttgtggacacaattctgttccattgatctttctatctattgctatgccagtaccacattgtcttgtttattgtaattttgcagtaaattttgaaattggtaagtttgttctttttcagaattgtcttgactattctgggcccctcgcactgctacatgtttttaggataactccattcatttctgcaataaaagcttgctgggttttgatagagattttgtttaacctgtagatcatttgaagattaatgccattgtaacgatattaaatctttcaatccaagaacatggaatgtcattccatttatttaggtctaccttatttcaacaattctttttgtttgttttcagactacaagttttagatccttttgttaaatttatttcttagggttttttttgttttgttttgttttgttggttggttggtttgttttgagatggagtctcactctgtcacccaggctggagtgcagtggcacaatctcagctcacagcaacctctacctcctgggttcaagcrattcttctgcctcagcctcctcctcctgagtagctggaactacaggcatgcaccaccacgcctggcttttttttttttttttcttttgcatttttagtagagacagggtttcacgatgttggccagcctggtctcgaatccctgaccttgtgattcacccacctcggcctcccaaagtgctgagattacaggagtgagccactacaccaggtcatttcttagtatttttactcttttgatctatagtaagtaaaattgtttttatctttgaatttttaaatttttaacacagttcaaatcagtgtgtctgatttcatctccttctctaacaaaccagggtgccagaactgcttcagtttctctgccttctctttgtctatgatgactaatgtatgaaggtatctgctgcatcaaactttaaacttcacattatccttatttctcttgaccttgacagatctggcatcttttcacctggctgtaagcagaaagtccttgatctccttaactttttgaggcatggcagcatgtgaggcagggagaggacacagacccacacagcaagtggtgagaagccaacagtggaattgttttcttaattccatttgttgattgtttattgctagtgtatagaaatacaactgatttttgtatattgatcttgtattctaaaaacttgctcaacttgtttcttagttctaatagttaattaattgattccttagggctttttaatacaagatcatgtcatctacaaatagaaattgttttactttctttctaatctggatgccatttatstttttttcttgtccaattgccctcactagaacctttagtacaaagttaaatagaaatgggragactagacattttgtcttgttcctgatcttagacataaaaacgttgtcttccgttattatgtgtgatattagttaagtttttcataaataaacttcacagtttgaggaagttcctattcctagtttgttgagtgttagcatgaaaaagtgttgaattttgtccaatagtttttaaaaawttttttagacaatcatgtaggctttgtccattttttacttctttaawtttatttttattgatacacaatagatgtacactttttaggtacatgcaataatttaatgcccctcactataaattcggagctgcctcctcgccgatgattccagcgcctgacagccaggaccccaggcagcagcgagtgacaggactttttaggtacatgcaataatttaatgcattcatataaagatcaaatcagtgcaattggcatayccatcaccttaaatatttgtcttttcttcatgctagaaacattcaagttattttctcctagctactctgaaatatacaatagattactgtaaactacagtcaccctactcacctatcwaacattaattgatttttggtaaactaatctaatcttgctttctggcatcaacctcacttgaccatggtgtatagtccctttcrtatgttattggatkcaatttgcctacattttgttgagaatttttatctatactcttaagaaatattgatctgtagtctcgtgatgtctttatctggttttgttatcagggtgatactggcctcatagcatgagttgggagatcatccttactcttctattttttggaagagtttgtgaagaattgatattatttcttctttaaatayttattgggtttttaaaatacatttttaaaatgcaacttgggtagcatgtccaataggaacaaatgagtgtccacccttgaatttcataaccctggaattaatccatgtaatctatgatccacaactgtattaccaaagttcgagttactcataggaaagagaaagaagttctctaattcgtccttaaaagttttccaagttcagaaaaaaaaaatgttgaagaacacgaatctccgcaggaaatgatactcctgtacccccagctcgctctccctcacgacccctcgctaggcggggttcgggaccmsgtgaacgctgatctgatagttgacacgggacgactgtggcatcatccttgctgccgtcartatcccgagagggaggaggttgggccgggagggtctcccggggcggggcggaggaggagggaatgcaaaacagagcctcgtccccggaacccaagaagcagcaacgcccctcactataaattcggagctgcctcctcgccaatgattccagcgcctgacagccaggaccccaggcagcagcgagtgacaggacgtctggaccggcgcgccgctagcagctctgccgggccgcggcggtgatcgatggggagcggctggagcggacccagcgagtgagggcgcacagccgggacgccgaggcggcgggcgggagaccmgcaccagcgcagccggccctcggcgggacgtgacgcagcgcccggggcgcgggtgagtccgcgcggaccgccaggcatgcttgggggacttcaagggcggggtgctaagtttcatgtcacggtgtcctaactgctggctctatactgggaagctctcggggaccaaggaaagagcgaccgtagttctggtcagcgcctgcccctggagctggccacactttcccaaatcaggtgaggggcttctggaatgggagggaacaaggtaggtttgtttgccacgtgcctcgaaattctcaatccattttaaccaaactcttccgagtgcaaggaagaaatctacagaaataagatgcaattcaataaactttcttcctgaggcttttagttaactcttgtattttagccatcatctgagcgggaagccggtatgactctgcaaggcgttcgtttaaaagttgtgctacttttgaggtgaagttaagagtgtctccatccacgccctctgcttcccagtcaatgtccctgcactgctcacgtccctttagctctctccctgcaaaccatagcggtgggtcctagacacgggacatcgctccaaccttggccaaactctcccaccctcagggttcccagatgtcctttgaataatcaaactgargaaggagaagcaagatgtctccacaccccaatccctacagccttagccaatgcatgtgtgtaactgagacagaattttagcaaaaggtctcctgcttccaggactaaacagagcctctggcaggccactgcccgacacccaactccatcctccaattttcttaaatgtccaggtaaacatctccatagtgccagcctgctatagtctcccgaagacctcagcaattcttccccaaagcgtctccttctgcaccgtttttttytttgggcaaccatttgtgacctggctattgagcccacctgggcctcttctctttgtttgctgatagcctcgttaagtattaaaaacctactcccccycttcaggagccctcttttaatgaaagtttgggtactgggatcagatttgggacttggctacatttatttcctgtgtcattctgagaagagaaagtaatagaggcaagaaatttggcaccctattgatctattttattactttgttgagcaacttgtgcttccsgctgaagatgctgcatcccaacatgattctcttattattagttaccacctgagggttttggatctccaggtgtttatttcacatagcatatgctttaacccccttataagtcttctctaaggaagaaactgccatacttcccttgtcttctcyggtgtttccctagctataaaggccccacctgcataacctgtcctcaggctgtgatgtattcccgggtgccctggtaccttctccttcctctccaccacccttcctgacagtgcaggggcaggaaagcatggggagaagggaaatggagactcccacttaacttgctgtgtgatagtaagagcattatttcacaactctgaacctcaagtctctgcccataaggttccctccagtgatataattccttaatttcttttgttttggttattgctttaaaataaaagtctaagcttaaggctaggttatagaaactgcccatcataattgctaggtctcaacatttgcttaagttttgtgattcttagtttcaagtctgttacccactctctctccccgccaccttttttccccctgacttcattgttctttgttcccatcctgaggccttgatttctggttctgctcttctttgaccttaaactgaatcaactcttccatcatccaactcagaataaaattggttttcttccaccggttccactgatgccaatggaagacttgtcttccttgcgatttgcaaaatgtctttcagtcacaggtgctgcggcaatgctgctgtcccacagcattctaagcttcagtctttctctctcttatcgtgggtcagtattcagaaaagggcagatttgtgggttgttcaggtttctcacttttctttttcttctttctagtttgggatcagagttgtgtgagtatttgtgtatataattttgttttggttttttgttcctgctgctacttacgactgctgttattatttcaattatgactaattaatactaatgactaattttcccctatgctagagggaaaataaggaagaaaagtttactctgctacttacccaaagcccaggtaaaatgcttagctgagaaggaatttaaaactcatagtttaaatgcatgatgcatgyctgctgtcattttatctgtgctgccacagtgtcctttcaagcagataactgagagttgctgtattttgctttcgaatttgttacagggacaaaaatagtgacccctcacatttaggtgttttggctgcttaatgcgagctcctgccctctagccgcatgcttattagtttacctagccctttttctggtcagtsatgactggagaatgccaaagagtctcccaagtaggctaccaaattaagaattgtgtttagaagtttgaagtcagtccaagtgttgtaaagattaaaacgttgttttgaagatatgctgtgtcaataaacaaatatggagccagagcaacacaatgtgaccaagtgtccaagcccagcttaggaacacttttctcccatgttatctagcaaactgacaaatcagctttccaacacgtgatgattggaaaatgctattagtttccttcaaaattctcctaatgtttctttttcaaaattgcctaagatcattggattatgtggtttgtgtttcttttcactgtagctgcttgttaaagcagtatactcaatctctgataagcaacagtaaatttgatcgatttgtatcctaaatttagctatcactttacattttgttttattcataatatgaactttagcttctaaaaatcaactttttaatagcttaatatataaagccatcttaaatcaaggaatatctatagggacttaaggtaatattcaactaaattggcaagtgactaccattatcctattaaagctctaaaatgcaatatttcaatcacagaaaaaaaatcttataatttaaagaactataaattgccagatgtttccctagttattacgttagtgacaaattagacaactggaaatagaaaacagagtatatgtttggaacagtcataaaaggactagtgactattgctgctagctgtggttgtattaacattaaaatatttgctatgggatttttcttcttatcaaagcagatgctcagatgaggaaaaactytcttgcatatgaaaatcaaaattgtcttccaaaatatttaagtaacaaaaaattcattatgtagtataaatgctgtatgattacattattcttatagttaatttagaagggtttgaatttgtttttgttttgtttgtgtttgtttcttcgataggtgcattctctaactgtcttaagtagaaacaaatgtctagaatctctcagtgattatcagtctccttcctattaccaagaatgtttttattgtgttgttaatctcacatgtaatttttttaacatttaaaagtttggaaaatgggtaaaaaatgagtgtgccttgtttcctattattacaatgtgccttcctatttcaagtcccaattctagatttccttaaaacttaaaatcatagaattaataatctttcagtttaagtcaacttttgtgtgatttcttgtccacttatacacacatagatgccttcatcttcaccaaataatgtagaaattttatttagttcaatggatttaagtactctgtatgcttaagtacaaaataagaatattgagaaatacacatatgattgtgtaccttttttttttttttttttgagacagagtcttgctctgttgcccaggctggcgtgcagtggcatgatctcggctcactgcaacctctgcctcccaggttcaaatgattttcctgcctcagcctccttagtagctgggattacaggtgcatgccgccacgcccagctaatttttgtatttttagtagagaagaggttcgccatgttggccaggctggtctcaaacttctgacctcaagtgatctccctgcctcggcctcccaaagtgctgggattacagacatgagccacctcacctggcctgattttgtacttttaaagagaatttgttgttgctaatttgctaagtttatttagatattttctgattctatattagtcaaagctcctcttatctactttggaaaatgaagaattatgtctataaaatatatcaacaacagctgcaggtacttacagaggaaatactgtggatctgagtgatattaggccctgaggatacaagccaaagtataaaaatggtctttgccgtagagagatagtagtcaagctaagcacatattttggcatgggtctctaatagcctaatgctagtagggtgggaagccatttaaaaatggcccctccttctgtcctgcctttcagaccagatggtgtgtctaaagtggtcacactgtttggttctggccacttctgtaataaccactgctcctttcccctcctcgtgagattataactcctttgacagtatggayggcacctaacgcatccttgttttcttttactaaatgttccacggagtcacttgcttgcctgtttgttgcttatttgtttgtttttggctaaaactacagaaaatgttaaatacattttcagacctttatattttaaaaaagaaatgttaagaaataaataatttttctaatctcatttagatacactgtcctattacacacaatgacaaatttgatgcttttgtcttgctaattgaagagctaagcatgaatacagtttttcagtctacagcagcaatgacaagggtaaagtggagaaaagagtaaggaaagaaaaaattaaaaagaataaaaggttgaaatatcaaatcggtggttcttaagatgacagaggcaggtgagacaagaatactggaatcacccagggggcatatgaaatctgtacatttcatccacaccttcttttctccccctgtcctcattccccctgttgagacacattgtattacaaattaggaggaaaccatctaaaattatctcacgtatcccagttcccatattagcatcatgagtatcacctgagagtttgttggaactgcagaatctcagaccctgtccagacccattgattgcataagaatctgcattttagcaaaatcctcaggtgattcaaatgcacattaagggaaaagaaacacagtgtaccgtacctgtggcttgtttagaataattatgaagaggtgttttcttggctcttmackaacgtttttaataaagctaatatttattgagtacataaatgtgccaaacacaacgttcagtctttctttaaattttttttatttaatcctcacaacaaccctgtgagatagtttctgttttatccttattttatagattgggataccaagtaataatgagataagtagtttacccaaaagctgtaactgatacagtcgagatgtaaacataagaattctaatttcattgcctgttctcttagctgttacctacagtgtctgctctatactgggctacctactttttaaggccaactaattatttgaaaatttatttaaagttttaatttgagatcaaaatctgtttccctcataaattttttttwaaaaaagcaaacaagatctattccattttgatctaatgttttcctgtcaccttacctttaagtgcaataatgggaaattctagaaattccttctttaactgtttgaaaaaataccaaaactatgacagcctgtccaaatccactaaaatatatttttatatgcatgctttttgtatatcaattatacttcaataaagctttttaaaaaaatagtagatgacatacttttaaaaattaactttggagcccaggtatggtggctcagacctgtaatcccagcactttgggaggatcacttgaggccaggagtttgagaccagctgaggcaacaaactgagacccccatctctacaaaaaataaaaaattgccagagcatggtggcgcacaccatgtagtagttgggacctgtagtcccaactactcaggagactgagttgggaggattgcttgagtctgggaggtgaaggctgcagtgagccatgatcacaccactgcactccagcctgagcaacagagaaagaccctgtctcgaataataataataataatamcaacttttgatatctctrttttttcccataaaaatccaaaattttctgtttactttttggtgctctcatgctataaagtaaattctcccttggattggacaagttattttctgttttctacatacacatagactgttcagcattccaactcaaattacatattactttttcagcttttaatataaatgcttatttactacaagcatggtttacaaaaatgtagtaaaatatagttactaaccagtcaatgctcaagccagtgactccccaaatgattcagtccctgagctgtttcacccagtgcaggtagattctctgacagccatcagttggatctgtccgaatatctcctgttttgacaggggcttattgatgttggtcaaaagacaggtgtgtatgggttccctgggatcatgtttgaggggaaacctgtgccaacaggactgagcagccactttttcaatggtattgagaaaatttgtaggagataaaatttcaccagctccttgaatctagaactgtagatattcaggtagcactgacattacaacatctaatttgtaagttatgggttagggcaaaatcaatccagggctgccatcatgacaagtagtggaagtttgaaagaaggagaaatacccaaaagatatcttacacatagcaggcagagtttcttagtactaataaaaaataaagtaccagtgatcaccctctatagcccctaagagtcccctggtttcactaagccccaatatttgtggctgtggctgaatgcaatctgcacaaggttttctttttaacagttggaaaaaatctcatagcatagcatttttttctttttaacagttggaaaaattctcgtagcatagcatttttttctagtaaatttcatatacttaacaactttatcagcacatatattttccttcacacttacaatttcatcaacacatatactttactttttgactcaaattcttcttgccatcaattcaaatgctcctgcccttagaatgagaattttccattaacccagctttaataatctaactctcccattcaaatgatgtcacttcatataaaacacattttatcatgatgtctcccagccctcagttacacagttaattgctgccactttatcatgaatgaaaaagatgtgattcttgggtaatgatttcttgagtatgtcctggtctattatctactgagttaccagagtggatttttgagagaacacacagttattcctattccttttaatttccattaacttaagccatatgatagaacattacagttgttatatattttgtataaatataaaatgtaatatataatttatatattttaaaatatttagtggcaagtaaagatagtagtaagtgaaaaaatcactgtataacatatgaatcgtaagtgtgatcccatgtatgtgtatacctggtagatgcttgtcaaggtgccattaaggtcttgggttattggcatcttaatgaaattcatttaattatgttaggattgatttgttagtaaaatcacttacatgttttttaaatgcatgcatatctgtggagccaataagaaaaattaggaacaatatacaacaaatcttaagagcttttgaggatgattttttttctttctttcttttgtatgtacctacaaaattttctataatggatctctattgattttatattttttactttctatttgtcttggaatttctattactttatttataattcactctagattttaggtactagacaactactattaactctctggagaatggtactataaatctgaccctttctgtcatttttttttcctgtggtacactagtgtctcacaaagagtccacagaattcacacggtcatgatattttatagaagaaatcattttatgggaactttcttttgttaatagatccttccaatgctaacattattctgtataacartgctaaagttggtatgcctaaatgctaaacttggtatgctaaagttggtttaaaaattaacctatatacaatcttcttgaataactcttcaactttaaataaatttcttatttaaaaaatcctcctatatataattaaaaatactgatgaatttgactacataaaaataaatgcttatacagtaaaaagtaccataaacaaagttatcatctaaacaagaaacctgggaaagctatttgccagccattacatgtaaaatttaagtttccttaacataacatgagctctttaatgtgagaaacaataaacaacctaattgaaacatgagcaaaagccatggctgagaaaactcgtagaagaattactatggaaacaataagaaaatgaaaagaagttcaacctcattcataattaacgaaatgcaagtcaaaacaaagatataccttttacttatcagataaagaaaaaatgatttgataaaacccagattcttggtattataaattggtataaccttaacggaggacattttatgaatatctatcaaaaacttagcatatacaaacaatttggttcaacagtctgttagaatttattatatagatacattcatataagtacaaaagtgcatatatgtaaatattattattgggacatttttgtagcagccaaaaggaaaactgaaaaaaaagattaaggctcattaatagcagactggttaaataaactatgtgtgagtacaatgaatgaaatattgtacagccatcaaaatgaatgaggtagatttatatatgctgatgtaggaaatctgcwagccatcataagtaaaataaatgaaacaaagaagaaaatactatgatgtacaaaaagaaaaaactatagatatacatatttatatgcatgtgtatgcattttttatgaatatacatatttatatgcatgtgtatrcaagtcctagaaggagacataggtaactattagtagtacctctgggaagtaaatgcagagaaaagtaatagagggtaaggatatgtttacttttattttacatccttctgtaacttgacatttatacgacgcgttagcattacttctgggaaaaagaaaaacagaaaaggtaatcttttaaaaaggtattttttaaattatggtacaataaaatgtgcataagctttatactaagtaatagaatcatttaagtttagctgtagattcacaagtaaaaatccaatctrttttcatattcttacatttatagacatttcttacatgtctatagaaagaaatggctaggaatgagactgcactattttaccctaaaacgttctttttctctttgcctaatgtatatctacaagggcattggggaagatgttgaccacaggcaggaagatgatgagatcctgtgcccaccacttaatgcagtctagctctatataaggaaaaatatgttcttgatgtgaaccagatggtttcactcccttcaaaaacactcttaagatgcagtgtggaagcttactctgtaaattaaaaaataaaaacctgactatattcagtggaatgcgttaatcatttttttctttttaggtttgatatttgacaaattgatctaaaatggctgggtttttatctgaataactcactgatgccatcccagaaagtcggcaccaggtaaatgccttacatctacagcagtgggtctgtcagcagttttctttaatgtgtcagcrgtggggagagcgcaaaaacccacacacaccattatcttgtgaaagaagtagaggaagcagaaaataatgaaatcccagtgttaccacatcccctccaatatacagattaagagcrtttgtatttatrtggttttaaacataaataacatcagaattactaagctatttccattcatgtactgataatgaatcatgtgagaaagtcctttggcaaggactccacatggccacaggtgattcctttgagcagtgttcttcctgtatagggcttaagaggaccagaagggaaatgaytgtactctcttgtcagctacttcctgggcratttgggttctttgataccccagtgctcactttcggaagtgttaagaccataaaccttaacagttgaccttctcaccttcagaaaacccaaatgtctcggagtttcattctcacaaacttccaccttcctccaatgatgagatataggaaaaaagacaatgtgaaattggagatggaggtgccctcttagcctctttacaggcatgagtcacatggcagggcattaaactctctcacaacctgttgtggagctcagcagggttagccaggactgytttgtctatctaactcttcttacatgggcctatgtgatatttttcataacaagagtccgggatttacctaactaataagatttccccaygcccctccttacaaaaactcagttcaaagaacaagccctcagcttctcctagtcccctccagggaaaatgaagagtagcttgtcctattctgaatatgttgtgctcccattttatcaaagtagaggatagatacgtaggtgctgggtgggtagataaatattagagggatgcttcttctttgctgtaacagattggcaagtaggaatcattttctggaaggtactccacagtggtggtgttagaaaactatttagaatgcctttaatcttggagataaaaatagtaacactttacagagttctgtcaatggatatctttagggatgttttgttttgggaggttttttttctgattttgtttttttcaggtatagcgaagcttgggaatctggactgtgcagattttctgcaaaaatccagctctggaaagagtgtattaagatgcatatcctaggatgacacaaagacagtatgctttattttacatcttaaaagtattgaacagaaggagttttgtccatgatatcccatcagcccactagcaggaaaagcaggacacttacccagggkgttcctgctggaaatgattcttggaatcagccttccttctactctatttgggaagtctttggtttctaacattcacacatttgtagcaaagcttccaaaataactatgatgttttgcttaggaataacaaaacatggaagaaaacattctgtgaaattttaaactttttcaaacctttaagtttcagatgaataagcaaaacatacttaaktctaagaagctattttttgtttgtcaaagaactgatgttataccagttctaatattaattagcaactttgccctggttttcctgtaaaataatctccaaggccctatctcaatctgtgggcagtatactgaaatacaaaaagtgttcacaaaaggaccttctgaactttgcaatctccctttaaaacttttaccaacttaaaactacagaactctgatctcttattgatttaaactagtgatatgtaaacagcacttcagagcttgtttcacaggaccaaaaaatttatgctgaaatctactcatgacaaatgggaaaamcctgattagcacatttaaatgaataaataaagaaccgtattcaatggcttaaaatttatagacctgcatcatccattatggtagccatttactatatgtggctatttacatttaaatataaacgtattaaaattaaactaaaaattcagcccctctgttgcattacccccatctcaagtgctcagtagacacatgtggttagtggacaacacagatttagaacatttctatcataggaagtactactggacagtactgctgtmaacacacttattaataatgcagcagactttcttggccacttggtaagaaagttttctgctcttttaaacttatttgggaagtttttaatacttttgaaattatgatttcctcagtgttagattatctgatatacagctctcacagaccattttttgtttttcctgtttgtttgcatattaaaatatataggattcaatgtttcacgtgcttttctaaagttgcagttcttgatttcttaaaattgtgaaaagaagtacccacagttatattaagaactaaaatatatggctgttggcttggttaccaacattgctgacagctccaagtaagcaaaagtaaaaaagatgtaggatcatttttaaaggccaatattttcttccttactcattaccttctgtaaaattctgtaagattttctttagttttccartaatgataaacatttcaccattgcatagacataattaattgattttttaagcagttggagagccaaacaaaataaggggtagaatacttcttattttattttttaataaaaatgtacatattagaagcctttatttttatttaaattgtatgtcactgataaggtttggatatttgcccctccaaatctcatgttgaaatgtgatcccctgtgttggaggtggggcctggtgggaggtgtttggatcctgcaggcggatctctcatgaatggcttggtgccctccccatgttaatgaaagagttcttgctctgraactgtgacacctcccccctctctctcttgctcctgctctcgccatgtgacatgctggttccctatcaccttctgccatgattgtaagcatcctgtggcctcaccagaagcagaagctaacaccatgcttccttgtaagcctgcagaaccaggagtcagttaaagctcttttctttataaattacccagtttcaggtattcctttatagcaacacaagaatagaccaacacagtcacggataacagtagtttttcatttttcatcaatataatgatcctgctgtattcttaaagttcttaatcactatttgtcactaatacgataacattaataaaatttgagtctcagttactttccagtcacttatacctagcagttcaataacatttagttcctggactaatgatcatgtgttatataaggcaaaaaattaaaaacaaatttgtctttgagtcatcaaagcatcaagggtttgaaatagctatataactagctgtgaaaaagggatataaatatccagctgatatttcctttacacatttaatagtatcatttttcaatgaaagcataaataaaataagtttggaaccagtttggaatttttaaatattaatcgcagaatcttactaacagaaaacaaaagcaagataaatgctagtcatttgtgcctgagtttttttttcaataaacagaaatgaagcttgctttaggaaacatgtgtactccaaataacctactattcacacaattctcagtaacattctttctttgcttaaataatacagccagatgtgcttagcacataactctatagaaaataataatttaaattagatttaaatagagatagatagacagacagacagatagacagatatttttgagacaaagtctcactttgtcctctaggctagagtgtagtggcatgatcatagctcactgcagccttaaactcctgggctcaagccatcctcctatctcatcctcccaagtatctaggactacaggcacatgcactatgcccagctaattatttttttaattttttgtagagatgtcgtcttgctacattgcmtaggttgctcatgaacccccagcctcaagtgatcctcctgcctcagcctcccaaaatgctaagattacaggcatgaaccmctgcacccaaccaatattaatatttttaacaattgaaagagctcaaagaaataggttttaaatttagaggccctgttttgctgacaggaaaggcttttagctggaatcaagagtgctgttgtcttttcccttcaattagtcattccttttaagacttttaagatttaaatgtatgagtcattttttaaatcccagaaagatctagtatatctcataaatgtaataatacagtgcagacctggtggaaaataattatttatctgaaactgggcctcagtgcctttcctgaatctaaacaaatrttcatctcacccagagaactgggacaacaggaacaaggtattgcaagtccaaaatccaatccaaagcagcgttcttcctccccacctctaggcaaggccaaaatacttctgcacacagtatagacrccagaaaaaaacagagccactgtagatgaaaccagtcagggggtaagagctgtcttttgatctagagcttgcacctttgctcctcagtaatactcccaggtcaaaaaggaaaaataagatgggcagttggctgcctcctggtccctccagcctggtcagtgaacagagtgggaagataaaacagctaagtatcttccttaacaatgcaaagcaagaaatccagtctgctttgggaaagtgaaagcaatgcaaattcagattattaatcataagagcatctcatgtgatatacaaaattattgtatagcagtaatgggtcagccgtattttattcaacactgaaccattaatgaatgctagctagtcttcctttcacttacagaatgtttatctatacatgactaaacaaagaaggagcgctggaaatgatcctgtgaaaaatactggctcacaatgtatcagctgagtttggggcaactgaggtagtaggaggcgccccctggacttctgctrgaatttagatttaaatagatggatgaattagacaaaacatactctctgaaagagtgagaaatacaatattcaccaattaagtgaaggaaaaatctacactatgaataaaacaataaatgtggatacatttgaaaatttgaatttcaaaccccttaagataatgtgacaaatacaacaggcctaatttaacatcttaaagagatctgtgtgacctattttgcagttttattttcttaggacaatgcttcagtatctttaactttcatatttaatcattttttttcttttttggtttctatggtatcaccatccatcaatccatattggttggagggggggaatatatatatatatatawgtatgtctcccaagagaaagtaattctgcaatcttcctcagcaattcagtctaacaattaagaacccttaagctaaatagaaaaattcatttcacaggcaagttttactcaatatgtataattagttttagttaactttattaatgaaatgtcgcaaatcaattaggtttgcaataatcagatgccgaggacccaagaggaaccattcctctcacaagaggggaaggtgatacacaatttagttgggaagcaaatgtaattagatttgatcaattgagtattcctgtcctgatgtggagtcagtcacatacccaagcctgagaatatatttgaaaagaggtagaaaaaaacccagtatgacttagaaaatgtccttgtggtcctattggccacaactggcagccaaaaagggctttgaagccacaggtagacaggttttgttcagacagggctatgttttagatttctctttcaaatctgaatggttttacgtagggcaatatataaactttcctatttgtcacagattctagcactctttaatgccttatactgggtgtttcacacagttatttaactgcccaaatcccaatggcacttcagtttgcaactatcatgacctagaagttagttattgaacagttatgaggtaacttaaagtttcttccctttgcctctagaataagaatatcaaagaaatgtcatgatgataggaatactactgaaagaggatattaaacactaggtattcctacttagggctacagtttgcagcagattctattgtgtttcagtcaataagtgtttttggacacctacatgccagacactattctcagcattgagcacaaagtcgtgagcaaggtagacaaaaatgcttggcctcataaaacttacattccagtgyataaagatgagaacaatcamgtaaaatttataatatgttggatggcatggaaaatggaaataaagtggaagggaggcttcaggttaaaaagagtgtttagggaaggtcttcttaggaagaaggaggaagctatgtggacatctgggagaagatcgctccaggcagagggtagagcaaatgcaaattccttgaggcagcaatgtgctggcatrgtcaaggcacagcgagtatgccagggtcttcagaaaccacagagaagagtggataacaaaagtgaaatcaagtattgaagagtatgaactgacaggaactagagacatatttagaatggatgccrgaacaggagaaatgggtgggattttaaaagctaaatgatttaaagacttaaaatgctctgaagtgtagtgaaatgttccccaaactgcagattttcccargaaaccaggtgcataatttagtcatcgatgactggttctgtggcaatgactctagtaattagacccctgcattttatgtcagttccttctggatactcagctacmttatttggtgcttttggyatacttcaaatatgcattgcctatcactgacctgtaatcctgtgtctctgggcctgaaaatataacttttcatgtagtagagaattagggctgtgcaacattgccactagattatttttaatgaaagctttgcccttttrgataaatacagcaatgtattcaaacaagtcctagggataccactgagtgcaaaatgtcatgtactagttattccatttaaattattttatcttcaagtctaataagaaaattctaaataaaattatatatttgggattgtgtgtgtatcatccatccacatgtaagtaggaataaaattatttaatggaaaatttcaaataggctaactctaaaaatgtacagataatctgratgagagaaaactatcctcactttgtgttatttttyaatggtagcattttctcataatccccatgcttttttcatgtcctgctattctttaagatttcctaatgaggattagggaataggcatatttaacaatctgtgttcgcaggttgaaaacaagaaaatgaagactaatagtttctctcctgttaatttgattttctacagctcctctcctaccagcttaggcagaggacttagttactatttccaatagatgggagccaaggaaaagacaagcatctgtgatgtcatgtctcccccaaacgggtagctgcctcaccagcctccattagagacatcccccasagtaagaaataagaaataatcatgagtagaatgagaaaaaaatrcagcttcctttatctgagaaaaacaatagtagctcaatgctgtggcctaaagggctttgaaaataatgcaatttctgataaaaataaatgccattattcttgcttattgtcactgttttagtcaaataagattttagcaagcatatttcaaattgttctaaatctaagtaaattggtaattaaatgctatcattagaaagtattttaatatcaraaaaattggaccataagaaagttagtttacccttgtattcatatatacatgtgctttgtgctaaaaattgttatcatttagtgagaacctgtgactatattaattaatttaatttaatcttcatatttctctgaccgttagagagtttgtgacttggataactttcaaacaactagtaccctgatggaaatccagaattttgttaacccagatcacagstgcatacttaaatgctatgcaacagtggcacttacccccaaaccgtatcctatggaaatgcctttttagcaaattaaactgaattgtgttcagagatccacaggtctaagcaacattagggaaggggtaaagtagtcctcagcaaggcccttttcagagcactccaccagtgcccttgtcctcctgggcagagctcctcagctatactccctttcctagtctaccctatcccacaacggaaccatacttctctcatggaagccctggtctcacagaactaaaaaggaggctcctagaaatggggttgtgttgagttgacagagatgtgtggctctttaaactgaaatataatccaaagagaacaagatctagtagaatttcaggtcctaagsctggttaaatttcaggtcctaaggctggttaatagtacaaatacagttatttatttataactagtgcaaatacagttatttatttataactatacaggaatttatttcccagtaccttctatattactaacatcccataaaaccagccatgtaaggaactagaacattttgagaatatgcaatacataactttaaacaagaagttttcattcttaattaaaaagaaataagcatagttcatcacaagttccttcaaatccttgtgccatttattctctctccccagagatattagacggcattttagagaaaacaaactctttaagtcacaaggagtggaataatcatagttgcattttaagcaagattatggttttttctttgagttctctgaatttgaatagtttcttaaccttagttttttaactgctctgaaaatggtttctgtccctggtggactcttgtttcaatgcagttattttgtctggtagagtcacagagttaagcygtcattcagatcmgaaaaaataaaagagagagatgaattaatctcaatggcacagtctccttattcaaaaaataaaaataaaaataaatctcaagtccaacaatgaatcatctttgagactctcccaagtgatctagttttaarggcaaaaactttggggaaactgttgggggagcaactggtgcccagtactgtttcacacacgtggtttttcttatctattgctcacacacttagacataactggaattattgcctttgtattgttgttgccattttataaaggaagacaaaaargatcagacaaaataatagtgaacatctattaattggacacttactggtgtcargcactgtgtcatgcactgtgtcargcactgtattttcttatttaatccaacaaaaaaaaataggmtaaattatcttattggctcaattttctttacagaaactgagcctaaatttcccaaatggctaaccaatgccagggccagcaactcaaatttgggagtaattccgacacctaggttccaaccatttttctcccagaaataacccaccaaattcaccagagtctaagatcttactgttactgtttaattaactgctacaattgcagcattttaaaaaaatataaatgagcactgtgctagtatttaattatagctttatactgatactgggtacaagtataagctaacaccattttgaattatagtagaagagtcaggagctctgagaggaatgttcaggatagaataaagcagatattttaatgtctcatttcagtgaggaaaattgttaattcatatgccaccagccatyggcagaaatgtaacaggaaatgaagaaaaacttaattactttaaatacagtggtctgtagtacaaattattgtgccgtgaattagtttccttctgctgtagaattgatcattttgattatgtagccaagcagtgtaagacattactaaaattattcttgaatcctacctttgagatctatataaaacactaggcaatttgcctgcaaatacatagaaaacaatttttaaaaggattgggaygagttattttcccctctgttaaatattagcctttgaaatgaacccagctgatctgccaaataacacttggaaattgttgtgttttaataaagtgacagactgagagggaagccacactagacgtccttatgcttttagaggccttacagggcaggaacattatgcaataatgccttttaaaagaagtgagcttcctagtattacaccttgcctggcaacaaatgtagccacttactgaaatgcaggcgtaattagaatctatgaaaatctagcatcagaatcccaaacctctatgcaatactcagtaaattacagcttttatgtctgtaatattttcaaccattctacttaaatatgtgaatacatgagtgtggagttctttaggaggcctgctgcatatgctagggaaaggtttcatcatttctaatcaggatggctctgtaaatgggatgyctcatgttcaggtttctggaaggctcagagcctgggcttctactggcagagggtagacccaaatggactactctagtgaaaatctccaggtgaacatggaaygcagtgaaaacctggggtatccaacttgcagtataggccaccagcaagtgtcacctctattataactttaaccaggcaagctcagtctcatgcattagtttataaaattgcaacagagccttctaagactgaaaggacattagtttttwaacctatatattatgacctaattaaatgaaattttattttaaagccctcataaaagtagtaaaattggtgttttaaataaaccaaatgggaattcaaccactttaatttttcttttgttccaataggaaaataaatgctttaaaatttgaagttgaaacatgggttttaaatatattgagataaaaactattttgcataggcattttgaagaaaataaattttgttctcgtgatttgtgattggccattgatttccgtgtttaagattatgaaggtgtgctcagctgtctactagaaataacaggggagactcaktcttgtttcaaatggaagggctcctattcggttttctccttcatttcttaaagtgttgtgatttttttattccctggtgttatgtcttgagattttaaatcttaaaacatgcaattaggtattgaagttgaaagctggaagtctcagccagctagtaatggttttttaaaataggtaatacagacctctagtggttgaacagtttgaaagcctctgcaagaaaaggaaattgcgcagaaagtgcctgcattttaaggggaaaagttagttaaaattattcagatgataaaattcacatatttcataggaaaaaaaaagccagaatgggcttcaagggaaggtggcacacttcccatccttttagatgttcctcaattcctctaaataagcaaaaactctctggccaaagtcacagtaagaagtctggatctgtattatttttctctaaaagatcttgtgaacagagctgctagatctctgtattatatgaaacatatatttttgtacacagttttgcctcactggggctttgcttcctttgtactccagaggctcyccatgaaaacaatctgcagccacctcaacttgcctgtgctgttctcaggttctgtccatggggagccacacttcagtgagctcagcgattggatggctwtttagtctacatgagagggaaactccatgtgcctctagactagtgcttctcaaactctaatgaacacccaagtcayctggggaatctgcttgaaatgcagattctrtctcggtctggggtggggcctgaggctgtcttgttcgtaaactcccagttgatgctaacgctgcccatccagggccacccagagcagcaagccrgttctatgacagctctctttattttttagttacatattttgtttttactcatttcttctttrtttgctcttttactttaataacttctgttaaatttttaatatttggatctgtaaaacatttaaagttctctttcacttcactatgtacaagtatctctgggaatctgttattgaagttttgagaagttgatctcacattttaaaaatagattcagtgtcatctctttatcttgaaaagttcatggtagttgtgagcatctctctaaccacttgaagctattgggttagaggtagctacaattaaatatctgattagccatattgggagagtgggtgaaaacaggttttgtgcatgtggtagatgtgtaggaagctaaggacccaaaaaacaaccacatcataaaatcaagcagaaacacacacacaccacacacacacacagargctcaaagcataagtgtcaacagatcagaagaaaacatgggagaatgtattttttcataccaaattattaaaattccatcatctaaataacttcctatcatagcatgttgtcgacctyatttttcaaatccataattttagaacttatgtcgtggggtagtctaaaagcctcttgcaaacttttaacatctagtttcaaatcaaaaataatatattaacaagctgtagcatagagggagtacataaattatcatcattgccctgcatgaatagtaattcacaggtttggctcacacacaacttagatgaaataattaactatgtacagtacttaacagtataaaagtaattaatctagctgcctcgtaccggtttggcctaaataaacatgcaataaaaaagccataggattttattatttttttactcackwtactactttagtgtgttggaattttaatatgtcagaagaaagatatctttgcattaaaaaatcattttcttttcaaatgttaatgtactgattataactaagtgaattccatatatttataattgtgggcagatgttctcaattaatagtttyattcattctacttcacagtttagtgaaaaggattattttaaattaaggtgtaaataagaacaaatgagatttttattactacaaatcacacagaatttgttggtggtgctataatcctgtgtaggtatagctttggcaaaacatttcagataagcttgttttttgccccatgggttctgggacgaggtgagttgtctgtytgtcctataaggttcagaaaggtaaaagggcaaggtcattaattggctagagggcaacaaagaaggtagttatccctgtgtggtcaagaaaaagtggctcaggttatcttgctcgggagagaaaatgttcattcagctccagtccttttggtaaaagcccactctcagtgtatgagtgttcctttgcctaatcatgtagactataacatgttttcccctatatgactccatcgattaatcattgcagtattatccccacttcataaatgggcaaagaggaggatgaagccgagtagttcttccaaaatcaagtagcatgtaagatgtaggagcaaaactcaaatccagagacttctgcttccagccaagatggaataacagggactagatttacctccccacctaaaacaattttaaaaactggacatacatatgaaacaatggttttcaagagagtggacatcagataacaaagggcagtgatccctggaggataggaaacaaatgacctgggattgtcccagcccactgcctggagggagtttgcaggcatgatacagggatggtacacccaggcagaactcgaggtcctctctgagttaaggacacagagctgggagtccagagaggccaaggaggctagagttcagagtaccagagagttgagagctgcacagagaacccagagatctgcaaatggtaccccttgtgcttcagtgcatgtgggcaaataatcacccaaaygtattagagagaacaagccccagaggtcatcaagagctagaaaatagttgctatttccaccagccacagtggaaagtctcataattcatggagcatcaggtagcatactcagtaggttcttgcctcaggaatgggaaaaatttagccctagactaattgctgctctggtaccacctaagaaaccrtaaaagtcagactcaaaagaattaaattatttgcaagtaactcaactgcttttcagaaaacaactggagaaattttgtaggaatacaaaagcatccaatatccaacaaagtaaaattcacaatgtttagcatccattataaaatcaccaggcatgcgaagaagctggaaagtacaacccataaaaagaaaaaaatgaatagaaacagacccagtcagtaatgacacagatgataggattattacactattacattaaatggttattatgactatttcatatgttcaaaatgcttgatggaagtttgaacatattaaatgaagacatgggagatataaaaaagactgaaattgaacttctagagatgaaaactacaatgtctgagatgaaaacttaaactgagacttcagatgctaagactacatttgtttcacatccccacaacattcttccctggacgctgagtttcctcccagcagctgaatacttcatgcttcatcctttcttaatgctgaactctcagaaaaagtccttcattctaagaagaggcgggagggtgccactctgtagcccctttctcatctcactctggtccctgctggcctggaacagattccactcccttcatgcactgatactccactctagactgagcctcttcatgaggtagccatcaagccatccgcagtcatcaacatggcaccttctgagtcagttacaagagtttgcatcatcagaccaccattttccgtctctgttttctgacttaccccaaaactctagttaaaactcatgaaatattatctcttcacatgaaatacaattaatatggaagtcagcatttttgcatctcccaacgcttcacatccaaggagctgtgtatgaaatcatgaactatgttcttccagccaaccaagcaattaaccaaagtatacatgtccatgttgtccttgtacagagtttgaaatatgctcatgagaattaaactatttttcagtaaatctgaaaaatcaacttgcttgtccaggaagttttattagggatagaatcccaaacaatgaatgtgctagccaagtgttactattaatcagaaatactccatattcatccaggattaatcctgtgtaactccctcagtcagtgtagcaatgtgttctcttcctgcactttttttatgtgtgtgtattcccaaatctgcagtgaatgtatttaggaaatacattagtatcaaaaggacaaatgtagccttaaaacataaatgtacagataatttcctatttgtagcaaagttcacttcagaaacacttgataagaactattcaaaaataaatattttcagtatttatttaaaatattttaaaatgtaaactcctcaccagtcatctagccagggccactgagtgtggctctatgaaatagcttcagtccctttcactactgatgaccttttgaacacaagataatatttgtcgagtaaatgtcaaaatagtataagaatacccaaatcatggattctatgctgtattcactcacatagagacttcactttggagcacttcagagcagcaacagctctaagagatgtaacagtatgctttccaggatagaagaacgaaaagggaaaaataagttgctagcaagaacaatgaggggtaggggtgaagttcaggctgcyattctgaaagcttcctcagactgagtcaggcacrtctcacraagtgcagactatgcaagctgsctgtgtgagatcaagggtagacagttgactcatcctgtcacatctctgtgttttaccgtamcctccaactattcagccatgaatcgctgcatgtggaatggaagggggaatgtctaacaaacagagacatacttcaagtcttcagtctagttaaamcattggaatgagggtctgcaacatctttctggggcttggagtctcgtctcagttctaaaatgagatggttggcctggatcctaagtttcaaattggcagcctttttaactaaatctaatctagaagagttctgttaggttccacagtgttgggttttaaaatatatatatatattagttgaaaacattttaaaataggatctttcacatgaaatttgaaattttaagtttatattttaaagttagctgttttcccccacctcattacaattggcacagttgactatagctgagaagtgaccccgtggcccccctccaagaaagggggagggccctccattcaccaccatgtccacttcacctatttctcccagcctatatatgtatttgaatatgtgaaccctggaatgcataatgtctagggaccataacaacaatagaatgctatgaatctctgacttacaaggactctcttatgaatctctgacttacaaggactctcttatgaatctctgacttacaaggaaaacaaaagactgtagagaatagtagttcaaccacattttaggttaaaatagactttacttggataacctgacaaccaaaacatctttgataatatagtaattgtgtatgtttaccagacaaagggtatacatgtatattcttgtatttctcttaagaagaaaatcaataaatttgacccatgaatttctttctatagcagacatttttgtgacttcctgactcacaggagatacagctaccctccaaacctaaatcaaaagtccgtaagttgcagaatgactttttatgtaaagagaacatactagtttctgataagatataaagaaaccatgtaatttatctagggaatgactctaagctgatcattgacttatttacacaactatagctactggaatagactgattccaaaaatatattttctctgaattagaatctttttcatatcaaaatatccaaaattattagcatattatgttattctcacaaagtcctaatgaacttcacaaatctgcctgctctattctgagtacaaaaaatatttagcctaatttgtttttccattattttatatagtaataaagtaataccaaaaatgttattgccagaaacaatacagtgttgtataattattagaaagtgaactcatgaaattctattaaaaaacaacaattaccacatgttaagtcagataattcacagaagagacttatatgaatactaggggagctgtaggcaacamaatttttctctgaatcctgcattttgaaggaagtttctgtcatttaattagttgaggtttgattcaccaaccaaaggtctatagtgtgatatattttcttcctccaacataaagttaacttaaagtcatttgtactttatgtgtttattctttcacttcttccccaaaagtaattctttaaattgctttatgggattaataacaaattatatcattatatatttttgtattattagggcttctaacttcattataatcaatttattggccatatataataatgcaacaaattacatctgtaaagtaaaattttatgacgcaatttacttagtatatgtataagtctcattctgctgcccaggctggagtgcagtggcgcgatcttggctcactgcaaccttcgcctcctcctgggttcaagcgattctcctgcctcagactcccaagtagctgggattacaggcatccgccaccatgcccagctaatttttgtatttttattagagacgrggtttcaccatgttggccaggctggtctcaaactcttgacctcaaatgatccacccscctcagcctcccaaagtgctgggattacatgcatgagccaccacacccggccggagacaggttctccctgacctgtgagactgcaaaggtggtgtttcctatgagtccagccagataatagactctgctaacattaattaaattaatattcctttttaagattctaggtgctgaatatatatctcttggtctataaattagcttcgcacttcagctatttagcaaacttgttttttattgtatctagtgtattcatactgaatgggtataatatactgtcttttgaaaaagttattttgtacacataatcttaaaacactcttccaagggcaaggtagaggcttcataatattatttccatttgtcagatcaatgaaggtttaatgatttgtccaagatctcaatttctagagaagcgaagaagaatcccccaattctagttytaagtttcttttttcccttgctaaatcctgcagtctactgatttttttttttttagacggagtctcgctctgttgcccaggctggagtgcaatggcatgatctcagctcactgcaacttccacctcctgggttcaagtgattctcctacatcagcctcccragtagatgggattacaggtgcatgccaccatgcctggctaatttttgtatttttagtagagacggggtttcaccatgctggccaggctggtctcgagctcctgaccttgtgatccrcccaccttggcctcccaaagtgctgggattacaggcgtgagccaacatgcctggcctgcagtcaactgatttatgttcatcaccttcttaagttaaattgctcttttactcattgcctttggttttgtgtgttaagattcagcatcagcattcatgatatcttttcactcttaattctgagtgtttccgtccgtttttttaatttttgtactttatgggctttttcttcatttacccccaattatgcrggaaaggctgtgtgcctcttttgaaagctctgatgttctcaatgaagagaccttttaaatgaccttgtttgtcccccaccgagttgcatatcacaacttcaaatgtctcactaaaatgttacccatttggcatcagtatacagaaaaggctgcactctgagataagaaagaacagtggtgttttcatagtaagagaatagagttcttaatgggaaaggggagagtataatttccactgatttmgctggtctttcaaactttatgatgcttttctccttgaactagcctataagaaatttgtagggaaaataccacaggaatcaaattttgggcatagatgtctattaatattgctccttacaaagctttttcccagaattgtttctccttgcctacaaaaactactccatgcctttattagtcagaaaagcagttttgtagagaaggcaagtaacagagaatcaagctaagtaagtgaaactctgtaattgtcaaacttccagaaagtaacatttgtaactaagtatggtatctttgtcctctctctttctctcttctctccacttggtttctaatgaaagccttgattacatgttatatttaatgtactgttccacaaagaagaaaaggcctaatgtgaatgcaagctgaatttacacttaaatattgcagtcagttcagaccggaaggatacagatcgatgccctctgatcctgtcagattccccgaagtgtctatggcagtgataccacaagagggcagggtttgacttccggactaggtggcttcctcccttcagtgcagaccttggggccacgacaacagccatcaatctcttgaaaccctaatgatgaatctgagctcaaattccctcttcagccttatctgtgcagaatcctgaagttatgaaaaatgcttacagaaggtaatttctagaatgatctaacacagcagatatttagtaaactccctgtttgagagctcctactaagcacccaacacagctttagactttggtcacccaataggattttatcttttgtgagggatctgtagttttccccggaagatataatgcatgaaataaaagcctccaataaaattcagtatacagttaatttatttcataaaargtgagagatataaattatcaaaggttaaaacaaaaagtaggaaccagagcagggtttttcagtagcaactctattgacattttggattagataattttttggtgtgggagactgtcccacgcattgtaaaatggttagcagtatcacttgtctgcctgctagatgctagtaataccccccacacctccctctcccacattgggaaaatcaaaaatgtctcgagacattgccaaatatccctggagtacaaaatcagtctaattgagaggcactagactggagtataaagagatgaccatgccaaaaagtaaaaataataataatagagccttgaaacattacttacagaatgtcaaaaacgtaaggacctgctctctattcctgtttcttaacctgagcaatgggaataatgatgccttccctcataggtctcttgtagaaatgaaagcaattaatgcaacacttggcacatagtaagcatccaatgaataataagtgatcagtgttactattgctaatattaagccactattataagtcctttctgttaatcagcagaaacaaaaagaagtataaaataatggtacattaaatgaacttaaacacttgtatgtcattttgtgctaaagttatgaagctgaaaagattgaattgacattttccccattgatagaaatcatctcaaaaatgctccatcttccttgtgaaagccaaaggccagcagtttccacatacccagcatctgataagtagttaatgatccwgaaataaactgttaggtgcttcagggaatttctgtgtatagagaagttccatgtaaatatttctccgagaggtggatggagaatgataattcacttttaccctctgaatttgatttataagcttcacctatctggcaggagataagaaccaaagttaactgaggagaaaaaaaataaatgatttcaagtgaccatgatcttcagctggaaccagttgaaactgcaaagcaactgggctgaagaagttcagccaaaattatttgtttataaaaactagagagtgttagatatttctatcacattggcttatttgaaatttctgctggctcaaatgaaattgtattcttctatttcctactgcggggttccttccctaaccacaattgcttttggattggagacttgtaactttgagaacaagaagagcctcagcttagctagctggaagaaccagaggagagttttaatatctcctgaagaaagaaaagcactaacacggttattatagttcaggacaagtggagtcaaagttgacagtttctgacttgaacagttttgttgctggtaataaaagcagaagtcacgtgctgaacgtgaaggtgagcagaggagaacttgcgatggcaaagttaaaaacaagaggagatgatggtcttggtgtggcacaggatgttaaaaaaattctcctgtccttaaggagttactgctatttgagtaatgtgccacttccctacatagccttctatgcagaaatgctatatttccacttcacaacccagaacgtgcattttattttacatttagaggaggaacaaacaaccagaaggcaaaaactggtgcattattttttgcaattctcttggaaagagttcgtttttaacttctgctcagacagcacacaactactgggaatatattttaatttcaaatctgatgtgtgacatctggtaactcatttattgctaatgaagttttcacaggaagcagcagtcaccagtagctcatcttatttttcagttggcaaagtgttgtttaccttttattggcctggcatcggtgtctcttatcacaggatatttaattagaaaacgcaagtagcctaacatagaaaagaaatggagtggtagataatagtagatagaatggtctaaatatttttattacagtgatgtaatatcactgtaatttatgtttaaaaattatgtaatactcaaaaggaattctcagagctggcgaaacagtctggtccaagcagcctctcagcagtgcctttcagcctcccctctctgagtctttccaccccttgctggtactttagtttcttccacttctagcaccacgtgtagtttcccaatttctcttacccaaatttgctcrcagggaaaaaaataaattaaattagccatttacaccacagtgtgaacttaataacaccaacaaaagttccaaagctctagggtctcatagcacctccagatccatgatctcattcggtgtttccaacaatgttttgcaccaaactggacacatgcttgctacttcatcatcctcatcgtgaacattattattattatcatcattttccagatgaagaaaatgaatcacaagtcaactgacagtccaaaggctccacagctcagagraggtaaatcatgtgcttaattcagaacttttggctcccatcactatgctcttcccactgtcttaactctggttgtcacctgagccattgtgtttcttctcaggtagatcttagttcttcctgagaaggtatgaaggtgggtattccaccctacctgaattataggaatttcagatatctgtgagcagctgcaaaggggattttactagatgacatcctgctgggcacactttacgccagtcctgaatgtgtaatagaaatctgcagtttaatgagtaagtttctcatattcagtttttgatgcttcataaatgttaaatgaaaacattttagctgagggtacttttgttgtttgttggattggttttgcctgttcatcaggattatcagcatttaagccagagttgcaaattaagttgcctacagggcagtgcttttcaaatattagtgtgtatcagaattacctggagggctcattaaaaacagcttgccgaaccccacccacagagtttctgattcagtaggtctgtggtggggccagagatttacatctctaacaaatttctgggtgatgctgatgctgttgtttcagggaccacactttcagaaccattgctagaggggccaactaggggacgtctgtgagtaaaagcacctacactgtgcttccagtacagcagccagccccagtgtgatgagcacttgaaatgtcgctagtgtaactgaggtgtcctggaagcatacattataccctgggttttgaagacatggtacaaaaaatgtaaaatatcttaataattttatatggattacatgttgaaatgacaatagtttggatatattggattaaatattttatcaaaattaattttacctgttcctttttacatgtcaaatgtttttaatagaaaaattacaattatatatgtgtctcactttctatttcttttggacagcactgaactaaagaaccagaaaatagaggggtgtattagtgaactacagaaaattcaagtcccaaaagctgtaaatactctgaggaccaaagaaaatayatacgttgttcagatttgccctgaggggtcagtttgtacccaaacatttgctgccacaagtagtaaatgtagaagcaatscaatatctactattttacttttctttcagggttaatcaagtgccttgttataattcttcaaactaaaaacattattataataatgaaaaatatttctgctgaacttccgaataaaaaaatttagtaatattttgaaagtctgagctttatttaattcattttacttacccttgtattatagaacaattatatttttaaaaatgcttttatgtcttccaaagaactttttatttttagcagtccatgaaatagaggtgagaacaggtgttggtattctcattctaaatatcttgtaatatttaaaggaaaccaaagtgaaagattaaattgccatgtaagattgtgttgccggttactggcagagcagactctttgccaggacagcagtccagtgctttctcttccaggctgttctgctcttcctcaatttttacagcatttttatgttaatcaatmaataaataaaaagtaaagaactataatgcatacaaaactgtgatggaagaaaaggaaactatgtgataaaatcaaataaatatgamccttatagctttagttttcttagaacagaggccctttaacttcagaatgttgaaaccttctcttgaagttctcttataatactctgccctcacctctgtgtttttatctgggcaattagaccacattaactaattgctaaactttaaaaagttgtattttcttacaaagaatctgagaatagggttgattttctatgttattttaacagtatcacattgcgcccccctcttcacaggaccatgtaatcttgactctctaacttcatggcaagcttttaattttgattttcaaccatgttccaaactgtactctttgacttggtagtgtcaataaataacgtaagggatgtctgacaggcttacagcctttggccataaatggaatgaaacaaagtagtccagatagggctcaaactcataacattgacctcgttagtctagaaccacaaccagctatccaaatgtgcctgggaaatatttctttgagtaatagttaattttttaaaagaaagaaaaaaacctgtgactatgataatcttatgttgagtttctttattcatcttgagtaaacagtaaatttttttcactttgttgtttcaatacaaagagttcttgtgtttaatatagaatattattaaattagtgtgggattaaaaatatttagatagctgatttaacaatatgtgatagcattaatcaactgccttgttataattcttgaaattgttattactctacttgtcaagcaattttgcccttctcgtcaaatgatgcatacctgttcaatggaaggattataaaagttcatgcttcggaaaatttttttttttttttttttttttttgagacggagtctckctctgwcscccaggctggaktgcagwggcgggatctyggctcactgcaagctcygcctcccgggttcacgccattctcctgcctyarcctcccaagtagctgggactacaggcgcccgccactacgcccggctaattttttgtatttttagtagagacggggtttcaccgttttagccgggatggtctcgatctcctgacctcgwgatccgcccgcctcggcctcccaaagtgctgggattacaggcgtgagccaccgcgcccggcccggaaaatttttttaagagtataaccaactccccgaggatacaggggtccagggaagctaaatgactgcttcaaggtcacccagccagtgagtgggaaagctaaaattagaacctcagtccgctcccacattttccaccaatttgcargctatcgttaaagaatatttcttctgcaatcagaacattgagcaatttggaaaaacgtgtacagtatatcgaatattctagcttcatttaaaatttatggttatgtgkcttgtataatgttaaaagctttaatctaaaatgaattgccatgtggccaataaccccaacataatactcataatgcatataaattctctaatattatcataatttcttaagggtacaaattaattagtacctcttttcctgcccaataactttcctcacaccccttaaaatggaatttgaaatgagataaacagttgctgctgctgaattaaagtttcaaagaaataaaagtgaggtggcttcatatacaaaatctgtagtttttttcacaaattggatgaagcaattgttattgactaagcccatattggtgctgcccttttctctgttgaaaagaaaagcttgtgagtagtctccaagagccatattattaaaaatgatgtttcctccccatgatggctgagatactaatccattgaaatgtggcgataattcttgtgagaaaattctatgagtctataagtttgaagaatttagaagtgtaagaggacaggggttcatttacttacaggccttcttccaagttaggttttattttccttttctcctagtctctggagtctcctctctccagacaccctggaaagccattcatggcctttmatatttaacataagagtatttaatactaacactaacatgtcgaaggaagatgtttaaagcatgtgaattagacttgatcatatatgtttcattggcacctgtttctctactttttggaataaaataaaaacgacaaaaacagctaagaattttggatagtgatgtgggtgggagggattggggcattcatcacaactgagttgtttaatttatagtaagtgggaacttttagagttgagagaagtttaattgtagtttagagtttcattattagacagtagtcttaaacaattcccaagaagctaaaatgtgggattaacattttactttcattgkaattcatatcctaaatataaatgttaatataaattataaagtttctgaatttcctttcataaaactgggttctttgggttcttagttattttggatgaaacaaggggagggctagttggaaatgatggaacatttaaccactgtcaccacagttagtcacaattggtacatgcagaattaataaagcagcttgccttgtttttatttcttgtgaggtcagatgacagtggatgatattgacttgggaagatggccagaagccactatttaccatgtacatatatcagagagccatttattaagtttgaggagattggatcttaagtacttaattagaatgacattaataattttaataaaatgttttgcattgagagaactattcactcagaaatagcaggggtgaacaaaatcatctccaaagaaatcatttaacatgaagttagtctaggattaccaaccaagagcatggcattctcccatgtatctgacttaaaagcaatacttgtctcttgccccatggtgccaggtggtctgccatgcttccctcttcgtggctgccaggattcccrgtatagaggcaaatacaacctgtaaaggctcaaaygcttcatcaaaagccatgactataatccaaagctattaggtttaagcaacttatttggaaattatcaccttcaaataacaygtagggcaacctcagtagagatgaaatggacgaagcaggcatggaaactgcccttcctgccttaaatacagaatgccagatcacagctctgaataaaagttaagaccacattgggccagatcaggactaacactagatacacagctgagatamagttccagtgactttggcagtgtgaaagtcaggaccastaggcacatatactgaaggcaatttaagctgtgtttcctgattaaagccagggactgaaaaatcactacctattcatgatgaaagactagaaaacttctgaagaccagacagagtttsagagtggtatagttactaatctactaaatactgcaaatatatagtatctgcaaatatatatataaggttgaaaactargctcagaaatgagcattaaaarcttttccagatcaagggagtgctgtacccccaagctgaggtttcataggctaccatcatccaggcactcagtcttcccaagcaagttaattcccaccaaaaatgaacacagtcaaagattacaaaacctaagcagaagtccattatcaagaaacagtgtccacaagtgcaataaatataatttatacctgaggaactataaatagtaragcaattgggtaggggctcttaacagacagatattcaaaatgttaaggaaaataaaagaagaagtagacttcgtaaaataggaacagagggctaagaaataagaacaagtagatctgaaaaagaaacgagtaaaaagcctagaaatattagtgccaatttctatgggtcaatgatttcacaagtgaatagctaacagttatttcctgtggccttacttggcagagagaggtgggggaagcaacataggagcagaaacagttcctttctaagtctgacttataaaataggaacaataaagacaacagtttattgaacaggatggtttattgagctgtccagcactataagcaaatggcttacaaacattttcctactctttttgatgcttgagagagatactttgatagaagattattccaaaatataattacttggtcatttagttctctctttattatcataggaaactatggggaatttttttttctttagattgcaaactagttttaaaaagagcttgtaatgaacaatttaattagattggttttggcttgcctaaaarcttaagaaggtattaatattctaatcaaaagtcttgggaaagcattcttagaataaaaaaaggaaagaaaatcttcattcttatgctttaagaaccaggaaagctgtcaaaggatataaggtaactcttacaaaagcaattgtaaaataaacgtggtttggccacaatgagccaacacctatgtttgccacagacttagrttcccacctcactcatggcaaatttattcagctgcttaagattattttttactcatacttcgaaagaacaacagcctggaatttttagacttttaatggcaatggaaggaacttacctatgataaacatttttctttactctcacgctttcttaacccatggctgttctgagtcaatgtttgccttgcattcaaaaaataatastaaagattcaagtaaaacatattcattaagcactatttgaaagatataccaagtgctttaacattatctcactttattcctacaaagatcatgtgcaataaatatcactgttcatgtttcctacagatgaaaaaaaactgagggtcatgttcagagaaattggatgacttacccagagccacayagatttgtacgtggcaaaggaggattccatttcaagtctttcaaccccaaattcatcttcctttctctaaggggamatggtgctatggaattcatgtaagccacagagyttggataaaaggaatagtaagaccaaaaataggaaaagtaggaagaggtggatcctcctatgtttttaatcagggttctatctacctrtaactcttctgggaaaagaagcaggatgtgactgaaacatagctgctttctagatctcacaaatctggcttttctagtcaatcacatctctctctccttcggcttctcaccaaaccagcatccgttcagcttcaaagaaaaaasagccctactgtttcccactcatttatcatcaatctaaagtaactgccaatcacaaaagtcccatctttatttctttccttagaaacaaatttctctagggaagcttatcagtagcagaagtgcagactgggaaatggcctatgtcaccctcccatctagaaatgcccagtgcacatccagatcccacacccccaagagckttgtgcaatatctgttaatttatgagagctgtttcccatagatgatgctgcaggcattagtaaggagggcaaagttcaagtgatgacaccatctctactccacctggctggtttccaggtgccatctcctgatccctctccccacccccactgccctctcaccatccttcccccaaaccccacactccccaccaatctgggtcagtgataaacacagagtattccacatgcctctgatatgatgtaacattcgacacactaaagataatactgcctttaaggctcctgtccccctggctagacttaaactgtgtagaggaggagaactgtgactttattccccttgcatcctggacacccacacatggtaggtgttcagtgaatatgtgatgagttggtgaatacccactgaatgtgctatttgcattgctacttccttgtgcttccttccactgtttctatcgcctaaaattcttctccctttttcctccaccctcgagtaggaaaaaatttgtttcyttattgggcrgggagktctggtcattatacatttatgtaaaatgttcttctaattggcatattccatgctatgtccagattctttcaagcgaattctcattaaggtaataatacctcaccgaagtttccagggatgatcccctagctgttcaaagctaccttttatatattaaataccagtcaatatgaatcaatggtaactgaaaaaaaggctgatagcttgtgaaggagttggagtacaaaactatgcctataaattgatcctcacaaaggcagactttttcccacagaaattgtattatgaatgctagttatagtttgagactagttaataaaattctactcactccaaacataggattaatggaacccacatgagttgtgtgctgtcaaagtcgagtcaagaggagagagaaggagaagaaaatttcctccctgttctcatagctcagggcacccaagggattctagagcgtaaagtgtactcccttctattttttactgcccttattcccaagctgaaccaaatatttacctctgccctcattttcagttatggagttcactcaggcccttttcaaccttcgaggttccttaacctttacattattaattctttttctaagcaaaatccagctgatctctactagatggttaaaaggatagtaaataggtaaattaatccacattaagccacaaatgactgctagccctaaccctttaatgactaattaatttttaataaagaatatgtgtctatataaatgaatttatacttctaagttggcataagttcagaaaaaatagtaagatgaactggaaaatctacaaggtatagggaaatcctctgggtgaggaagaactagtcatacctccctaaaagcctagccctagtttctgttacattatttcttcttttcatcttctgttttctaaaccacaagtttctaaaagcaccaaggaattttctacctgtttatttcgttttgtttttgtttctgtttttttgtccaaggtgaggcccaagttgacactgagtattctctgtgaaactctgcaaggagcaacatgtgatttcacagaaattagtctcgatacactatattcatggctgtaagttctatgctgctcacccattcatttgtccattcagtcactcattcatgagacatttatcatctgcctcctggaacataccagggcctacaccagaaaacaaggaaacaagtaaacactagtaaactttaaacaggctctccccacaagcaactgacagaccagtggagaagacagatatgtcaacagatgattacaataaagtttcaaggccgggtgcggtggctcacgcctgtaattccaacattttgggaggccaaggcgggtggatcacccgaagtcaggagttcaagagcagcctggccaacatggcaaaaccccgtctctactaaaaataaaaaaattagctgggcatgatggtacacactggtagtcccagctactagggaagctgaggcatgagaatcacttgaacctgggaggtagagatcgcagtgagccaagatcgcaccactgcactccagcctgggcaatacagtgacactctgtctcagaaaaaaaaaaaaaaagtgtcaaacctacatccaaaatgtcaaagtgctcaaaaaagttgggaaggcttcaccaaagatgtgacatttagggtagataacacctgtttgtggatactaatgtcctggtgagtcaaagaagaaaaggatgtacattatataagctggatgcaaaaaggaacaataatgaggacatgcaaccaaaaacttacatagggagaacaactttacttactcagggaaggcaaagagaccacttaagaactccttcacatgtgttatgtcttaaaagctgactactggagttgtatcccttgcacagcatccctttgcaccaaagtgaacactactctaagaacatgtgttcagctctcctgaatgccaagcacaaccatgcttggcatggcagtggtgtcttatttctgctcctctttttccccagggcatgccattgcaagagaatgctcakccatgttcatctggggacctgctcctggyagagcaataggatctgtgtgcccagcaccactgcccacctakctgtcctggcctgtgcccaatgctgaccttcacctcakagtgtggctgtaccacattcggtgatgtcactctcactgaaccttyagcctccttcctgggacttcctgatggactgttatccagggcagaatgtgttgattttctaaatcacataaatgaatagcttgactgttgattatgtagaaaatcagagcaaatatttgcatggctttgtgcagcccattcttgagcatctgattctccccagaattctaaaaaacctgctgctttctcaagccctcagtaaagacatgctttcttgataatcctagccaaacctattcatttgacatctttgttacacaaatggttaaccacagagttaacttcagaaatggctggcaggtatgaaggttagaagattcatgcacttttgctagactgaattggaagttaaagagtaagtagttactgactgcagaggcctggaaaaccatggaaaaaatcctattcctcaaagtcgagccctacctcctacgcctcttaaatcaattgccacagtgaccaatttgtcagtcacctaaaggcagctatcctgaccacttaagggagaatacttataatctttatacctaagtaaagattgtgagaggaaagaaatggtttaaagaatatgaatgtgtcacacttctgaggttaatgataaatgaattggtcctgcttacctcaggaaaaactttcaagtctttctgaaaaactaatttaattcagtagtattttctaagatttaggttatgttwttaatcaatttggaaaccaagatttacttatagaaaaaaaggaaaaggacctagataggtttattcacatagaatcccaatttcacttctctggatgataccattttctacaaaagcaattatgttctaaaatttaagtgtgctttcttaggctttatcagttcacagtgtttccttaagaaatatgatccagtattttttcctaagactaaagttgagttactacgtttatgactgagaaatgaatgtttgttagtttgtttgtttacaataagaattttttctttaccattttatttttattttccccaggtgtatttgatatagtgtttgcaacaaattcgacccaggtgatcaaaatgattctcaactcttctactgaagatggtattaaaagaatccaagatgattgtcccaaagctggaaggcataattacatatttgtcatgattcctactttatacagtatcatctttgtggkgggaatatttggaaacagcttggtggtgatagtcatttacttttatatgaagctgaagactgtggccagtgtttttcttttgaatttagcactggctgacttatgctttttactgactttgccactatgggctgtctacacagctatggaataccgctggccctttggcaattacctatgtaagattgcttcagccagcgtcagtttcaacctgtacgctagtgtgtttctactcacgtgtctcagcattgatcgatacctggctattgttcacccaatgaagtcccgccttcgacgcacaatgcttgtagccaaagtcacctgcatcatcatttggctgctggcaggcttggccagtttgccarctataatccatcgaaatgtatttttcattgagaacaccaatattacagtttgtgctttccattatgagtcccaaaattcaaccctyccgatagggctgggcctgaccaaaaatatactgggtttcctgtttccttttctgatcattcttacaagttatactcttatttggaaggccctaaagaaggcttatgaaattcagaagaacaaaccaagaaatgatgatatttttaagataattatgkcaattgtgcttttctttttcttttcctggattccccaccaaatattcacttttctggatgtattgattcaactaggcatcatacgtgactgtagaattgcagatattgtggacacggccatgccyatcaccatttgkatagcttattttaacaattgcctgaatcctctkttttatggctttctgggraaaaaatttaaaagatattttctccagcttctraaatatattcccccaaargccaaatcccactcaaacctttcaacaaaaatgagcmcgctttcctaccgcccctcagataatgtaagctcatccaccaagaagcctgcaccrtgttttgaggttgagtgacrtgttcgaaacctgtccataaagtaattttgtgaaagaaggagcaagagaacattcctctgcagcactkcactaccaaatragcmttagctrcttttcagaattgaaggagaaaatgcattatgtggactgaaycgacttttctaaagctctgaacaaaagcttttctttccttttgcaacaagacaaagcaaagccacattttgcattagacagatgacggctgctcgaagaacaatgtcagaaactcgatgaatgtgttgatttgagaaattttactgacagaaatgcaatctccctagcctgcttttgtcctrttattttttatttccacataaaggtatttagaatatattaaatcgttagaggagcaacaggagatgagagttccagattgttctgtccagtttccaaagggcagtaaagttttcgtgcckgttttcagctattagcaactgtgmtacacttgcacctggtactgcayattttgtacaaagatatgctaagcagtagtcgtcaagttgcagatctttttgtgaaattcaacctgtgtctyataggtttmcactgccaaaacaatgcccgtaagatggcttatttgtataatggtgttactaaagtcacatataaaagttaaactacttgtaaaggtgctgcactggtcccaagtagtagtgtcytcctagtatattagtttgatttaatatctgagaagtgtatatagtttgtggtaaaaagattatatatcataaagtatgccttcctgtttaaaaaaagtatatattctacacatatatrtatatgtatatctatatctctaaactgctgttaattgattaaaatctggcaaagttatatttactttaaaataaaataattttattgcaatgtatttatcktcattacttaaaatagatgctaatttattttaaaataagactaccttgaatgagtatgaatatatttttatttaaattttgatacaactgatagtttaatactattggttatagattttttatcctgacattgaaaagttaaagaaaaaacattttgttctactgcatgtcatggaataaacacatcgttttgaatttttcagtttttcacataacaaagaaaaaaattaactcttgctataatgctagaataatacattattttacaagtaatttaataacagaatttttctaattgtatacattatcattgtaggaaagttagaagatatagaataacataaaaataaaagtcatgtttagcttccccggtcaaaaatcattattttaacatttgggaactttattttctacttttttcattcattatacacacatatatgtgtcaatcctgatactgaagtcatgatgtgtatagtactttgtatacagatctttcacttaatgtcatagcatagtagtttcctacccaattaaatatttttctaaaacattttaatatttgtataatactacaaaatatggacatacgctgatatagttaactagtcaccaaattggaaaattgagctttttctgatttttttagtatcataaattacactgagatgagcattcaagtatgtgaatctgagaaatttcccatactcctagaagtggtgcaactgaaatacacgtatgaacattttttaatagtctaactacctgttatcaaatatttcccagaaaacataacaatttacaataccaccaactaggtatgaatatatatcaccataacctcagaatggggtatttactaaattttttttttttcagacagggtctcactctgtcccccaggctggagtgcagtggtgtgatctyggctcactgcaacctcccactgctagattcaggcaatcctcccacctcagcctcctgaatagctgggactacaggcctgctccaccactcttggctaatattttttacttttttacagagatggaggtctcactatactccctaagctggtctcaaaactcctggcctcaagtgttcttcccaccttggcctcctaaaatgctggaattacaggcatgagccaccacacccagcctaaatttaagcagaaaagaaagatttaccgtaaggatccagctgccacatgcaagggccaggatgcaactgtgcctgaaaattgtacttttaacatttctgctcccatcggacagttgcttcattcttctatttaaaggatttcagtgcttctgaagttcatacagggcagaccgaagtgctcattctggtcaaataaactgtggccaaagggttggagttatgcgtaaaataattgatggttgctgtgggcaagggggtgtcatctcagagagaggccttggccactgggcagaatttccacaaagcagactatattaccttcacattcccaaatataaagtttttgtgaacaaatatggttccatatgccttatawtatttatattatttttatattatttttaatttcattaatgtaatgccagccactcaccccaaaggtcttctactattttcacaaaggatcacctcaaaaaaataaattttaccttatcccaagtgatagcataaatatcctatataaaatccctccaggcctccaggtcagctttataactgttttttttttttttcagtagttgaggattttttgtgtgtgtttgtttttgttgttgttttgttctgttctgttctgttctgttttgttttgttttgttttttgagacagagtctcgttctgttgcccagtctggagtgcagtagtgtgatctcagtccactgcaacctccgcctcccaggttcaagcgattttcctgcctcagcctcccaagtaactgggattacaggcacgcatcaccacacctggctaatttttgtatttttagtagagaygggttttcactaggttggccaggctggtcttaaactcctgacttcaggtgatctgcccgcctcagcctcccaaaatgctgggattacaggtgtgagccaccatgccctactcaatagtcattttaatccaagtgattgtaagcattttaaacttgctgaactatttcataggttatagttggcaagatttctgatagataattgtatttagatatcccctatatcatgtatttattaatggtgttaataacatgttccattcatcaaattatattgggattttaccccatctcacttgtgaaatagatgttactaaccttgatgattattctttctttttcagtgagatcaacataatcttggagttgagaccctacttaccaaaatgttaggataggrtgccattatgtattcttcatgaaaatatttacaggttaggtagactccttatttttggtacatttaaaaaatacatacagaaaagaawatttaccatagagatctaggtgcccaacagaatgcaaaagctacatttatattraaatatatatttcaatatacacccatttacacccatttctgaggtgtaaatttcaatatacacaatattaaaatttacctcattctaagcttttggggaaaaaaaggctagtcatttctaatgctggctctttctcattgtggaaattcatctttttggacatcagttacatcatttttcaagtayggtgagttggcttggtgaaagaaggcttttatattttatattttattttattttattttattttattttattttattttattttatttttgagatggagtttcactcttgttgcccaggctggagtgcaatggcatgatctaggctcactgcaacctccacctcctgggttcaagcaattctcctgcttcagcctcccatgtagctgggattacaggtgcctgccaccacacccagctaactttttgtatttttagtagagagggtttcatcatattggccaggctggtctcgaactcctgacctcaggtgatccatctgcctcggcctcccaaagtgccgggattataggcgtgagccaccgcgcccagcgtgaaggcttctatttagttaataattcactcattcatggatttaataagtgttgtattgtttccctactctgtgctgggtaacaagtgctgtgtaacatatagcagcttagcatgtaggataaacttgttgctcagctgctgtgagcagtgtgaaggagagccaagtgagaagcagcttgattgcaaatcacagaaaggctctcagagttttgataccacaggtttttcagtttcataactctgtatactggtgcatttttttccaacaatatgtgccaatctaggaagcccaagaagagaaaatagattgaagcaggtcacaaaagtgtgaatgaagaaaacaagtttcaaggaatttcggatacttggtatgaagagtgagatatctgagggtaaagaaagtaaatcaagagtaagagagatacagagagactgagtggacaggaggctggaagcagtcacacactgcccccaaggccagggttcagacctcacaggagagatacatacagtcagggccccaggaccatgttggatccactggacccagaccaaccagaggaagagggaacccaaatattagrgtgggaagcaagtcataaacagtagacagaatggtatggggcaagcccttaaccatatggattttatatagttcaggctgtatgactgtatattggagctaatcagagagtcaaattttccaaattcaaaatcttgactgagtcagttaacatatgacatctgtaactatatccagtcttgtctacttgtgtagtgaacactcatggaaccatctgaacagtgtccattctcccctcatcgcaggaatagttctgccccactcagggacagcaccacctcagaatgaaccattttcctacctaactccatccccaggccacagttaattggtccaggcttgaagtggaccaatcacagtttttcatgaggatttttcaaacaggcgctgatgaagagctggccccagwgttggcatttctgagacgtaagctcaacaccagccacatctctcaccacgtggaagaagctagtctgcaacagagtgaagtaaacagaaaaggcaagagagccctgaaggtgcttgagtccttgattctacctgcgtcttatgtccagctaaatccctgcccactcctctctaatcaagggaccagaatacagtgatctatagctaagatctgcaagtgtttcttcccgcttatgatcaataagaatttcccttttgtagtgtccagcacatcatccattggccacccagcagaagtgataccgtctacatcccaaaacttattggtccctatcttaataaggggtcacaagtgctaccccacttccatatgtctccttgtgagatggtaacagccaggacattcaatagtgtgtgttaagggggaagaggtgtggagatatagacgtaccaatagtgagagggggctgaggctactacactatctacwattgcaaattattgtaaactgaagtctctccctgagatggcacaggggtaaaatacacttctgttgcatgagcaattataaaaaatatgatttagaccatgaaatcataagcagagagaggaaattagtgctcctcaccacttgagggcccaaatgcatggcttgcatgttgcctgggctctctttacytgacagtgacctgggagttctctgggtatcatagagccagtgagcacagcatccaaacctgccraaatccaatggaaaaggccttcatttaccaagctaacacaacttacatgagaaattatataactgaagttgaaaagatgcatttcarcaatcaggaagagccagaattagaaatcagactgttttttttttccagaagctgagaataagagaagttagctttagtaatatttaattctaaatcattcctatactaggaagctttgtataataatcctttaagagtttaaagaccatgagatttacccttcaagcagtgtaataggaaaatatttatctatatgcacaagagaygtaaatttgatgaaaaaatgatgttaattttaaaactattaaaagccagtttgctattatgattattttgcttcaagtatccaaatgatgatgagccaaatatgcccctgagcccagttcttgattcattccacgtcctataaagattctttagaaaaattgaacaagatgagaaatagggatcctggctcaacctcccagtgagttgggatttatctcatggaactttttcccaagcttgatgaagttctgctgtgccatatggacatgtacagttgctaaatgataattttccaaaaataagcttcaattctscaaaatggcagatagaaagcagctggtgttactcaacagagataagccctcctagagctcaccacagagaggagagcatcatgtctgcagatgccacagcagatctgctgagaatcagccagcrccatgtgacacaagaacccacagatgcrgattcgtcctgactggtggctttcttctggccattgctgttacagagaagtttctaagcagtactcaatgcacacaaaactaagtagaggctatataggcaattcttcaaataagcaatcattattctcagtaattcttgtagtaagtggatggtaggaggaaaaaaaaaatacctttccactgatgatatcacctttatagctatttcttgagtctccctatcttttccaccttcttcaagaaatagtcccctattacaatttgcatgcccactcttgctgcagaatttgtataggggctcaactctcattattgccaactatatgatttggaccatggatgtgagaagacttcagcaaatcaatccatcacattcctctggctgcaatgagttgggcacataacctaaatgaacacaattatggtgaatttcctggttttgccaggagctatcagacaaaaagcttgttctttcccactctatagtggatgtgaggagttgttgtagccatttgtcactccaaaggagaggtggtgtttccagaagttgtcacagtgtgtacttataccataagtatggagccaacatagtgaaagacyggacaaagaatggaaatgaatcaagtccttatgacatcattggagagttgactttttgtgctagaaatttgcactgtcctccagatctccctatcttaagcagttggggatgggttttctgtcaaaattatccacgagaatttaatcttctgcaaaattattatagttatcatttattgagttctgattataggacaggcatagaattctctgcttatatgcattatattatttaatcctcacaacacccagtcatgctatttctgttattatcctatgagacaaaaaaaaaaacacagattttacataatcagtccaatgtaacatgactggtaaatgttggtgttgacatttgaaatcaggcattctgactccagaatctgtgctcttatttgctaagctatgttgctttcctctgctcctcacctctcccctgaccccccaaaaatggcattacaaaatatgagtcatgtaggtactttccaatatattatccaagcctatttatycaaaatcaatacagtaatattttactttgtctgaaaccgatctcactggatttcaagatagaattttaatagtctttgtccttgaaaattgggctcactaatggaaagcactaattgaccttaaaaagcataacactggattttacatttattgtaatgtgattttggatgagcttatattgggtctagcaaataaacaggctacaactgttaactgtcatagtaattagttaaatgctctggtcctttctgcagccrggaatttagatagcacttactaaatgggaggggaaaggaaattcctaaatttattttcatatcaaagttttaacttcttacagcctaacagaatgatgttctttaaaatatatatgttttaaagaaactacattatattctgagaaaaatttccttttaaggtgtgcagtacaggtttggcaacagattttggtgaagaatagaactggaataattaaaagtatgacttatttcaactgtgcacagagacccagaggataaagatgttatgatcataccatgagtcctaaggacagttgtagcagcatcattgaamactacctcaacatggatgctatttaagaccttgagaggtaaggagagagttgcaacagaaaagataaaawatgcttactgcttcaccttttgcttctggctgcagaacaagtagaaaggagcaattacacccaaaacgttaaaaaaaaaaaaaaagcaattaggctaaaggctgaggaaatgatcataacatgatggaagttccagcagccaagatsaatcagaaagtagctatgtagcctatcatgataggaaagctgggcatagacatagatcagtgttttccaaccaagtgtgggccaggagtggtggctcacgcctgtaatcccagctactcatgaggctgaggcaggagaatcacttgaacctgttagatggaggttgcagttagccaagactgtgccactgcactccagcctgggcgacagaccaagactcagtctcaaaaaaaaaaaaaaaaaaaaaaaaaccccaaaaatggaaaaccaaccaagtgtgattggccaaatccccaggggacatttggccatgtctggaatcacttttggttgtcgcaacttgaaagaggagagtgccactggcacttagtaggkagaggccagggatgctgccaaacatcctgcaatgcacagaacagtcccacacaacaaagaactatctggtacaaaatatcaattgtgccaaggctgaggtccctgrggtagatgaggaagggaagagcaccatgtgaatgctgcagtaaattgtgctaaataatgaagtgccagtctcccagttcttataacctctaaagtgtctctccctctctctttttcctgtgctcacactcactttctcagattgcattacatgtgaacttcatccaaatgacctaattcatggggaaattgtgttaaaaaaaattgggggggcaggcagtgtcatttctggggctaagtagacaagtctattaagcttctgcaaaaaaaaaaaaaaaaagtttattcactcattaacgttaggaacaaaggcagctggtagcatgggataaacctaaagggttataacccacttccatgggagacaaaatgaaggtgtgggttccagtgggaaactaatcctcagagaagacactaagtgcagaaataaaacatgtaagcatgtggtgctgctggctgctccaccaggacactctacagtatcttagcatttgctatgagtctgatgaaaatttttattgaacaaaatcaaaggtgtattttatttttactctaaatatttccataggggatttgagtggctttcaatgaaaagcacattaaaacagggtaatataaaagaaaccagacagatgaatcacaaaaaggaagaagcaaaaccattgactgtacagacaaaaaggtgttgtgacagataagaatattgggttcacaacttcttgcagccaggttgaaaaggcatcactaaaactccagttctttttatcaaaacaagtgcagaacaggtccccatatggagcagtcttttcgacattgaattcctaaggaaatttctcacgttggaytgtggatagagacatagagtcacagagggatcgtttktaagcatcattttttatttcagcctgattcttagttggttgttctcggaatgttcttcttaaaacccaagagcatgacaccaattcaatgaagcttggtgatgtaagggtatccagcactgtgagataagagtcacccaatggtgtacttgacaggcacagcaatgtccttatgatgtcaatggggacctctgggtccactgaaaccttagataagataggcttagactccctgaaacagtgcaagatctccagaaatttccacagaagcctgaggagcttatgtgttcgtggtctcctttagtttttgccatctgcytttccagttcagtttagagattatgatctcactactccacactgtaagatgccatattattccatggctgtaagatgccgtattccatgtgaaacagctccaattacacacacacacacacacacacacacacacactcaacagcacactaacatgctatgtcattagggattacctttgattcaaaaagtcctttgtcccttggaacatttctcctctggactccatgcagtcccagacttcactccatctcacagatcattcccttccttctctgcatcctttccttttttatcaccaactcccttgaagaagtaaatccactttgtatttcctcacccctagcaccctagccattcgtctcattaactactcccttctgaatgtcacacatcctttctttcctgcaaagtttcctcttctcccacaaacagactttcaggatattttcttagagaaattccaggccacactatgcagataatgaattcttcacctcgtcactatcaatccaatggttctcaaatagtagtacccagtgctaatggtgggaagcaaaaaattcctcaaggaatgaagtgtcttcatattttgatttattaagaatccttgctccatcaaaccccatgttttcctgcctatctgatgcatcacctcctgctgcttctatttgacagggacgacccaatggttcacgtgtggcagggcccctgtgccctgtgtgagcattcaccctgaaggcatgctcatggggctcatccaatggatgtttttaagtccaacaaccttctcaacttttttcttatcaaattcaattaacacatcactggacttagtttttatgttctcatatccacagattttgtaaaatttaaaacaatatcttcattgtaaaatgtaaatcattatgtgcttaatacatataattacacattctaaataaccactttctctatttacacatacaggcgtaaaaattgtcaatgttattcatataaccacgcattttttaaaactactgggggtaggtgactaattttacagatattaaaaattaacttttgttcctttgaactatatgttatgtataaaatttcggtgccaccaaagaaatagcacttgaatataaaattttctttttaattctcagcaaggcaagttacttctatagaagggtgagcccttacagatggagcaatggtgagcgcacatctggacaagggaggaaaagggattcttatccctgacgcacatggcccctgctgctgtgttgttcccctgttggctagggttagactgcacaggctaaactaattccgattagctaatttaaagagagtgatggggtgagtgctttggcaggaaaaaaatggttatgcagggtggagaataatgagtcagggtggagcaggtgattggaatgagtctgggtggagcaggtgattggaatgagtcagggtggagtaggtaatcggaatgaatcarggtggagtaggtaatagaaaaaggttactttacgaggaagttaagtttaaaagtagaaggcaaagaattgaacatactgacatattaattmtttgaagagaaattcagaattcatatttaacgtatatgttatttttataacttctaatagtaacagccatatccagatgttgttagaagcaataatgtaaaggatgcaatccacaccctgtgcttatctagatttttttttacttaagaatatcaaaaacttgcatcaaaaagtatatttttctgatgagagcccagaacccgctctttagatgagagaacccagtattgctcccccttattttccctctccgtattcaatgccttccagaaaagttatgactccaaattaaatttgaaattattctctgaatcctttttccaaaaagtccttgttattttcttattcaagatataaacccaaggtgttctacttcaagaaaagagatctgtaattttttttttttttttttacctgaacccagcaccatgatctggtgactatattgggaaggattctggaatattgctstaagcaaattcaggagtaagtataggatatactacctacacgcatttggggctcattccaaaggttgcctggagaaaaacaccaggttagaattatgtaaataactaacacctggagtcttctgccactctcattagatccaggtaaaactgctgtgactccacctcatcaaccctaaaatccataaaggtctggccgggcgcggtggctcacacctgtaattcccagcactttgggaggccgaggcgggtggatcatgaggtcaggagatcgagaccatcctggctaacacggtgaaaccccgtatctactaaagaaatacaaaaaaattagccgggcgtggtagcaggcgcctgtagtcccagctactcgggaggctgaggcaggagaatggcgtgaacccaggaggcggagcttgcagtaagccgagatcgcaccactgcactccagcctgggcgacagagtgagactccgtctcaaaaaaaaaaaaaagtctgggtcttttcccctagatctctgcaaatcctgaggggacctccaggtttcacagatggagttccccttgatgctcccaggatcaacatctgggggagaataaaggaaacgggactgggaagaggatgactttggcctgcgaggagatgatctcaacgcaggtctgagacaatcccacagggagttctggggcggaatggccgtgcacagttacaccaggttggggtgtaaccactatacctttataatagagctgatctttctacccccacattgaccagtctgtggatgtggtctgccctcaggaacgcattccaccaagatagctctctccagcagaggacaactgtcctgataaggaaactgggctctcagctgtgggccacaaatcctcccagcccctgagggatgagtgtctcagcactgaaaaaaggatctgggcagagccctgtggtgtccaccccacagcctggaggagcgcttagctcctccrccacctcctctttttccccttctcctttcttctcctgctcccccatgggctcctcctttagcacaaactgcttccattctacaccacatcgccctggggcaaaacacagctctttcttcactgtgcctaagaaacccactcacatcaagtgcttttgtgtttcaytcaatctcctcaaaaggggaggaaggtgtgccgcatcctggagtgtggagccctctctcgtttccctagcatcatactcttcccctcctcctttctattcctcctctccattctggatgctggaagaatctccaaatttcttcttaagcaaggtgaaaaaatgagttggctttccccagattttttttccaaatcctgaaaacctacatagcccacaagaaaaagaacacaagactttcctataaaagaattcacctttcatagaaaacacttgaaatttaaagtgctggagtgatattcctgtttcctatagattgaaaaaagagacagggggcttcaaataatcataatccaaatattttttgaggccccaagcaattcttttttcctattgtgaaaaattgtcaagtcatgaaaacataagcacacaatcagtattgtttcatgaccaaacttgtcatgaagttatcctgacctaaatacatactcagatcattcattttaactttctatgtacaaayctgaacaaaaggaagatccatctatctgtcttctgtattgacacaactggctctcttaaaactctctcctccctagccttcatggatactacactattccggatttctgccaacattcagcccactcacatctccccttgttttgtacctcttctgtctcctgtttacctgatgtaggtgagtaccaacactaaggaaggaagaaaaggtatgtagcttaaaccctccctgactaaacagcctggtgaagacactcctgccatcaatggttgactcaagtgccacccagactgttggcactcracactgagttcttccctcatcccctgccctcactgacactgctggaccragagacctgagggtaggtttatggtgacagccccagaattttccccaaaacctgctggcttttttgcagcaccaattccatgttcagctgctgggcaaccaaaaaataacaaacgagctctccaaaacacatttgttaccaagaaggaaaggacaagttaaaaaatgataatgatgagagtgcattctggacacaatgggaaagtcatgacagttgctgttggtgtcagcctactgcctgcctctgcattgggctcctggccttccttcctgtggcctctttccccacatctcttcactaaccaaagaggtaactcttggctaatctcttacttaccacaaaacttaatttcataaatcytcccccccgtctcttacttaccataaaacttaatttcataaatcttccccccgtctcttatcaagtcagatttcagttacgtcaaaaggctcaaataaaccttcatatgttataaattttaggaaaagaaaagtcctgrgtaaggtcttctccaacccccttattttacagatgaagtaaaataagtccaataagacaccaagtccccagtaggtgagcccaggcatagaggaaggttttctgctttaacacaggacaacgctttaagagcaacagacctttagaaatagaatcccaactcttaaatatcagacagagaggagagaactttggagcagaagatatttctagggctcttaaaatcacaccttaggccagccctgagaatagaaaaaggcaattaaaaaaaatgacaaatcacccccacccaggggatctgaaaaaggggaaaaggggaaggtagatttgcaagtaattaggaaggagaggcttaaaggttcatgcagaagccgctgtaataagccatcccagctcaatagcagcttgtcctatttaattcttcacagtgacaatgcctacttgcccccaggggttacaccttccagctagagagacactgagcaaagcaaagggcctgtggcagcgaggaatccagtctgcttctaccgcagtgcttcccaaactctaaaagcattcaatacacttcacctgggaatcttgtgaggctgctgattccgctagtaggtctaggacagagcctaagagtgtgtatttcttacaagctgccaggagattctcttgttgctgattcgtgggccacacttaaagtagtgaggatccagtacatgaggtcagagttcagccagagtttaaactcaaatctcccactcctaggcatgtaaaccacgtgctctcacctcagaagtatttcctatatgtgagagttataccagaataaaacttggggagattttgctcaaaacatgacttttattattttggtatggtgattatttttgaaatatcatttagactgcttgagaaaaataacagaaattcaaaacactaaaagtgttcaagcaagaaagcacttccaaaccacaaaccaagctactatgcctatttcaacactggtgctagggtttctgtaagatcrctctgagtcatcaaacatctccaaagcatctttagctctgtccttgccatttaacttgatattgctttgaggaacaaggtgcaatttcttgtctgtaaatgagaatgctcggacttttgtgcagattcaaagactcagtccgcgcagcaacccacaatctcaggcagactgtcaatttaaagatggagggacagagccattatatctctttcagacttttatcttctctcaaatgcatatggatgcacagcaagcaaaccgcaatgccacacttgcctggtcattgaatatcctgcagtgtacttcttaattaaaaccagcatcacaaatacgactgcttaagtgccaaaaacctggcccgcttaatgaccaatcagagaactacatgatcgttcaatctattcagaacctttttttttyccctgaggtaaatatagttaagctgtaaatattcttactgttttccatcaagtgtgctttttcttaaaatactgcttccttttcagcatcaaaaattcaatttcacttttgtcatcagaaatcaacgtatgttataataatttattacattttaaaatctggaatttgtagcaatgctggggattaaggaataatttgagtgaacgacacatacagtgttgcctagtaacacaggctgatctgtacaaagccataaattgcaaaatttcatagcagcataaaaacttttgctggcacttaagcgtatttttccctgattgaagcagaattcatgcaacaattacaaccacatgacaaaagctggtaatgattagccttcaagagccgctgttgtttctgacagttccaaagctgtttttgtttgtttcaggaaagaaagtatcaaatccttcacttactagtctcactgaaaagacagggttgagcctgttaattagccagtgccagcattgtaactgcagctcccagtgaagaatggaagagttatgtaataatttccaattcctattaatttgtgtcaaccaaaaccagctccatatgtacctatacacactttacagggaagctctcttattatgtaaaataaaggtagaaacacataagaaatacaaatgtgtctgcaactatcattgagaaaagaacttcatgaagaygaaagctgagagccaggaaggttgttttcatttgttataayaaatatcttaaggagctgtcttaagatatcttcaatagttacagttcttgaagtaaaattacaaaatatagttgctaaagagcccaaaggaaaattatatccacattgaattcaaaatagcttgctgaataatatcctatagccagcccaaagaaaatatgagtttgtggaaataatactttatcacactctgatatacactacacacagagagagataaaataaatgagtgtttcactgatgggatactgggygattttctctgacaaacacrtaagtttctatgaatagattcaccaatgtgaagggattcacactatagctcaagaaaattgagaaataaatgctttgatcctttcataaacttttcattcttctagctatagcgtgaataaaaaacacataaaaatttaataggtaatgtgggcacaaaagaatatattgtgaaacacaaaggaagacttctatattcaggtttagtctttcaatcaattttgtggctgagcttcctggtgtacatttcgataaatcctaatttactttcggtcaagcctcataatgtcaaacttctggtttgatttctcagaatccctcacccctaacacagctacagcaagatacttggaaagatccagatgycaccagaggaaatggaacaagattacacagaaagcagaagtggatgtctaaaaatagaataaaaacggataagggaatccacctaatccccaaatcccacgtccaagaagcaccatctgcacatcacacaacacttagaatgcctggaaatggtcccaaaatatcatgagcccacaatttagtgatggtcaggccatgaaaaagttgattagcctccctgagtctsagtttcytcctccatacaattgggagattggatttgatgagttctaaaatttctaacagctccaaggtgttataactaaatccttccactgctctataagaaagtcttcatggctttccactctgtcattttacttataagcaacggaaaggaaaccagcagtcaggctgagaaattaaaattggttgaggtatgacacgctttaccgatattgaatgtcacatcacaaaatgagtcctacataattacttagcacagtgcttgacatatagtggacactcaccaaaaaccacctcccactgctgcccctcctccacacacacataacctccatacatgtttcactgtttgccctcccttgtggagtacgcttctatgattatgagtgccaattatgaacgctgaaagtaacaagtctgaaaaacctgttcggaatatggcagtacattgcctggattatgtgcacacttagagtgacaatttacccactaatttctgattacattttaaggctgatcaacttagatattttgaaaagaagttgacatttgtcaaataagtcctaatgagaagtgaagcatgtttttgtatactgtgttagaaagcaatagaaacactaaattcttgaatgatcattaaattaattagatggatkatgagtactttatgttttgttcaaactaattcattctataaaaaggctacaaaacatggattcaataccctactgaaaagaagagaagcttgagagtaatggaagctctgagcacctttctacaaatagcccaagaaaaaaataaatagatttatcaaattgctgcttatttgtggataatgagaattttttaaaaatacagattctaaaataccttggaatccaacttacaagggatgtgaaggacctcttcaaagagaactacaaaccactactcaaggaaataagagaggacactaacaaagggaaaaacatgtgatcctcatggataggaagaatcaatattgtgaaaatggccatactgcccaaagtaatttatggattcaatgctattcacatcaagctatcattgacttgtcttcacagaattggaaaaaaaactactttaaatttcatatggaaccaaaaaagagcccacatagacaagacaatcctaagcaaaaagaacaaagctggaggcatcatattacctgacttcaaactacactacaaggctacagtaacaaaaacagcatggtactggtaccaaaacagatatatagaccaatggaacagaacaggggcctcagaaataacaccacacatctacaaccatctgatctttgacaaacctgacaaaaacaagaaatggggaaaggaktccctatttaataaatggtgttgggaaaactgtctagccataggcagaaagctgaaactggatcccttccttacaccttatataaaagttaactcaagatggattaaagacttaaawgtaaaacctaaaaccataaaaaccctagaagaaaacctacacaataccattcaggacataggcatgggcaaggacttcatgactaaaacaccaaaagcaatggcaacaaaagccaaaatwgataartgggatctaattaaactamagagcttctgcacagcwaaagaaactgtcatcagagtgaacaggcarcctacagaatgggagaaaattttgcaatctatccatctgaaaaagggctaatatccagaatctacaaagaacttaaacaaatttacaagaaaaaacavacaaccccatcaaaaagtaggtgaaggatatgaacagacacttctcaaaagaagacatctatgcagccaacaaacacatgaaaaaatgctcatcatcactggtcattagagaaatgcaaatcaaaaccacaatgagataccatctcacaccagttagaatggygatcattaaaaagtcaggaaacaacagatgctgggaaggatgtggagaaataggaatgtttttacactgttggtgggagtgtaaattagttcaaccattgtggaagacagtgtggttatttttcaaggatctagaactagaaataccatttgacccagcaatcccattaccaggtatatacccaaaggattataaatcattctactgtaaagatacatgcacacatatgtttattgcagcactattcacaatagcaaagagttggaaccaacccaaatgcccatcaataatagactggataaaaaaatgtgacatatatatgccatggaatactatgcagttataaaaaaagatgagttcatgtcctttgcagggacatggatgaagctggaaaccatcattctcagcaaactaacaaaagaacagaaaatcaagcaccacaagttctcactcataagtgggagstgaacaatgagaacacatgaacacagggaggagaacatcccacactggggcctgtcagagggtagggggagggatagcattaggagaaatacctaatgtagatgatgggttgatgggtgcagcaaaccaccatggcatgtgtatacctatgtaacaaacctgcactttctgtacatgtaccccagaacttaaagtataattaaaaaatatagattctctgaagtaattttctaaaatgtattacttgaaatttccaaaaacttcttaaagatgaatattgtataaccatcaataacaaaactaggaattctaaactatatggttatcagacttatatgtaaattatgttatctcctaaacaaaccaacattactgaagtgctttaggcatgtcattacaaaatgtaatgcacttttattaaaagtccctggacttaattgaaaggtgaaaaatgtggtaaatctgtctttaaaaaaaaaaagtattcgattcttcaacctcataacttaggagtaagttctgggtatccaaaattgggggagtttggtttcttaatcaaaaaagggtaagttctgaattaatttttgtcttatctacaatgttatttcatttccaaaggaataaataatatttttattatacttaaaacagctttattttaactatctttagcatttcggagggggcgaggctctccccatttatatgaataatgttagatatataaattgcctgatgtaaaagtttgaagaggaccagctttctaaaatgtacttgaaagcagcaaatgttcaaataatgtactttwctaagaggaatgcattagaagtgctctaccttttaaacaagatgcaacagacagtatcattatcacctgttagtctagattttgtaatggaagaactaataaaaggtaacttagtgaagagggaggaaaaatcaagcatgagtttgtttttttcttctactagaaataatgactttctacaatctcatggaacactggaaagtggttttcaacttggagacatagaaagtaaaataggtcaacatccactgcatctattttcaattactgagacatatagtccttaagcagccagagtcagccagaattgtctaagatctgggctccataatgaaaatatcttatagtaaaatgtattccccataggttaaaatgcaaaatgagaacccaactttttattactcgttaaatgaaatgtgcagtctttttccccttttaaggtcaagtatacagtattttggaaaacaaaccataaaaacatrattagagagaacagaggaagtcattattttctccagtcataaagaatgtagcatcattctatcaatctaatgtatctttgtaacggcagtggcagcatgtggcagtgcttaaattgcaaatacagtatttaagaaaaagmacggattaaaagagcactcacatgagctggaaaatagccacatggattataatatttttataaattccatttcyttttcaaagcaccacttaacattatatattgctatattatctacctacacagaaataatatactcatcaggccaaaattcataaagtaaatccaagtgtacataattaatggccaatgcagatagaccccatattgtgatatatggtgaatgtaaaatcagtgcagaaatattgaacctgaatctatacatgtatataaataacatccctagatttggtttgcctttttggaaacatttataacacaaaatttgaagatagtaagatgcatcttctcaatgttaacatcaggacagaattcacgcaaaagcttatcacaaaggcaaatatttcagagcatgtggcttttacaaagcacaactttattgctgagacaattccaacccagtgtcagtttttcagcaacagttgctatctatctgtcatatttagggcagttatactttcaatatgctccactagaggcagctggataaacttgaaagcatttttaaaaacatgtttaggaaagtaaaggaaatgacctgtaacatggtaaacacaccatattgtacatgagattctcactactctagctttatcaagtcaggatatctaggatggaatgcatgtttaagccaacactcatgctcaggatttcatgtttcaggacttagtgatggcttccatttccagtcggtcttcttttaaatgctgtttggcattttatgtgggctttggttgtcaataaaataaaataaataagaaggtaaattctactaacagcttaattgtctgcaaggtaagatgagcaaaatctaagcagacattctgactgagagagggcataagacaacttggagattctgccaaatccataggagaggacyttttgtttggttagttggtgggctgattttcagctttttaatttttttcatagagtggagatgttgtaaccctgtcttataarctaatagaattaggaaagctgcctccatccacagcagtttgtttttcatcccaatggtttgtcaacataatgaactagataaacaatctgcacaagaaataaaactgtccttatagataggctagggaaatgtcaggcctcacttgttactgaaaactcagcagaaacttacaaagacacaagaacaattgggaggatgccaaacacacaagccaaataaactgaagattctycttcaggcttcagtttctttgcttttcctacatacatctcacccagcatttggctaggcactcctaactaagaatgttgaggttatcagaaaaattggcctaaaagaaatcaagatttatgatttttaaaagcagtcctttttttaacacctttaaagtgatgttcaccacactcaaagctggttgtcagactgaaaaccagaatattttacgtcttcagcttttttaaaaaaaacaaaatgctccatttcatttggcattttagaattatttttaaaaagaataaatcctacctcaaagcaaattgggaagatgatagtgccaactcttcctttgagcccttcttggttcatgcatgagccattcattttcaaagggagatgctaatgagcagacagacaccaactaaggtgtcctggtccatacaaatgcatgtgtgcaaatgctaagaaggactctacactgcccaccccacatctcccgcaccagcttgaagtgaagtagtcaagggggtaaaatattcacataaatgagccagtcttggtaataacattacgtactaagtgaatcagtgctttcattttgcatgagatcgtattccaacatacaaaatcttgataggttcagtacacagttattatgttagacattttgttgacctaaatgataataataattattattctcatgtgttctctgcactgctggattctgatttttcatgttaatttgatatcgcagttaaatgaaatgtaccttcaagaggtcagatgtgctggttgaatgtgctgggtgaccgatgtacacaaggctaaaagctgatgaaaagaagagtccaacagacatgcacttaatcattcattcaacaaatatttttgagcacttggcactgttaaaattgttacgtatatacagcacttaggaaatattaaaaaacaaaaaacaaaaaactttgccatcgtggaaattacattctagaaggaagaaaaagaaaatgaacaggatggataagtaaaataagtagaatataagtaaacatataaaatacatagaataaaatctctcagcatttgcttgtctataaaggattttatttctccttcacttatgaagcttagtttggctggatatgaaattctgggttgaaaattcttgtctttaagaatgttgaatattggcccccactctcttctggcttgtagagtttctgctgagagatccactgttagtctgaygggcgtccctttgtgggtaacccaacctttctctctggctgcccttaacattttttccttcatttcaactttggtgaatctgacaattatgtgtcttgtggttgcccttctcgaggagtatctttgtggcattctctgtatttcttgaatttgaatgttggcctgycttcctagattggggaagttctcctagataatatcctgcagagtgttttccaacttggttccattctccccatcactttcaggtacaccaatcagacgtagatttggtcttttcacatagctccatatttcttggaggctttgtttgtttctttttactcttttttctctaaacttctcttctcgcttcatttcattcatttgatcttcaatcactgataccctttcttccagttgatcaaattggctcctgaagcttatgcatgtgtcaggtagttctcgtgccatggttttcagctccwtcaggtcatttaaggacttctctacactggttattctaatataagtgataagtgctagggaaaaaataaaacagaaaaaatagatagtaattgccatgtttaggggaggggacaaatgaggtggtatcaggaaagacctctttgagatagtgaccttgagaaaaggtttgaagacaatgagagagtgagccatgcagtgtctgggagaagagcattccaggcagggaaaatggcaaayacaaagagggaaaggtgtatgaattgtacaggcatttgggggtattccaaaacttttattctaagtaatatcattgtagataactttatggattcattcagagaagagatttactctactacacaaatatttaaaattctaagtatagcacataagttttcatgtctgttatctttgtaaaatgttagggatagtgagaagtttgggatagctcaccaaagtctctgatttcggcagcccaagaaagagaggccaagaagggttagatggtttcacaargccacacccttatctggtggcagatcctgagctagaattcagagctctagagtcttattcccatgctcttcctgtgccttacaggaagatttttctttttgcttgaattattcatggcaaacactctggattcattctaaattatgatgggaaatcattggagcattttagggagaaggggtttctgatttttttaacctgtataaaggctctcttggctatcgtaagaagaacagaccttagggaaggcacaggtggacacagacagatgaattaggaagccattatgatgtcctctatacctagaaaaatgtctattgaagggatgagggaatgaatgaatgaaggaatgaatgaatacagatacaagcctcacaagagatcatatattttcttgcaaaacttatatgcttggcaccttgcataagaacttggcacagtaggagataccaaaaataccaaaggagataccaaaaagtccctaaaaggattgaatagagatactttttcctattcctctcactaagtacaactaaaatcctgaacattatatatcaaataaagacaagaaaactgaaagatgaagagaagaaggaaaactagctacagatctcaggacccttggaaacacatggtgatgagttcgtgagttttctttctgcctcrtatataccagacttggagtcaaataatatgaccacccagaaacaccaatggacacagacaaaaataagcccaatacaaacctcttctgtccagccaaaggaccaggaaaagaacagtctagaaaaacagaacactttggataataactgttctactctgaacaaataccacagaaaaccctgtggccttaccctcattcacaccaataaaggccaagtgcagaagcttctaccctcatgaagctgtaatgaagtacccaaacacccttgccagtgtcaagttagagccaagtatcaagctggaaccttcatctccactggctgggaataaggtcctatgactgtgtagtggggaccactggggagcctggaattcctctccctttcagaaataatgaggcacctcttctctgcactgggacagtatcagggaggccttgtagaaagtcaagaatttcactatagcccaatggagtatcaaggccaccctccactgtggtatcattggagactacatgacaagccagaactccaacccctgtctagaagcaaggaagagctttcccacccaggtgtcaaaagaagctgagtggaaaacatgggcttctaactccatctggcagcaatggggcggcactctctctttccctgacacagaaaaagtcagataaaacagaaggcttaaataagtgtcagagtctcataatatgagattcataatatgactttcaaagtgttcagtttgcaattaaaaagcactcatcataccaagragcaggaaatgtaaacttgaataaaaaaagaatcaatcatcaatagatgccaacactgagacaacaaagatgttagaattatctgataatgattttaaagcaaccttaatagaaatgttttactgagcaattatgaacacacttgaaataaactgaatgtttatctctccttaaaatacatacaatgaaatcctaatccccaaggtgatggaattaggaggtgggacctttgggaaatggttagctcataagcaaagagtcttcatgagtgggattagtgcccttatcaaagaggccccagagagacccctgcccctccaccatgtgaggatactactagaagccatcatctatgaactctaaagtaggctctcaccagataacaaatttgtctgtaccttgatcttcaatgtccatctccagaactgtgagaaataaatttctgttatttaaaagctacccagtgtaaagtattttgttatagcagcccaaatggactawgacaacacttaaaaacataaaaagcctcagcaaataaatagcatttcagcaaagaaacagaagatataaagaagaaccaaataaaaatattagaactaaaagatacaataaccaaataaaaatttcaatagatgtgttcaacagcagaatggaggcaacagggtaaagaaacagagaaatggaagatggaaaacagaacctacctaataataaaaacagtgataagataggctgaaaagaaaaaataaacagagtcttagttacctgtgggagtataataaaaaatctaacatttgtgttacccaatccttagaaagagaggaggatgatagagctgaaaaagtagtggaataaataatggcttcaaactttccatatttagcaagagatgtaaacctaaagattcaagatagttaacgaatcttaaattggataaaactaaagaaatctatatcaaaatatattattgatcttctggaaactaaagacaaaaaaagaaatcttgaaagtagtcagagaaaaactacaccttacctataggaaaaactatttgaatgacagatttctcatcagaaaccatggaagccaacatcctgcccatatatccttgaacttaaaataaaagtggaagaagaaaaaaaaaagagaaatcatagagggcagaggtaagtggcaaaatattttgaaattgctggaaaaaaaaaaaaaccatcaacccataatcttatgcccagtgaaaatatcctttagaaaggaaggggaaattaaggcattctttgatgaaggaaaagagaawtttttacctgcagacctactygaaaagaatggctacaggaagctctctaaaaaggaaggcaaaggcaaatagaatccttctcacatcacatcaccctggcctcctcctctgcccttgctttcccattttaaggacacttgtgattacactatgcctactgagataatctaggtatccccatctgatgattacctaattaacaacttcagttcyatatgctaccttaatttctgtttgctgtattaggtaacatattcataggttctggggattaggaggcagggatctttgaggggccattatactgtctaccacaaatgtaaacagtctaaatacaccaattaaaaaacagagaatggcaaggtgattttgagaaacatgatttaactatagctatttacaagaaactcacttcaagtataattatataggcatgttgaaagtaaaaggatacaaaaaagactatatcatgcaaacattaattttttaaagaaggaagagtggctaaattaatatcaaataatgtagattttgcagcataaaaaattgctagacacagtgagtgacattagatgatgagaaaagggtcaatccaccaagaagatatagtaattctgaatgtatatgcaccaaacaacagagctgcaaaatttatgaagcataaactgacagaactaaaagagaaaaataggcaaatctacagtaataatgacagactacaacacctctctctcaacaattgatagaacaaataggcagaaaagcakcaaggatatagaagaactcaatactcaagaatatatgtattctgtttttgttgggtgggtgatttgttgggttgggtgattctataaatatcaaactaaagtaatcaactgaaagaatttgatattcatagaatacccctcccaacaatgacrgaatatccatattcttttcagatgcctgtggaacatawagtaagatagagcatattcctgggccataaaataaatctcaacaattttaaaagaattgaaatcataaacattgtgtattatggacttaattatgtccccccycccccgtgccaaaattcatatgttgaagccctaaccccttagtgtgattttttgaagacggagcctataaaaaggtaattacggttaaatgargtgaatatggtgaggtgaataaggttacatgaggtgaatatggtggagccctaattcaaaatggcttatgtcttgatgagaagagtaagagacaccagggatatacactcacagagcaaaggccatgtgagggcatagtgagaagatctgccagcaccttgatcttggacgtgtggcctccaaaactgtgaaaaaaaaaataatttctgtggtttaagtcaactagcctatggtactttgttgcggccatgctagaaatcaataatagaaagaaacaggaaaatctccaaacacttgttaactaaacaacacagagttagctctctatatctatgggttctgcatccatggattcaaccaaccacagatagatcataaatcttcaaaaaaaaaaaaaaaggatggttgcatctgttctgaatatgtacagacttctttttcttattattccctaaacaatacagcataacagctatttacatagcatttgtaatgtattctatattattagtaatctagaaatgatgatttaaagcatccagraggatgtgcataagttatataaaaataactacagcattttataaagggagttaagcaccagtggattttggaatctgcaaggatccstagaacaaatcacccaccagatactgagggatgcctctacttctaaataatccatgagtcaaagaggaagkctcaaggaaaagcaaaaatatatattgaactgcatgataacagaaatacaatatatcaaaatctatgggactcaactagagcagtgttgagatgaaaatttatagcacattttagtgcctacattagtaaaaaggaaacagaaaaatatcatatcaataatctaagttaccacaatctaagaaactagaaaaagaaggatgcagcaaacccaaagaaggaaggaaataatgaagaaaataataaagagcagaaataaaaaaagatagctcctactttctagaagtttgtagcttatttagagagataatattaatacacaatacaaaacgatgtagaagcacagcctaaaagatgaagaggggttcgggcaacttccattttggctcccaatatactaaaaaatgaagaaatgacaaaacaggattgttgttattgtgagattaatatattttaaagttttacattagtatatagacccttatatgaataaaaatgaagkaactatattattcacaagataacataatttataaacatatacagttaacgagtacatcaaagagcccagtgatggggcataaggcaaacctgtataatgaacgtattcttcatcgagcctgtcttggtacatgtgattatatctttagtctcayctagaaataatgtcacaaatctgcactcaagaatctgtagatcataaaacataaaatgaacygtgggtttattctattttartatttctgtagaagacatctcaactaataaagccatgtcacatttttttcctttgctgctaatggagtatttgcaaaactctgcacactgcygaaaaaacaatgccatttgtggtattaycataaagccatattctgaaattgcaccagtcttgagtatgacagtcacrtctgatatacatgaaaatgtcagtatgcccctgttatgcaaattgaacaaagaagcactcaattactcaatacacactcacaaaatgcagattttacatgtgaaaatagtagtaaaagtgcactgtgatagaatctgacataatattcttgaaggggaacccaaggcttctcattgtgtaaaccagaaatgtatattctctacttccactctcccatcggccatcgattactttggaggcatgcagctctcatagagaccacctttgacattggtttggtctattscagaatggcatggccacaggtcaaatggatcacagtaaaaagtgctattggatcaggggtctgcctctgcaaatctgctgtcttagctaaatgccctcttgcctggcaaggcatctgcttgtcctgtcacagattccaagcttagcaggcaaatttccctatcaagctaacatcaatgccaagagctctgtttttctattctggcatgctcaaatgatggacacagacctctgtaggtgtaatgggaggttcatgtttggttcacagggagaaatcagagtgcagtagattgagctgtttaagtctttgctcagttgctcatgagtcatatgaccttgatcaagtcacttaacctctttgagcctcagtttaytcatctataaatagggtcctattcaacctcaggcttataagaaggatagagtaaattaatgtatggcaaagtgattgayagatatcagacccttagcaaatattagtgatattgatgatagctctgtgtttcaaaaaagaaagccagaggggaaaatcaaaaggggttttcttcctggttccttagcttgaaaaaataggggataaaatgttcacacttgggtggttttagagtgcttaaagacatatgttagattacaaacagactactaacagtcattatgagttcttaattgagttactattcccactgcactttttcaataccaagaaaatggaattactgcctagtaaatttctcaccactgtgataaaaagtcaagaggcttcttacctcacaatcaaccctcataaggggtaaataataatattgccatttaacagacaggaaaccgaaactttgaaagtctggaaaacagcaaaagcttttacttcactctatcttatgccaaaactcatgttcccttcttagtaccacactgctttgcatttcagttctagctctaataattcctctgaaagtggctcaaatgttactaatatctaatatttgctcagtatttacaatgtgtcagccacatttatatattaaattatatactttttataacaaacctagaggataattgctattgttatcctcaagacaaatatggagactgagactggagaagtgaaaccacttgctcaaggtcaaatggctggtgagtgtcagggctctgattcaaatccagacagcaagacgtatcactgttcttctcaaccattacatgagatggatgcaccacgtaaatccatgattctcaacatgtattgatctcacaacattctttccagcaaagagtagccaagaattacaaactccatcaggatagcaaagtgattagtccaagatcacacagcagcaagaccagaacttaaaccagggctttgttgatactagtcataacagatactatttataaggagcctactaggtgccaggcactgatgtaggtagctgatatttcaaaacaacaacaaagtaagtgccattgtcttcttttcatatataataaaattgaaatcaattcttaagtcaattatttgaggcaatatagccagtaaastgccacttcaggatttgagcctatatatttctatcttcaaagtccatactttttccaaacaccccagattaytcccttgagtctcagtctattgtccacttaactattatataagttcttgatttgctcttcaaaatttgttttccacgatgttatttcacaactggagtttgcatatgtattttcaagatgaaacaaagtcattccaagraacaaagaccttctctatgactttttccctttatcaaatcaaatctattattgkttcttataaactattatattttccttcagagaaaaatgcccccatagatctaggaatttacaaaatgcttatgaagagacaaaaacttcaattagtcattttctagtttggagtgggattatctcacagaaatgcaaatttggtaagtattttgattaggacacaaggagctagagaaattaccctcaatttgaaagaagagataaaagaattttgaatatctggtaatttttaatgttctcactataaaataatagactattcctggttcaaagttacatttgagatcatatatccccactctcatttyatttatttaggtttatttcatcagaaaaaagatttgaggaaacgtaataaaattacaaatgaactgatacatttaaagacaaaaagataagtaagagccatataagaaggaaggcgatcatttcattagaaaactaatgggaggttatgactgtacttgaagatctgttccatttgttacatcttggcagcaagggcaaaaatggaaaatgttatttgtagataatgtaacttatattatgtaatgatgctaatagttaatatctatacgaaaggttgaggtagtgcctagaacaaagtaagttgctcaataagtgtctcttcctgcttctccttaaagagcctttttttttttttttttacgcaaattccagcttaggggtaatatcmctttctaaagcagaaattattttctgctgggagttgttcctagacacaatttgctccttattgaataaataaataattcctattttgtaaagtaaaattcacaaaatgagcgataaattctttataaccataaatttctcaaaagattagacaaaaagtgaggaaggaaaagaaacgaggaaaggggaggagaaatgaaatttcatcatataaaaatagcatttaggccgggcacagtggatcatgcctgtaatcccagcactttaggaggccaaggcaagcggatcacgaaatcaagagatcgagaccatcctggccaacatggtgaaactccatctctactaaaaatacaaaaattagctgggcgtggtggcacgtgcttatagtcccagctacttgagaggctgatgcaggagaatctcttgaacccaggaagtggaggttgcagtgagccgagattgcaccactgcactccagcctggccacagagcgagactccatctcaaaaaaaaaaaaaaaaaaaaaaaaagcatttaattcatgtgcatatttgtaaacatttaagtagatttcctcaagacctcaagatgtggctgtcagtatatttcccttaatcactcagagtaattgctctggtttgaatgcttgcatcgccaccaaaattcatgttgaaacttaatcctcaatgaaacaatattaagaagaggggccttttgggaggtgattaagtcatgagagctttgtcctcatgaatgaaattagtacccttataaaagggtttgagagacctgtagctagacacttttttgtccttctgccttctaccatgtaaggaaaatgcagcaacaagaagccatcttggaagcagagaccaggctctcaccagacaccaaacctgctggcaacttgatcttgtacttcccagccaccaaaattgtgataagtaaaattctatttttgtaaattacccagtctcaggtattttgttatagcagcatgaacaaattaagatagaaattgtatagttttagaagatgtgtatggctgagaagttgataaagtgtggacttatgttggttaatttttggtgtcaacttgactagattgagggatactcagaaagctggtaaagcattattcctacgtaagactgtagggtgtcttgaaaagagattggcatttgaatcagtggactaagtaaggaagatcttccttcactcaatatgggcagacatcatgcagtcagcaaagggccagcatagaacaaaaaagtatgagataggcaaatttcctctctctctgattctctttctctctgattctctctctctctctctctctctctctctctctctywcwctctctctgtttctcttttctggagctgagatacgcatcttctcctgtccttggacatcagaactccaagtcctctggcctttggacttcaggacttgcaccagcagtgccctagtttctcaggccttcggactcagactgagaattccaacatcacttcccctggttctcaggccttcagacttggactgagacatcctaccagcttacccgcttctccaagatcgtagacagtctatagtaggacttctcagcctccataattgtgtgagccaattcctctataaatataccattggttctgcttctctggagaaccctgactaatatagcaactcacaaacaagcatccagttatcccagaaaagccatgctcattcatttataaacattgatgaagacaaatgtcacgtaggggataaccatttttaaaagctagatgcatttgagggtttgattacttaaacaattttataaaatgtaagcattgattcacttaaccaagaatttttaaagcattaataaggacaaagatggctgaggcctatggtaactttgagaccccatagacaaaatcctcatgaaatagagacaaggtgtaataacccaaagcttcccaatgtgcatgctgttgtataggtgtgtcaacaggagacaggtgatctgagatagtgtctccgcagccttggggctactggagcaagcaacctggcctgtttatccacgtataaaaatagtgccattttctatgtgtaaaaaaaagataggaaagcactaaaagaggctataaaataatattagtaaagatggacaaagaacrttattgatttcaaacagataagtggaaaagtcttgaaaaaccatttcaaattattatggagatgtagtcaattcaaaataacataatattaaaaatatgagttatagttgtgtgcatttctggacaagataatggagttaagagttaaatagtgaaataaatacattaaatgctctagtgatggtaaagtgtcagaaatactattttattataaaatatgcttctgggatacatgcacagaaaaataactaaatgctctgttttcattttgttttcttttgtctgattttcttaaagctgtacaactcaaaattgcactctcttcagtgtagtctaagattttatcattaactagacatagttattcagctttcaattacacagccagattttaaaaggcattatttcttattggttaactataagaatttgcttaaatgcaaatatatatgtttttccaggtactgataattagtagtatttcttctttcaggaggtataaaatttgaaatttagtccttagggcacaaaggaaaataagtgattgtcaaagttacagagaattttatttaaacttaattcagataattatgtgaaggttgcttggtattaatactcaaagtgataaaaatccttttgagaatgctcataatggcttgaaatcaaagtacctttttcattttcaggaaattttattcaatctcaaatatagggaaaaaaaagttacaatttaatctcctagaaactgcttttacttttaaggcccagtcaatcaagaggtaaagtcttcacagttcttgaacactctatgcatttccttcattgtttgttttaaaacaacatcaaaactgaaagaatgagttagttctcaaatcacaattttaaatgcttagttttccctaatacccaactttcaagtattttatttcaaccaatatccagataattagctaatattagacttacaaaccaccactgggattgttattgttattatttggggaacgctatgatttataaatgtttgttaaagttatttttcttttatctctaccaataatgaaattaactcaataataatcccataacccaaagagagctactcttaatattatagtatattcttatagacacttttctatatacatgctattttcattttyttacataattaacattctataattttgtatcatgctttctaacctaatatgtcacaagcatataytatctactttattatatttcaactacatttttataataattacatattatttcaccctacaactacgttataatttatttcagcagtcaactattgttaaacattttaattacttgcagtgtttcattactagaaacaatatacttctctggtcaaaacattaaaatgtgctctgaagtacaactaaaaaatcaaaatttaaaaagaaaactgttttaatacatagtccagtgcaaaacacattagggaagtttctaggtgccagaacaaagagaaaatgaaaagtcttaagtagaagtagaagatgaaacctttcaccaggggtgttaaagtcaaatatatgctgtaagggctggaggctgagaataacagaagttggaagatggagaagtcatgcctatgagtcagaactaaactgcacaaaacaaggagacacaaaagggtctgcattctaatctgcaggctctgcttgctatcctggaaaagctgcaaggaarctagccacgcgcgtacagaaggtgaaaacaagtcacctgtaaagcagaatgctaagcctgtgccactcgtccttctaagggtcatattccctgggtgtggacatctcaacatgagaagctaacagaatagctttccaaatcagtaaaactcacaaatacttggctgaggcaaatacaaaattattctataggagtgactccacagggaccagtctacaacccaasacactgggatttctctggtaaacaatccctcttgaaaaattacccacagtaaaaaaattataagccctacatagaaatgagccacgttgaagcacagtgagtggatgcaactaatgggatcttttgaaccccaagaactgaagatggtagagcggtctaaaaaaatacttgcaaatataagagtttaaattgattaaagaaatgggaaaagagtagaaactgtgtcaagaacagaaaattaaattaaaatgtgtttttgttaaaagagaaagaaatttttgaaataaatatatgatcaatgtaatttttaaaaactcgaatgtttcagttcaaaagtcattaggtagagttgagcaaggtgattgtctggtcaaggtcagggaagaggaagtatagctacaatgagaaatggggtacatccaggtgggactaatgcaataaataaatatactgaggataatgagagccagtttccccactgtttgagaaaacagtggcaaatatgaaaagagaaaaaataaaatagattagaactgtggaactcatggtagtcaatatagacaaatctggaagtaaatataaaaatatatatgtatatatttatgtatatgtagatagatgatagatacatgccttggtgcaatagtaatgattacattcaacacccagatcttaatttctaaataacccctcaccactaaaaggaaccagtgttccttggtgaaatggctgcttccagggctggggcaggaaaagcataaggtgaccctagaacatctttgggacagaaagtaagaaaatactcaaagaattgtgggaatgtgtcaaagacactattgtaaagaaacttctagccaaattttggacaatttgagcatcaaaataattatagcaacaaattataatctgttgaataaaaatgtgtaagtctataatgatataaataaattattatctaaatctagaaaaaggaaagctttttcttacagttaactgccaaatgataaatgtaaacagaataaagcagttagaaaatcacaatatgacaaccatctgagtagtaattaattcagccaccaaacatgaagggatactaaagctacttaggaaaggtttaatgaagaatgttgatatttacatagtttcttttttattattattattatactttaagttctagggtacatgtgcacaactgtgcaggtttgttacatatgtatacatgtgtcwtgttggtgtgctgcacacattaactcgtcattcacattaggtatatctcctaatgctatcgctccccactcccccaaccccatgacaggcccctgtgtgtgatgttccccttcctgtgtccaagtgttctcattgttcaattcccacctgtragtgagaacatgcggtgtttggttttctgtccttgtgatagttggctgagaatgatggtttccagcttcatccatgtccctacaaaggacatgaactcatcattttttatggctgcatagtattccatggtgttatatgtgccacattttcttaatccagtctattattgatggatgtttgggttgattccaagtctttgctattgtgaatagtgccacaataaacatatgtgtgcatgtgtctttatagcagcatgatttataatcctttgggtatatacctagtgatgggatggctgggtcaaatgatatttccagttctagatccttgaggaatcgccacactgtcttccacaatggttgaactagtttacagtcccaccaacagtgtaaaagtgttcctatttctccacatcctctccagcacctgttgtttcctgactttttaatgatcaccattctaactggtgtgagatggtatctcattgtggtttttatttgcatttctctgatggccagagatgatgagcgttttctcatgtgtctgttggccgcataaatgtcttcttttgagaagtgtctgttcacatcatttgcccattttttgatggggtcgtttgatttttgttgtaaatttgtttgagttctttgtagattctagatattagccctgtgtcagatgggtagattgtaaacattttctcccattctgtaggttgcctgttcactctgatgacagtttcttttgctgtgctctttagtttaattagatcccatttgtcaattttggcttttgttgccattgcttttggtgttttagtcatgaagtccttgcccatgcctatgtcctgagtggtattgcctaggttttcttctagrgtttttatggttttaggtcttacatttaagtctttaatccatcttgaattaatttttgtataaggtgtaaggaagggatccagtttcagctttatacatatggctagccagttttcccggcaccatttattaaatagggaatcctttycccatttcttgtctttgtcaggtttgtcaaagatcagatggcygtagatgtgtggtattatttctgagggctctgttctattccattggtctacttctctgttttggtaccagtactatgctgttttggttactatagccttgtagtatagattgaagtcaggtagcatgatgcctccagctttgttcttttggcttagggttgtcttggcaatgcagcctcttttttggttccatatgaactttaaagtagttttttccaattctgtgaagaaagtcattggtagcttcatggggatggcattgaatctataaattaccttgggcagtatggccattttcacgatattgattcttcctatccatgagcatggaaagttcttccatttgtttgtgtcttcttttattttgttaagcagtggtttgtagttctccttgaagaggtccttcacatcctttgtaagttggattcctaggtattttattctctttgaagcaatgtgaatgggagttcactcatgatttggctctctgtttgtctgttatttgtgtataggaatgcttgtgatttttgcacattgattttgtatcctgagactttgctgaagttgtttatcagcttaaggagattttgggctgagacaatggggtttcctaaatacacaatcatgtcatctgcaaacagggacaatttgacttccccttttcctaattgaatactttatttctttctcctgcctgattgtcctggccagaacttccaacactatgttgaataggactggtgagagagggcatccctgtcttgtgccagttttcaaagggaatgcttccagtttttgcccattcagtatgatattggctgtaggtttgtcataaatagctcttattattttgagacacrtaccatcagtacctagtttattgagagtttttagcatgaagggctgttgcattttgtcaaaggccttttctgcatctattgagataatcatgtgatttttgtctttggttctgtttatatgatggattatgtttattgatttgcatatattgaaccagtcttgcaccccagggatgaagccaacttgatcgtggtggataagctttttgatgtgctgctggattcggtttgccagtattttaytgaggatttttgtgtcsatgttcatcagggatattagtctaaaattctcttttattgttgtgtctctgccaggctttggtatcaggatgatgctggcctcataaaatgagttagggaggattccctctttttctgttgattggaatagtttcagaaggaatgctaccagctcctcgttgtacctctggtagaattcagctgtgaatctatctggtcctggactttttttggttggtaggcyattaattattgcctcaatttcagaacctgttattggtctatccagcgattcaacttcttcctggtttagtcttgggagggtgtatgtgtcgaggaatttatccatttcttccagattttctagtttatttgcatagaggtgtttatagtattctctgatggtaattagtatttctgtgggatcggtggtratatccccattatcattttttatrgaatctatttgattcttctstcttttcttctttattagtcttgctagtggtctatcaattttgttgatcttttcaaaaaccacctccaggattcattgattttttgaagggatttttgtgtctctgtctccttcagttctgctctgattttagttatttcttgccttctgctagcttttgaatgtgtttgctcttgcttctctagttcttttaattgtgatgttaggacatcaattttagatctttcctgctttctcttgtgggcattcagtgctataaatttccctctacacactgctttaaatgtgtcccagagattmtgttatgttgtgtctttgttctcattggtttcaaagaacatctttatttctgccttcatttcattatgtgcccagtagtcattcagaagcaggttgttcagtttccatgtagttgagcggttttgagtgagtttcttaatcctgagttctagtttgattgcactgtggtctgagagacagtttgttgtaatttctgttcttttacatttgctgaggagtgctttacttccaactatgtggtcaattttggaataagagtgatgtggtgctgagaagaatgcatattctgttgatttggggtggagagttctgtagatgtctattaggtccacctggtgcagagctgagttcaattcctggatatccttgttaacattctatctcactgatctgtctaatgttgacagtggggtgttaaagtctcccattattatggtgtgggagtctaagtcttttgtaggtctctaaggacttgctttatgaatctgggtgctcctgtattgggtgcatatatatttaggatagttagctcttcttgttgaattgatccctttaccattatgtaatcgccttcttagtctcctttgatctttgttggttkaaagtctgttttatcagagagtaggattgcaacccctgcytttttttgttttccatttgcttggtagatcttcctccatccctttattttgagcctatgtgtgtctctgcacatgagatgcgtctcctgaatacagcacrctgatgggtcttcactctttatccaatttgccagtctgtgtcttttaattggaacattaggcccatttacatttaaggttaatattgttatgtgtgaatttgatcctgtcattatgcttttagctagttattttgctcattagttgatgcagtttcttcctagcatcaatggtctttacaatttggcatgtttttgcagtggctggtaccagttgttcctttccatgttttagtgcctccttcaggagctcttgtaaggcaggcctggtggtgacaaaatctctcagcatttgcttgtctgtaaaggattttatttctccttcacttatgaagcttagtttggctggawatgaaattctgggttgaaaattcttgtctttaaaaatgttgaatattggccccctctctcttctggcttgtagaatttctgccaagagatcagctgttagtctaatgggcttccctttgtgggtaaccgacctttgtctctggctgcccttaacattttttccttcatttcractttggtgaatctgacaattatgtatcttggagttgctcttctcaaggagtatctttgtggctttctctgtatttcctgaatttcaatgttggcctgccttgctaagttggggaagttctcctagataatacccttgaagagtgttttgcaacttggtttcattctccccgtcactttcagttacgccaatcagacgtagatttggtcttttcacatagttccatatttcttggaggctttgttygtttctttttactcttttttctccaaatttctcttctcgcttcatttcattcatttgatcttcaatcactaataccctttcttccacttgattgaattggctactgaagcttgtgcatgtgtcacgtagttcttgtgccatggttttcagctccatcaggtcatttaaggtcttctctatgccgtttattctagttagccattcrtctaatcttttttcaaggtttttagcttctttgcaatgggttcaaacatcctcctttagcttggagaagtttgykattaccaatcgtctgaagccttcttctctcaactcgtcaaagtcattctctgtccagctttgttccgttgctggcaaggagctgctttcctttggaggagaagaggcactctgatttttagaattttcagcttttctgctctggtttctccccatctttgtggttttatctacctttggtctttgatgattgtgacgtacagaggggkttttgatgtggatgtcctttctgtttgttagttttccttctaacagtcaggaccctcagctgcaggtctgttggagtttgctggaggtccactccagacgctgtttgcctgggtattaccagcagaggctgcagaacagcaaatattgcagaacagcaaatgctgctgcctgatccttcctctggaagcttcgtctcagaggggcacccggctgtatgaggtgtcagtcggcscctactgggaggtgtctcccacttaggctactcgggggtcagggacccacttgaggaggcagtctgtccatactcagatctcaatctctgtgctgagagaaccactactctcttcaaagctgtcagagagrgaygtttaagtctacagaagtttctgctgccttttgttcagctatgccctgcccccagaggtggagtctacagaggcaggcaggcctccttgagctatggtgggctccattcagttcgagcttcccagctgctttgtttacctactcaagcctcagcaattgcgggcacccctcccccagcctcgctgccaccttgcagttcgatctcagactgctatgctagcaatgagcaaggctccatgggcgtgggaccctcygagccatgcacgggatataatctcctggtgtgccatttgctaagactgttggaaaagcrcagtattagggtgagagtgtcccgattttccaggtaccatctgtcatggcttcccttggctaggaaagggaattccctgaccccttgcattcccaggtgaggcaatgccctgccctgctttggctcacactccatgggctgcacccactgtccgacaagccccagtgggatgaacctggtacctcagttggaaatgcagaaattatccatcttctgcatcgctcatgctgggggatatagactggagytgttcctattcagccatcctggaacttccccccaccaaatatttatataatttcaatacataaggattttayccctacaaaatccttattaattacaaagggataaagagaatcttcacagtggaaaaacctgactgtaccactttaataatggtcatgattaccagtagtgggacaaatcaacactgagtcccacctgataggattcaatgagaatacggtatcacttctataatactcctatcaaaatgcataayctgaatcaaaccataagaaaatatcaaagatacaaaaagtaaggaacattcaagaaaataactggtctgtcatctttaaaagtcrcaacatgaaagtcaaggaagactgaggaacattccaagctgagggagacggcagagacatgacagctacaggtgatgtatgatcctttgctagatccttttctctaaaggacatgattgagacaattggccaaactgaaattgagcctgatgagatgatagtaatttatcagtgttgacttcctagtttagatgttggagaatttccttgtctgtaagaattacacactgaaatagttggaagtgacagggatttacatcagctacttaytcttaagtgtgtcaagggaaaaaaaaagytttttatgctactctgcagtctttctcctggtttgaaattatttcatattaaaaaataaaactcatgtaccaaacagtagtgcagacacagttgagtgaattatttggaacctagaacagaaactgttttaaaacaaatggagttaaaatattggacaaagacaaagaaagtgagtggaggacttcggagttaaggattccaaagggccttacaytgtttcagagcaagatagatgtgatatttaacttcacaatttaagaagtcacataaaaatttaaaggtaatatagagcagaaaaagaatgaaaaactttcaggctcatagaggagaaaatgagtaataacaaaaatatgatccatgttctagaaagctgcatggaagaagaaagccacagaaactgaataagtatgtaagtgtgattaaaaaaataaaagttggcaacactataataaacatccttggatataaacctctctctctctctgtctctctgtctctctctccttctctctctctctctmtmtatatatatatttaatgtacttaaaattatataatatttgatattaatatagtttcaaagtactttcctaaaaaatctgtattaattacaaagggataaagagtatctttacagtggaaaaacctgacagtgccattttaactgatcaccaaaaatgggacaagttaacaacaagtgctacctgataggatattatataaatgtccttagacattatatgacatgagtgttctatgttttacaaaatgtcctcagaatccctggaaatagaattgctatgttaaaactacagacacattaatgtctcaattcattaacaagtaaacaaaggttttacttaacaaactataacttttctattcaaaaaaatgtaactacatttactgtgctccaccctatcaatgaggctccaccacrctatccatctacctactctcacaacaggccaacctttttcttgccctagggcctttgtaaatgctgttccttgtgcctggattggtctcccattttcccccatccttccttcataaactcactccttttcatcttcccataattgccacctccgcggtgaagtcctcgctgacattcctgggagatcacctcctatgcaccccatagccacactttgtgcaaaaaaacgttcaacaattctctcctaaaattgaggagtttagtgtcaccttcttatgttaatttttatagagcagtctttctcctgtgacacactatattcaatttttttctttcataagtcaagctgctaagtgctaataaaacacgtaataaaaaggtaaatggcctctgtattaatcttaagtactgctgcctgtaatatgatttttaaagctatattctcaaattacataaaccccatgggactgattgtcaatgtctttcatatataagaaagcctcactgtggctgtcatataacttatgccaaatctgttttcttctccttaaaaaaatatgttttcaaaaactttttctaaatattttcatgaagttagtgctggtcaayggagccacactaaagcactcataacctcagcttaaccacgggaaaagcactttgttatagcattgatcgacctcacatttatttcagaaaatccacagttttcttataaacaagcatctaatgctggtgaaaattgttgccatttccagcaggaagtgacctaggactcctagaaagcaactgmttttaagggtctggtgatgaccactgggcatgagctggtgagtgattaacattgttagatttgtccgtagtatttaagatgttcagagygttttacaatcccttttcttagtcacaactcataggcttgtgaaggaggcagctcctgtcattattgctttgctatttggatgctgatccacagaaaggttaaataccgtttccaaggtcacggagmgttttcctgacagagcctacttaagcattcattgccgctgacacagggctctagggaaaaggaaacagaggaggcgaggaaaagccctaggctacaatgagaacacaacatcataagcacatcactggggatagtctttctcatgtgctactaaagaccactatgtcagcaaacatccaattatgtctgattcttgctaatattaaataacattctcaggattcctgggaaacagcaaaactatacactgacatagaatgggagggggatgaaattacattgactttttcatacctacccagatgtactgtttattttctatttatagtatgctaatactaacacatgtaagcttatattttaaaatgctaatggaatcctatcatatgtgctgaaaacagtaggcatcgtttagtttttctatctaagggtcacaagtaggcttttattatcaaaggaagactctcacttttcagagtacaagttgaatatcccttctttgaaattcttgggaccagaactttttcaggtttcaatttttttttaaattttggaatacttgcatatacatagtgagatatcttggggtgtctaaagtcaaaacacaaaattcatttatgtatcatatacaccttatatacatatcctgaaggtaattttacacagtatttttrataattttatgcatgaaacaaagttttgactgcattttggctgatatccgtcacatgaggtcaggtgtggaaatttccacttgtgacatcatgtcaatgctcaaagtttcagattttggagcatttcacatttcagattttttgatgagagatgctcaacctttagcacactatgttcagaaaggttaacatcacacagttactcagtgcacctttccaccagctcagcactcctctgtcccaagtggtgtgtctccctgtggccatcccctgctgggcagtactgatacrtgtacatatatgaaaaacaacatccataaggaaaggttaatttggagaaaagcctaagtggaggaatcgatcagcaacaagagttaataatcaattgcaggtgatttgggtaaatgtgaaaataccctgagatcacatagtctttatcacatcacctttaaggagaggaactcatcattgctcagtagtcaccaatctcagtttacttcttatcctaaaaacatggacaaaggggagatkggaaacccagattggccctggaggccggccagctgtgaatcccattctaggctcttagtccttataatcatttgtttaatcagactgccttctgcacatggaagggggagtaatggctatttctcacttagaaagcaaagtaatagtgtacagatcagatctctagtctttgttccagatactgacttattttcagtacattgtggttcaagaacacatcgatcataaaaacgtggcagctttaatgagctaatgttgtctaaactggagaagaaagaatgccaagacagagcctagggcttctgagtagatttggaccttcaataaatttctttcagtcaccccatactctagacagaggccaagaatgaccctttgattcctgtcttcagcagcaaaccaaagactttttcactgtggggttttggggtttggtttgttttccctaaaccctgtgaccatgactttcctagcatgtgatagagctcattgtctttctgctgagctctccaattcgtccccacagaacacatttggcacccacagcaacacaggcagaccacaaagtctccagaatgaggaaatgttggaagcaaataatatattcagctgagcattcttcctggcagtgggagcaggagcctgatttggaccttaaaagcttagtggcaacaacaaataagcattggcctggaaaatccacatcccaacaggctaaacaaggcaggtaatatgaaaataagtttgatgtatttacaaaatctctctaaattttctttttactggtcacactctcaggccactttcatggaatcattcagttctgcatcccttgtgtgggatccagagctctttgtatctttgactgcctcccagcacctgagggtcaagtatcccactgagagcttggaaagagaagccaagaagatttggagctggtgcgggtgactgtcaagcgcagatggccagttaccgacgtaatctgtgtatctgggaggcatgtgctataagaaggcagctgytaaamcaaatgaatcaagccacagtttttaagaaggaaaagtgtagattggaaaaggataaaagttttgaatgcatgcagctgtgcagggctatgatcaatgctttaaaaattaggattatatgcactgatggagggttttcccaaagtgcaaccctatgtgaggtcagagcgataatccatttcatttcactggcagagttgggagagggcatttaacaaggtcagctttaacactgttttcctgggatgctgaatgtggtttgtwactgttgatgctctgtgttttggaataaggttgtaagactaggtttaaaagaaggtattgacctgtcattttcctataaaagtggagcagagatggcttttattccatttattgatcacttagatgtgtgacttaatctgtatggctggataaattctggattttctgtctatccatggtttaacccataatgttactggaaaatgagccaayattactttgttctggctgtgtgcacagcagtgaattctaattgtgtttctcaatctaagccccagaatgaaaactgccargatcaattcattttgataaattaactgtttctgatggctatctacactgaactgcagctgctgtgtttttttcttccttaacaaaatgattatgaagtaaatgtgctccaactattgctcacattgttttattgaactaatgaattgctctgggaagctctatgaagacttttgatcaattattgtgcgcaaattgtttaaaaggaaatacatcataattaggctaacaaatctgctgtgatgctgcctctcctgatgaataaattttgtgtagatagaggggtagayacataggggtactttgcatttttctcttcattgattttcatacatcataatacgatggattaaccaacattggctcacaattgctctttgtccgaagtttaatggaggaaaaaataccttttaatcccttttaaaaatctcctataagtgtgagacagataagcatatggtcatcaagcaatactactgagaacattcacctagatcaaaatgaggaaatgtatttcagctgtcactgccatgtcattatagcccccccttaactgcatttatgttgccaagaggaatcctcaccagatcaaactgaytggaatgaggcccaagacagctgtggcccagataaagaaaaccaaatgattttcagtctcctgaataccaagaaacaggatatgtcattgatgtccagttagtgatcttgttctacactcagtactgctcatctgagtgtgacactttctgtatcgtcattggactactgtcactcattacagtttaaagagaaaattattccattttctttaaagacttctactgcaaagtttgggactcagacaccaagtaatacagtcagagaagacttcaggagtctatacaaagcatcyttaattcaatcaatgacaatgcccattgttctaataatttcattgttcaaaaactaaagataaattggcatggaaacacataccagactagagactaccaaataatatagagagtatgtatggatggatatatatakakagagagagagagacagagagtatggatttattaaaatttgaccttatataagagggggaaaatgactacatgaagataaaggttttagtcaagcctctcacaggaagttttgggcattgataagaaattagccctttttagctacctatctttaaaaacactgttagtgttatgctctatgagatgaaacttcatgaattaaaaaatatgtggtgccagccacagtggctcacacctgtaatcccaaaactttgggatggtgaggcaggcgtatcacttgaggccaggagttccagaccagcctggccaacatggtgaaatcccatctctactaaaatatatatatatacatacatatatatgtatgtatgtgtatatacatatacacatacacaaaaattagccagagttgggggtgcatgcctgtaatcccagctactcaggaggctgaggcacaaaactgcttgaacctgggaggcraaagttgcaatgagccaagatcacaccactgcactccagcttgggcgacagagcaagactctgtctccaaaaaaaacaaacaaaaacaaacaaacaaacaatgtggctttgatgaatgttggcatgatcaaagtcattgggactctatgtccaaacaaataaaagggagtctctgagacctggggatagtatgtttcttaggaaaaatctgtgtaacatcatctcctgtcccccccsmaaaaaaagggggggtgctgggcacggtggttcacacctgtaatcccaacattttaggcggccaagatggaaggattgcttgaggccaggagttcaagagcagcctgggcaacataatgagactccatctctataaaaatatatattttttaaattagccagacgtggtggtgcacaactgtagtcccagctacttgggaggctgaggtgggaggatcacttgagccctggagatttatgctacagtgagttataatcacaccactgctctccagcctgggtgacagagggagatcctgtctcaaacaaaaaaagccaaaaagagttcctttaagtgaacttcattttccctggccagtgagtgatcttgttcttttcaaaggggctttccctaaggaactctcaagcctcctagagtttcctattcctctaagttcttgtccttctctgtaataaagcttctctctccctaaaagataataacatcatatatgcaataatttttttaatgtggtgtctttagaagagcaatattttaaaagtcaaaccactagtaacctaacagtttgcctaaacttcctttgtcatagaacacatgaagtttatgtttrcacagacaagtcggctagaggtcagggcctcagggcctccccmactgaggaccgagagcataaatacctcagasacactgtaagccattcatgtgggaarggttgctgtccagtagaggttgctaacttttttgtcatgctatctgttgacatctattaaccccttctcagaatatttttaaatgcatgaaataaaatttataggattggaaaggaaactgattatattgaaatacagttagcaaatactttaaaacaaatgtatgatataataatataggtacttctttttgaagtatcaattaagatcagtggcaacttcaaagtaattgtaagtataagtaattttcaaggtatttgcaaccattacattgtaataygaaaatattttttgtttctattagagacctagtcatggatgttgctaataatacagaagtttgtagcctatatttatagttgagggagatgacaaattttgagagaaagtaaggatgcaattttttcaaatgccaactcatggacccctaagatttttttcccctaagaaaaccctgctttagaagasgaaagctacaggaaaatgtttctattgcactctcttcttccctgtccccagacttttcctgaatcactcataatccctttacctatattcttttttccttcagttttatctatatttgttctctttgaattagtcttttttcattattatcttgcaaattctttcccttcttttccttyacttcatttcctttcctccctttccataattcatttctcaatacacttagcacatgagcagctccatcagggcaagcccttgaatgagtctgtccatagcacacagtagaagtttgagcaaagagggaaatgcaccaagaaatgcagccaaggtataggagggattcaccttgctccaagccaggccctttgtcattagaagcagtttttacagctcaggataaaagtgggcaattgtctgtttaccttagtcaatataatacagtcagtaaaattacctaatcatcaaagtagaatatttgcagtcatttttatcacataaatatcaagttcttcctgtagattaaggttccattagttaatctcgtatcttaatagaagtgattatcattaacgaaaccctaaaaatatttatagacagtcaagattatatgaaattgcaagcatttaaaattgttctccacatacctcaaatacacaaccatacattggcattgaaaaatgtcataacaccacactcatttaccaccctcctgctcaaataatattctagataaaacttgtatgattaggcagggcagggtggctcatgcctgtaaatcccagcactttgggaggccgaggtgggtggatcacgaggtcaggagttcgagaccagcctggccaagatggtgaaaccccgtttctattaaaaattttaaaaaattagccaggtgtggtggcaggtgcctgtaatcccagttactcaggaggctgaggcaggagaatcacttgaacctgggaggcggaggttgcagtgagccaagatcgtgccactgcactccagcctgggcgaaagagtgagactccgtctcaaaaaacaaacaaacaaacaaacaaacaaacaaaaaaacttgtatgattatgctcttagargccatgaattatctgcttgatctcttggggctgccactgagtaatccagaagaccattaaattccccagtaagggccaggcacagtggctcacacctgtaatcccagcactttgggaggccraggcrggcggattgcctgaggtcrggagttcaagaccagtctggccaacatggtgaaaccccgccactactaaaaatacaaaaaaaattagccaggcatggtggcgtgcacctgtaatcccagctactggggaggctgaggcaggggaattgcttaaaccaggcaggcggagtttgcagtgagccaagatcatgccactgcactccagcctgggtgacagagcaagactccgtctcaaaaacataaaaataaaaataaatttcccagtaagtagatgaagaaaaacactraataaatatggaaacaataggaaaacaagagactcataaatgaaatttatttttaaattgtgctggattaggcttaccaataaggaaagggaattcattaaatgttaagtctttcatttcagtaaagcacatgtaacaacatctaatataattgtgtgtacgaccatgtgagctaattttgccacaaaaaaacagccacctgggtaataaactgtctgaaaaaataatgataatttataaamatgccaattggggaaaagcacttaatattatgctgtctagccaaagaaaatgagatccactccaattatttcaatactctgacatgaagcattttgtgttactttgatagtcataatttatcgtgaggaagggctgatcaggaagtggacagaagcatctgtatggaagccacacctcagtccacaggctttttcaggtgactcacctatttccaagctacctagctctccctgctgattgtttcaagtgcaaataaacatgctgtatgatgcaaatcttggctttgctaaccaaatgtgtgaccataagcagtcattatatttttctctaagcctcagtttcttcaaatgtaatatggggtaattcatagagcaatcatgaaaaccaagttagacaacacatgttaagttgctagtacygagcctgacacagagtaagttctcaatcaataatatggtgatgtcctttagctgatccaagcaactggccagataatacttagaactctaagaagaaaatatggttgaattttatatgatgtgtaatgccttttacctgtttagaaatctattttattattcttctatttggtgcaatacataccaatggtgatctaatgctgtggtatttttcacacaccatagtggaagtattactttaatgtcaagtgtaagcagctcatattatgcttaagaccatgatatctgccttgaaatagcataaagaaaaatcacatccacctggagaacatgaagatagctataacattgtttctatagggggaataaattaaaattttgtgatttctttacattaaaatttgaagtacattgacttagcctggggatttccaaaataactttttaagaagtaatagggatctttaaaataaaatgattaaaaatccatctattttatttggctcattcaaatataatatctataaaagctttgtgttgtggtaataatcccttactatttcctctctctccttggtcttttcatttattcatttcccattaatcgtaaaactgaaataaaaagagaatgaattttttaaagtcactttccattctaaagctttgttaatttcttctaagtgcactttagtgctgtttaatttgtatctaggggtagcgcattgttgctgcactatttgcttattcctccagatagaagcaattcactgggctagccaaatcctccacctggccaccatcagcatatgcacatcaccaggaggaaacaggcagctgagtgtacctttgggcctgtttcctttggtattcaaattctccactttctccagtgggcccacagtagtgggggcatatttatggaactcagatcatctctgatcctaatcctggcagacaatgaacatagctgtgtttccattctgatattttagtactaaacaaagctctatctatttaaaagctattgcgctgacaaataaggagtctccaatgtgcacttccgaatttaacattagttgttactggaactcactgttttgttaatgttatataagaaaagtctagaaagaaacaggagtgatcttgttgtagctcaaccaggattatggatgtccacactttggaaaatgtatagatgttagactgtggtgatatgttttttagggtcactgggcaactccataccccttagagctagaatttggtatgttaagtgtaacttggtaatacatatgttaaaaatggcttttatcttggatgataacatcactagtttctaggcatagcattttttctaatgtgtaagaagttttactccatggatgtcacctgatgattgatcattttgatgtagacgagtttgaatttaaacatcaaatcatgctttatctgagactctgttatccaagagagcagatatttttaactaaggatgtatcatgccacattgaactgaaacaaacactaagcatgttgaacaagatcagtagtggcagtaaatgtgcacgattgactaggacacagcacagtatttttattccaaatgaagtacttgtaattagctttgtattttttgaactatatttatatagatttctttatgttaaatttcaacaaaacatgtaggatccagaagacctcatcttggaggtcttgggattttcaccttacagaatgattcttcttgtccttggtcatatttttcttggtcttagaacctgctaaataccaaaccttcagaaaaaaaaaaaaaaaagaaaagaaatgccaaccaagctattctaccaaagagctgaagaaaagccctaatgatctttaaatccagtaaccaaaagttgccagctatttcttctaaaacaaattaaattttttttttaattagttgggaaaaccatctgctacatagcttctttctttgctgtgtacaacttgaactgctgttcacatccataatctacatgcctagcttagtgcctggcacatgaaaggtatcacataaatatatttagaattcataagaatctagttcagtgaattgaatgaatgaatgaagaccatattctaagtcttaatccttatcactactaatttagcagaaatgtcctgagaagtgctgattttcacattcctcctcatcacatttttcctattgatactgttaaaagtggcaaatgtagaactccactccagatttctccagtgtaggaaaccagggagcaaatcaaagcaagggaagtctttcaatcttttagcatctctggtaaattagtaaggtatcctcctgcacgttgctctgggtttgaaaagrttttaaaacaaattacttttttctcttggcctgtctcaggagcaacctaaattctacttttcaaatgctgaaatgcccttaaaagggaggggttgaaatgatatattcaaagaatcagttttaaagaattagattgctagctctcctcacagcagatagtctggaaatgacaattgctaggctttttggtggtattagcagagtagtaaatataatgtatatgtcatttttattccagatggaaagaccagtagttactagtgaatgacagtaaattgtaccagataccaagtaaattttaacaattttatagatgcttttctcatattcatatattcattagtatttcaatgtttaggtacataactcaaggtttcaatattacaccatgtaaaaagaaaattacaaaagtgtctacagaacaacattccactcttgagacaaaaatccatagtttggtcaagaaattattctatatcaacccaaaagaaatgaaaatatatatcccacaaatatctatatgtgaatgctcataacagcggtattcataataaccaaaatgtaaaaattatccagaggcatgtgaactggtaaatgggttaaaaaaatgtggttgctccacacaatggaatattattaagcaataaaaaggaatgaactactcataaatgctacaatatggaagaacctcaaaaacattgtgctaaatgaaataagccacgtgcaaaagatcacacattatattattccacatatatgaaatgtccagaaaataaaaatctatagaaataaaaagcaggtctggagctcagaatgggagcaggaattgtctgcaaagaagcatgaggaatattttcagggtgagaggaagagtctaaaattggattttggtgacagttacacatcttgtaaatttacttaaaaactaataaactgtatacttaaagtgagtaaattttatgatatataaacaataaagctgttaataaaaatgagaccaaacacttttgttacagatgaaaagcttgattaaaatgcttacctgtacaaaaaaaatcacctgtgaaatataaaatacttttactaatatgtaaagcaattgtcaatgagaagtggtttttttctctaaacaatatgatagaaatatgagaacagacattccctaaattgccctaccttccaatatgttctctcaacaatgtcactgagtagatacttactgggcgcctcctgtgtgtcaagtatcatgttaagttcttaaaaagtgaaaagattgagacaactttaatcaaggcctcctttttttaaatttatttatttatttatttatttttggctttccagtcatagaccttctttaccctcactgatctagagactgtctcaaaaggcatagacaagcacacttgtagatttatcgttccgaatccaacatcggctgagccatctatgtgaatcagtgtatgccctaaccccttccccagatttcgctttcctcacaytcccttccagccacatcgctccattgtctgcaaataaccttgccttttacttcaaagagaaaattgaagccaccctgcagaaaatgcctctttccactcacccactgacaattcctcacacctaccaacccttcagcccctcctattccctcaggggtcaatattcaactctctctagtatatttaacctcttcttaattggtacttttaccttaagttacaaacgtgttcaagatctttcactattttaaaagtattcttaaaacttacaaactcctctagcaactttcctctttccctctatcccttcatttccttgaaagatctggctaaatttcctgcttcctcttcttgagccctgtctaagatcagcaatgatgcgccagttgctatatcactgtttcctcatcaatatttagttgacttgctgtttcggtagtatgcttttgggccttagagttgattctggaaaggatcgagactttggagaatgctrgaacagagtgaatatattttataccttcacctctccaaagacccagatcatcatttccaactgcttattgtacatttccacttggataacacattgactgtgcagattcatatactgtatttcatcagatctaaattttcatcaattataacataacccattattttatataccgctaagaaaaaaatgccactaatttgttgatgctatgctattcattgtgagaatcatagcaaattgagagatgttaaaaattgggatctaattaaactaaagagcttctgcacagcaaaaaaaaaaaactaccatcagagtgaacaggcaacctacagaatgggaaaamatttttgcaatctactcatctgacaaagggctaatagaatctacaaagaactcaaacaaatttacaagaaaaaaacaaccccatcaaaaagtgagtgaaggatatggacacttctcaaaagaagacatttatgcagccaacagacacgtgaaaaaatgctcatcatctctggccatcagagaaatgcaaataaaaaccacaatgagataccatctcacaccagttagaatggtgatcattaaaaagtcaggaaacaacaggtgctggagaggatgtggagaaataggaacacttttacactgttggtgggactgtaaactagttcaaccattgtggaagacagtgtggcgattcctcaaggatctagaactagaaataccatttgacccagccatcccattactgggtacatacccaaaggattataaatcatgctgctataaagacacatgcacacatatgtttattgtggcactattcacaatagcaaagacttggaaccaacccaaatgtccaccagtgatagactggattaagaaaatgtggcattatatacatcayggaatactatgcagccataaaaaagaatgagttcacgtcctttgtgaggacatggatgaaactggaaaccatcaatctcagcaaactatcgcaaggacaaaaaacaaaacaccgcatgttctcactcacaggtgggaattgaacaatgagaacacttggacacaggaaggggaacatcacgcacgggggcctgtcgtggggtgggggtagaggggagggatagcattaggagatatacctaatgtaaatgacgagttaatgtgtgcagcacaccaacatggcacatgtacacatatgtaacaaacctgcacgttgtgcacrtgtaccctagaacttaaagtataataaatttaaaaaaattggcggggggtagggggagacagggaccaatgaagtgaaggaaggattcagtgaagtgaaggattcaaggaagtgaagaatttaatcagcaaggaagtggaggattcatcttcagaaagaaagatgtttcaagcagctggcagagcatgagcaaagtcacggctgtttaaaaatgcctggtctatttggaaaactatggcatctggaaagaccaaggccaacttgtgacagtctgttatcaaaaatatctcagtaattaagcagattttaaactgtagggaaaggaataataacccccatacattcttagttggaacagactcattacaacagacagattaacaagagaaaaacaaacagaagtttgttaacatgtatatttcatatataaatgggcgacacccagggaataagttctcaaagacgtagctttgaattccagcttatataacatcttcaacaaagaacagtaaatttttagagaagtaaaaagacaaagaaaaaggacttggagtctctagggacagcaacttcgggaagactaacagaaaaagtttagttagtaaagcttgttaatgtggatttctctggcatcaccccaagcctataaattgtgtgtattagagggaaaatcacaccttttgtcttcgtaaatctatgtcctgcttttgagcaaatagagagaagacagagagctttcctgtatctccttcttaattgccttcaggtcaacaattctttatattttggggtggtatattctggtctttcatagtcccaccattgaaactttatttatataaaatttcgcaaaataaaagtagggttggtagctatggaaagatttgggttgcaagttgcaagatcaaagatgggcaaaagacagaaaaacataaattgaaacaagcagaaaaaaaaaatacattggagtacattgtcccataccttattgaatcagtcacttartactaagaataagtcagttcagttaaactgaactgaactgaactgaactgaactaagtcagttcasttcagcgtctcatttcaggaggtggtattacaagtgggctcccaccaaagttaggcctatatggtgcaagcatacagttatttaataagaggtatttatatgaaaacaagagaaaaacaaagattaatcattagagcaaattttaaaccagttactgaattcagagggtggctggtcagaaagaattctaaatgttgggctcaagcatcttttgcagttttaatgactccagtgatgtctgagtggcccacaggcaagaggcatgaaggaagtccacatgtgagctattgtggttatttctcctaagtttatgttaagttgtccagtatcaacttgcagggttttggggaaagggtagattttgttcttagtgatgccaagtcagaaaggtgagagaatattggaaatcttaatttggagacccacagccaaatattggaggaaactagaaaaattcagaatccagttcagttcacaggtagataataaaacctcaaaaacaatgaataggactagaatctaacaataggtgcactgtacttttattctgaaatttttttttctctgtaatcacccctatttctaccaaagaaaatcacagtaaggctaatttattttcaaaataagtctagtgttattaaacttcaattgattatttatataagtgcagcaaaaacagtgattgatcrcataggctctttttaagtctgctttgctggaacttttgataagaaatttcagattagatttttaaaaggctttgactcaaggccaaggatttgctagaagactttgaccacaatacctatagatttgattaaattcttctcttcttaaggttcctgaaatattttgaggttcctgattctgccaggaagtgacattccgtactcacctataaggtttgcaacacttttaattaggtactaggccaggttttttgaagggggggggggctttattggttccataaagccaaccttagtttcttaaaactacagacagcttgtcacccaggctggtgtacagtggcccaataacagctcactacagcctcgaacccctagaggggatcctctcacttcagcctcccaagtagataggactacaggcacatgccaccgcatctggctaatttttatttttcattttttgtagagacggggtcttactatgttgctcaggctggccttgaatttctggcctaaagtgatcctcctgccttggcctccccaagttctgggattatagacatgagctgcacccagcccatttcttatttgacaatgcttcctatgcagatttrgcatatcaaataagcttaattaatttaatatgtctcgttataaagagagagagtaaattttttgagatagtcaaggggcttatctgaaaaatcccgaagtgaattctaggtttaaaagaatttgatttagggcgttgttaaaaatgccaaaatctttaagtcacttgaatccataggatcacagatcactgtgaaataatagtcattcaattaaccagaatgagaattaaaagacttcaaaggtgggccgggcacgatggctcacgcctataatcccagcactttgggaggccgaggtgggcggatcacgaggtcaggagattgagaccatcctggctaacacatctctaccacaaaaaattagccgggcgtggcggcgggcgcctacagtcccagctactcgggaggctgaggcaggagaacggcrtgaacccaggaggcggagcttgcagtgagccaagatcacgccactgcactccagcctgggcgacagagcgagactcctactcaaaaaaaaaaagacttcaaagcaaatacagaaagttacatagttgcaggaaacaacaacaacaacaacaactttgctcttttaatacaaaggactcagttgtcttaagtaatcaaagacctaataatagaaaacataaagcacagaaaattattttgataagacacaaaatctttgttttctagtcagagccctctaaaggtaaaactctttcagtgtctcttatcaagagcagatttaatgttccaagaacactttgcttttttaacagagagaaaaacagcttctagttttacactaataacttgttgatagtaagactcatttttaaaacccgtataatacatttattcaattttagccagcttcagcacaaaagatagtctctctctctttgacccctcttctcttcccccacataactttctatatcctttcagttttctccttcattttccttttttattctaaaataaccattcytttcactttagtacagaattaattactctttttcctttaacaaaacagatcctcataccttataactttccttaccaaaagcacatcttattttccttgtatactttgcactcagagttgtttcccttattatttctagtagttttaattatatatgttaatccaaatttttaactcgaagtaactttaatttctagaaacatgtgcttcctcatagtataattttttaatgtgacacatgtttaacagacccaaatatcttcagcttctctatactatatgaaaacaaaatgccaaaagtatacaaacttaaacttatgcttagtaattagtgcatcagtattttatcttatttggaaatgatctagatattgaataagtatctattttttaacttaacttagcaaaacttaagggtgtaagttaccaaagagatttacaaaactgtttttaagtagatatattataaaacrtaattattgtttgaaagcatattcataaattcttaccccacttacacctatttaattcacttattcttcacaattgtgcttggattacccgtgaaattttcagggacctcagacaaagctaagcatcatttcaagttatttcyccattaagtattttcactgcacatgcatgttaggcagacgtcaccaaaacaacaacttaaaagttaaatacatcggatttttgttattattaaactaacaatattaaagtagtcttatctaccaaaggtttatccaagtcatgtgaacttgaaaagcatttgggttagttcctatacttctggcagttttagggataatttatataagcactcatttttctttaagccaattaaatagagctcttttacgtattaattttggcaatgccatccagagttaggaaaatatcacatatgctaacatacatacaaagacatatatagacatgtagacagtagcagatcttatcgctttcattctaaaacttcagccatgttccaggtactataatacaaaactcactagtttataaaagaataagcagaatccaaattgtttctgacaaatgggacaagccagggttacctactcagatggccaaacctttctaccactatttttggaaaagacttagatttttttatttgcccaacttccaaatagcttttttttccttctgatwatcatctccctgaagttcgcatttcaaaagggatggttctcaggtaagacagggtagaacatttatatctcaaaggtacagaaaaagaatgtaagtttcaatccaagaagsagccttggggcacatttttctatcatcagagctcaatcctgtggaggctgttgactaaattttaagtgccagtatatttccaattaacctttgtagtctcggatatatgctttggsggaatcctgagatccatgagagcaggactccaaagctcaagtgactgaraggctagagtgggagggaaaaggtccgtcaaagaaggacagagggacggaggaggcagaggctggaaggagrcatatcaacaatgtaagggaactgatggaagatttaaggcaacaaaagaaaaaaggagaaacagaagcaatgagaaggaagaagccaacttggggagatcttaagttcttaaagaagctaatgaagttccatattacccttaacaaaatttatgccartgagaaagaaacctkaaagtggcggcagaacctacagttagcaagggtttgagaagggcttcccatggaggaattcctatgggaggagcaggatcaaatggagagaacagagtggactttaaaaagttgctcctatcaggctatgaatatcagaaaccaaacttttttaaccgaaggtattatctactaagcaactcaggatcaaaaccaataaacctttyatggcttaaccacagatacactagtcatctccagaggtgcaaagatactgcctccatgatttcaaagttcactttcagagatagccaaaaaaaatcaaagatctttgttgccacaggcggttaaggatagtgtttgtgcaaaaatgtgtcccagagaacgtgggatgcctccaatcacagccctgctaatttgaaataccatgcatgcattttactgggatagattttccctgcactaaccaaaagcaaagaaggttgagacgatgaragccccctgtggactgggatctattattaagacaaactcccctgagagttggcacaaagaacacttagtttctcagattcccaacccgactagcttccagacacaagttgacacctgcaaccccaccccaacaccagcaaggaccagagaaaatatttttaccagtcataaagccaagctctcaggacataaacaagacaaacaggaaaacgatggttgtccattgaatgaaaatgatcaataacaagtgggtaccccaagatagagaatcacatttcaaactaaatcatacaaatgttttcctgcagctaaaatgaatttggaaaggaagggacaaggagaaatttttactttgctctcttaaatgggcactatagatagagatcaggaagagctgactttgatgtaaattcttacccttttgcctgcttctgccatttccccaggatcccatctgtgggctctgaagcaagtgaatgtcccagaaaaatcccacatcctcgtcaccagaaattcagsgaaaggaataagaacctccctaggttcttagttggaacagacccattacaaaagacaggttaacaagagagaaacaaacagaagtttgttaacaggtttatttcacatatacatgggagacacccagggaatgagtagctgagtagctctcaaagatgtggctttgaatttcagcttatatcgcagatttaacaaagaaaagtaaatttttagagaagtgacatgacaaaggaaaaggactgggactctctagggacagcaacttgggaaagacaaccaacaaaaaaatggttaagtaagtaaagcttgttaactgtagattcctccagcattgcccccaggactatacgtgtttaaagctgccgtcagtggttgttgttcttggtagagcaggggcaagataccttttgtctttgtaaatcttcgttctgcttgtaggcaagtagagggagggtagagagttttcctgtatctatttattcttaattgccttcagctcaacaattctttatattttggagtggcatattctggtcccccacacaataatagtctataattccttgcctctgaaatttayttcagccccatattcaaactctcagagaagttctgtctcattttaaataaagatgcatcattcacttcagtcttgaaactaccctcttttaaatcacacagtgaggatttacacatttttaagaattctgtaacttagaaatcagctaatgatatttgctcttaagaatgagaaagaaacaattttctttgaaatgtgtgttaaacrtgaaagaaaagaaaatgtaagtaaggaagaatgtttagtgcttgcccagatttttcctacttttattaggtagtccaaagtccacaatgtgttaaggtgtatgggaaaatgtcaagtataccaagaaaacatttaattagatcatagacaataaccagcaagaaacagtttccctcttcatcacttctctttgaggatataactaaaacaggaagaaaacagaaataagttcatagcacctagttgcccctgcccagcatgtcttcacctggaaagaacagagagaattgagccaaagagaggtaagaaatagtaagaaagcatccagtcccattaactatggtcacagcttctaggcccagctggactgtgcagggaactgttttcctgggagactggcagcgcttgcagatgtcagaaggaacaagtgccaaggaactttaaagaaatcaagttacctccattcaagaaaagcctcctactcagtaattgctgcccttttaataggccaactgctgttgccttccagcttgccacatctcaacctcaactcctcagatcgtgcttcagggctctttttttgccctgggtaccgttgttccacttcatctcacaaatccgtagctgcctccaaggccaccaacctctgctttgcacagttccagagaagaatctattgcagcaagcaatgtgttcatgctggcatttaagtgcctcagtgtctctggtattgtcctgttatttaatgccttaataggttcttacagatgctgctggagccattcaaaagccatggacaatgtctaagctaaactttctacatatatacctttctccctgatttgtgtctccatctgtgtccacaatcatactgaagttcatgtaagccatagctggatttggaaacagataatcatgtcagtaaaccagtggaccagtgattctcaatagggagaataggatttagccctgagggaacatttggcaatgtctgaaggcattattggatatcacagtgatatcacaatgatatggtttggctgtgtcccctctgagaagagggctaccatcttccagttaaattggactttaactagaagtccaattaaacctctttttgttcctagtttcaggtatgtctttattggcagcatgaaaatgaactaatatggtaaattggtaccagtagggtggggcattgcygaaaagawaccccaaaatgtgaaagcgactttggaactgggtaacaggcagagaggttggaacagtttggagggctcagaagaagataggaaaatgtggaagagtttggaamctcctagagacttgttgaatggctttgacaaacatgctgatagtgatatgaacaataaggttcaggctgaggtggtctcagatggagatgaggaacttgttaggaactgaagcaaaagtgactctttttatgttttaccaaagagactagcagcattttgctcctgtcctagagatttgtggaattttgaacttgagagagatgatttagtgtatctggtgaagaaatttttaagcagcaaagcattcaaaaggtgacttgggtgctgttaaaagcattccattttaaaagggaaacagagcacaaaagttcagaaaatttgcagcctgaagatgcagtagaaaacaaaaacccatttttgaagagaaattcaagtcagctgcagaaatttgcatatgtagcaagaagcctaacgttaatccccaaggccatggggaaaatgtctccaggccatgtcacagaccttcacagcagcccctcccattacaggcccagaagcccaggaggaaaaagtggttttgtgggccgggcccagggtccctgtgctgtgtgcagcctagggacttggtgccctgtgtcccagctgctccagtcatggctgaaaggggccaacatagagcttgggctgtagcttcagagggtggaagcctcaagcctggcagcttctgtgtggtgttaagcctgtgggtgtgcagaagtcaagagctgaggtttcggaacctccgcctagatttcagaagatgtattgaaatgcctggatgcccaggccaaagtttgcttcaggggtggagccctcatggagaacctctgctagggcagtgctgaagagaaatgtggggtcagagcccccacacagaatccctactgaggcactgcctaggggagctgtgagaagagggctgccatcctccagaccccagaagggtagatccactgacaggttgcaccgtgagcctggaaaagccacagacactcaaagccaacccatgaaaacagccaggagggaggctgtaccctgcaaagccacaggggtggggctgcccaagaccataggaacccacctcttgcattagtgtgacctggatgtgagacatagagtcaaaggagatcattttggagctttaaaatttgactgcccaactggattttggacttgcatgggccctgtaacccctttgttttggccaatttctcccatttggaacaggagtatttaccmaatacctgtacccacattgtatctaggaagtaactaacttgcttttgattttacaggctcataggtggaaggaacttgccttgtctcaggtgagactttggactgtggactttttggttaatgctgaaataagactttgggggattgttaggaaggcatggttggttttgaaatgtgaggacatgagatttggaggggccggggtggaatgatagggtttggctgtgtccccacccaaacctcartttgaatcgtatctcccagaattcccacatgttgtgggagggacccaggggtaggtaattgaatcatggggaccgatctttcccaggctattcccatgatagtgaataagtctcacgagatctgatgggtttatcaggggtttctgcttttgcttcttcctcatttttctcttgcctctgccacgtaagaagtacctttcacctcctgccatgattatgaggcctccccagccttgtggaactgtaagtccaattaaacctctttctgttcccagtttctggtatgtctttatcatcagcatgaaaatgaactaatacatacaacttgagcaggtggttgggttgtgctattggcatctaactggcctagtccaagaatgctccaaaatatcctacaatgcacagggcagtccccaacaacaaagaatgatccagcccaaaatgtcaacagtgctaagattgagaaaccctgtagtaatctaacaaaatattacttattcagtaattatgatctcatttctcatgtcatacattcttggtgaatagaattgcagcacctaacttcaaagatttatcaatgaaaagaaccagaatatgagsctgttctgcatacctgccatgmatacatttaaagcatatacagagttcagcagtatcagagaaacaaaatgtcaaaaacattgtctaatcatttttttgtttgtttgtttgttttgagacagagtctctctctgtcacccaggctggagtgcagtggcgcaatctcggctcactgcaacctctgcctcccaggttcaagcgattctcctgcctcagcctcctgagtagctgggattatgggcgcccaccaccatgcccrgctaattttcatatttttagtagatatggggtatcaccatgttggctaggctggtctcaaactcctgacctcaggtgatccacccacctcggcctcccaaagtgytgggattacaggcgtgagccacmacgcctggcctgactcatattttgtttaatttccaaaatacatgtaagctgttgatatgcataaatcattaacaattcatttcataaatgcataaaagagtaaagtcactaacagttgctatccatctgtctcsagagtggtttctyagcctcactaaaacctttccttcattgaacatcatatccctcactgtaactagggagaatgtatgaagtccctctttcacatcaggagatctgagctacacacctgaccctgtgtggccagaatggacaatattctggatcatcctggtatcatttatgatgctcctacactgaaggattgatttttgtgaatatttattagaaaaaaaatgctaagaggaaatacgagcaaacaaatagtttcaaaaatgggtataatgcaggagtgagcaagtggagaaggaagaagactgggagcacaaagaragggagaggcatttttttaatcctttttttaatgcttgtgcaagagatgttgggggtaattgcttcarctgtgttcttcacactgcctctgaagccctgccatggccaacaatttgtgacttggtccgtatttctcttgatcaacctgtcactctgtcagttaaaatttgccatcaaatacaacttttaccaactgctacccttatgcccattggacttacaccagctatacttcccaacattttacactctgaactaaattgtgtgtgaaaattaccttttattgactttagtgagtgccttatacaaacaactgagggctgatttcaactgcccactgccaaaatagccctctgtcccatctgttggatgcacataccattaagacttttattagcctcagaaatagagaactcattttatggtgttagctaaaaaacctgcaaaagtccttgaaatgcagcactactagtccctggtaaccactgtgagcaaatgatgttaaaaaaaccaggttggcatcaatattaaaagataaaaccgcctccaaacgagagcaccaaaacgtaattttatgtctgtaaattcatactttacattggactactcaaggaaaatatacctattgcccttccaagaaatgaagagttttaaaaatacaggtgttgaaaagaataagaaaatgtcttattctatttatactgatttggtaagaaaaatgacacaaaatttcagttagaaaaaaataagtttgagagatctgttgtacatcatgatgattacagttaataacaatatattgaatatttgaaaattgttaagaatacatttttaatgttttcatcaccaaaaaaaagactagtatgtgaggtaatgcctgtgttaaacatcttagccattccacaatgtacatactatatcaaaacaagtaatacaccataaatatatttaatttttacttgtaaagttatttctaatttacaaataaaaattacataaaagaaataaagggaaatttcctcagaagcactaagaaaatataaattcttaatgaaaccactggggaataaagacatggcataacagttaccatcagaagaaatcaagaactttcttagaaaagtagtaagaggtttaaccattaggggcccagggagaagtaatgatcttttaccagaagaagagaataaaatcatggaagcctaatatggctttttacagttctgcttacaattacgcattaaacaatttaccccttgcagatgagttcctaaagcctgctgagatgttgcactcggagaaaatagtacatgctgttttttcttctgttgtggtttatttttattaaaacaaaaaacttacaacaactaaaaaaaaaattcacttttgctgaattttactctttccaagaagaccaacagcttggatgaacatttgtccaatgtttgtagtaaatctgaccataaaagacaatggcttagacattcatgcccagtcaatgtcctatgggctggaattcataaaataaaggcagcagatggcatacctaaatttaatttgctatttgatttatccttgtgttaccactctgaaatgcagataccgaatgtttatctaataacgctgttagaaaacacaagaccatgcttcaagcaagtttatcatggaatctgatgctagaccatcagtcctgagaatgaaaactgtagcccatccacagaggcactctcctytgactaagtaggacctgtcaacagccaatactccatggatcagggaaagcatttcatgtggtttagaatcactcttctggctgtaatgcaataccggagaccatcaagaggaagaatacgcctttgattcttttattcccatttgaaattcgaggggatatttttgtgtgcttgggtttatctcctattgttcactgagaaaactgatgctttgtttaattgttgtgatcacttttccttgtgagttctcttgaacgttatgctactgtctgattgtcygttggcatgtatacatcacaccaatattctggaacaccacatastaaaatgaaaactttttgagtctgtgttactgcgctggcagctgtcaaaataattcttgctgacatcatgttgaacagacttgcctccgagtcagatcaacgttggggagcatcatgcagtgcggcaaaattaggtcattaattgtgaagccagcacaacccttcttgcatttggagatcaaaattctgacataaaagaaaattgaacaatcaaaaactctggaatcatcttttaaatctcaaaacaagttgtcaatttagccatttaattctcagagttctttggaaggatttttattacataaaagtatggtaatataatacctagttttccaaaggaactatgaaatatcccaacatgaaaatatttcactcttaaagggtaaaaatccatgtctaacatccattacactgatcatatttctgagcactcaaatgccaactttttcaaatgactccaggagaacttattgtcaacctgtttctctcaagtatcaccatgctgattataggtttgcttataaaattaccttttggtaatatagtaggaagaaactagagtctcaatgattaagaatcggaaacagaaaaaaaaaaaaagaaagaaagaaaccaatctggtggttagaactggattgccaaatgacagcatcaccggcattatctgtgtgcctggggcttgcccttccaaactaatttttaaaataaattgaaattgaactggagccatgcaaagtagaacaaagacctttttgaagattcatatcaggtaaacagtaaacaggttgtcagaaaatattgacatttgaattgactttatgcttttatttcctacccaatatggcattttatattattaacatttatttattaaaaccctgccctttcctcaaaaggttttaaagagctttaatgttctgttacagtattttaagaataaaaatagtttcctcttaccttataaactggaataaaacaaatatttctcatatttgaattaaaagtagaaatgtacctcttcttataagtttgtttccaagaaatattaatatgaaaatataacatgtaatttatttaataattcaaaatacctaggaatttttttctaaaatttattacctgttacatgaatcaaagatcagactcttaagatggcctatgagaattaacaaagataaatgtaggaacaaaaacaggttgatttatttggcagcattccagtttacctcccgactcttctgtcctgattaattgccctcagcgaggagctggagcctagttatgctgttttcttaattcctgttgatggagtgttgatataagaatagaaagagaaccaactgccttttaactagtccattcttcatgcactaatcaatcataacttgtccattttaattatctcccaaattccaaatagagatacgcttggagtttccaaatatttgcatgattaaatatgttttccttatttcaataaggaacctcaaattgatgactcaggtggtaagatttatggaatgaagcaattgtgtttatctcccagctttcaaaatactggtctgcaattcagtaacaaacaacattcccaccagagatgtgcagactatgcccattaatgatgatgatcatgtttggaaataaaaataaaaccatataccaacattagtagatgccaaaaaggaaacccagccaagaaaatgtttactagcctctcttttcataaccataaaaagacagtttattcaaatattaagtataattatacaaaactaactggccataggtgcacctgtacaacattttcgggttgtttttgccctcctcggagaaataccagcagatcaggtcatcaatcagttatacccatcaagttacagggtaattctggctgcctcacaaacaactggacagttcagttaagaaaggtgcataaaaggagaatttttactgaactgactgaatgaatcagttgttttgattggatgcaaacaaacaaaagctaactcttttctgaaataactccccatttaggagcttgcctcttctataatataaaatcctattgcctttttaacatcagaattgaagcaacaaagttctatttkcatagtaagtggtctaggaattgatgacagaatatgatgatgaaaagaaggaggaggaggaaataatgacaataataatatgagaggaaaaataatttttcctctttcaattgggatggatccctgtaacaaaagatagattaacaagagaaaaacaagcagaagtttattaacatgtatacgtcatgtatacatgggagctacccaaagcaaaatgagcaaatatcaagaatatacatctaagaaggtagagtaaataccatcatccactgaaacagagagaggtttactatgcaggtttcagtcaatattctctattaataatacttcctagtgatttagagtcatccttctcttcctggaacaaagcggagatactcatacaaaaggaacattttttaaaagatgtaacttttttacaaatggtaacttctactctatttttaaagtttctcctgtgtctctcgtttcccgtaataatcaactcaaaataatccttaagcttaagaggcatattttgaggtggcatattttgttcttctaaagtcatattttggagtagcattttctgaacttcatcaatgataatgataaaatgcaggatttcttttttcaattctagattctgagtgtacatgtgcaggtttgttacacaggtgtagagcatgatgctgaggtttgggcttctgatgatcttgtcactcaagtagtgaacatagtacccaataggtaacttttcaaccgttgtccccctctacctttccctttttggagtcctcagtgtttattgttcccatctttgtgcccatgtgtacccaatgtttagctcccacttgtaagtgccaacatgcagtatttggctttctgttactgcattaattcacttagaataatgacctacagttgcaaagaaatttgctgcaaaagacataatttcattcttttttatggctgtgtagtattgcgtggtgtgtatatacaacattttctttatccaatccaccactgatggacacttgggttgagctcatgattttgctattctgaatagtgctgcaacacacatacaaatgcaggtgtctttcattagaatgatttatttccctttgggtatatccccagtaaggggattgctgggtcaaatggtagttctatttttagttcttcaggaaatctccaaactgctttccacaagggctgaattagtttgtattcccaccaacagtgtataagcatccctttttctctacaacatccccaacatctgtcatttcttgactttttaacagtagtcattcagacttgtgtgagatggtatcttattgtgattttaatttgcaaatgatgcaggatttctgaaagaataattttcagataaaaatgttcctagttgtttatagacaaattaaatttaacagagtttaattgagcaaagaacaattcataaatcgggcagtctcctgagccagagtaggctcagagactccagcgcagccacatggtagatttatggacagaaaaagaaaagtggcatatagaaaatggaggtgaggtacagaaacagccagactggttacagctcagcatttaccctatttgaacatggtttgaacagttagccccctttgattggccaaaactcagttattggcacaagtgtaggttacatctgtatacaactctgtttagtttgtacttcagtatrtacagggaaacctgtaggccaaacttaaaatatgtaagtagtcagctttaggcttaacttgatttagcatactcaatatctaacagacacaaatacatgtacaaagtacttgaacttctccaggtaattagaactgtttcctctgacttaacaggaattactcattctctgatttctctctcttccctggtatcatctggccattttaacagagaggaagacagccttctgtttactccttactcatcagttctaggtagcactcaggttgagagaatggtttttccagaatcatcgtttggcccagttgttaaactcacacctcaaragaaaaaaaaagcgtcaagagaactactcctttagtttttgtgcctgttcgcctgcctggcactataggtctcaaagaacacaattaagcccttttcatcactgaataccccataacacttagctcaagaacgttaacattgaaatcacaataaattcttcggttttgaacaaaagagaccatgaatccacagggccagatgttttaagtttacgtaattgtaattatgtactctgtctaaagatcccaaaatgtattctcaaaataactggtctgaattgatgcttttgaagaaaatattccacagtcaaatgcactgaaatcacaggagtggtcgtaagtcttctaattttagctggacttggttatcccaaccctctactgtgagacatgcttgggaaatagctgtatggcagagtccccttttgatgatttgtaatgcatattaaagactccaagaaaycttacactaaaggagcttgtttgttttagtttaaagcaaacatatttgacctcagaacccttttctacttaatattatggaatgcttggggaaatccttttccagaaattgagacatcacatgggataaattatcacaccatggacagtttggagagtctccaaaatctcacactgttacatgaaacacaaacagacacaaaggtgccactttccttattaatcaccaaagctttaagtaaaaaagaaatttaaaacatgtacgtgagacggaaagcagaaatttcaaaatctacggaaaaattattgtgtgcctgtagaggccaaggaaaaactttccctttgccctccgaagtttcgctgaaaaatcaactcacaaaatgcagattacctggagaaaagataaacaaatgtattaatgtgcacacagggaagaactacagactgattactctccaccttccaatggggttcagaaggtcaaatgccatctcgaggttacagaaagaatgagggcttggactatgacaaaacaggttatgggaggggaagaagaagaggcaaggctagcaaaagtggccttgttatgcagatgaaacctcacaggtagcagccctcagagggaagagatagtaaatgtttttttcagacctttaaaggggtcagactcttcaattaatctttcctagatctagatagatgagagaaggaagtcctcatagaaaaactggctgcatcaatgtggattctccacagatgcaaacctcccccatgaaagactttgcagggctacttctgtttgcaggccttctgaacagacaactcaaaatatgtcaaagaagtatatttgggggaaagatattttgatttccctcacacctaaaaaaaaaaatttaattactaactgaaaatcttaattgccctccacttggaaccacagtgtatggattgagataaactytccagtgtgtttacagttccaattacagcacaccacaagccatccacaaataattatgtcctcctttagtggatattggtcactctttttagctgtccagatctgaaccccacaccctaagactggggaaggctctagctaaggagccataggaggcagacacttcctaccatcaaagttaaagtcagactctcactttcccagcctcctagtagcaagggcactaacctatgactttggaagctggtgacaaatggaagtgaggattgctcaagatctcttctggaaagggtggcaacagcagcagcagtagtagctgcattaagtattttgtatggagtttatgccagagttctagggatgatcccgttaccctggcctggcaaaccagcacatcccaccatcctgaccacaagaactggtttcagagagagaggcacatgtctcaagttggtccactgagaatcaatctaaatatttggtttagaatttgggggaaaagaccgggcgcggtggctcacgcctgtaatcccagcactttgggaggccgaggcaggcggatcacaaagtcaggagctcgagaccatcctggctaacacagtgaaaccccatctctactaaaactacaaaaaaaaaaaaaaaaaaagtagccgggtgtggtggcaggcrcctgtagtccccgctactcgggaggctgaggcaagaaaatggcatgaacccaggaggtggagcttgcagtaagcagagattgtgccactgcactccagcctgggcagcagagcaagacttggtctcaaaaaaaaaaaaaaaaaaagtggaatttgggggaaaaagaaattatcttttcaatagggttaccaatccactaggatgcaaaactgtacttattagtggccatcctgtaactacatgacacaggtgaccaaaaatagaggcctaggcttaacaaacattgtaactgcccaatgggttcattttgctcactgcccagatagagtcaatttatcaagacagaggaattgcaatagagaaagagtttaattcacccagagctggctgaatgggagaccagagttttactattactcaaatcaatctccctgaaaatttggagactggatgttttttttaaggataatttgttgggtaggggggtcaggaagcagagagtgctgattggtcgggtcagagatgaaatcatagggagtcaaaactattttcctatgctgaatcaattcctggagagggccacagaatcagatgagccagtttattgatctgggtggcactagctgatccattgattacacggtctgaaaaatatcttaagcaacaatcttaggttttacaatagtcatattatccccagtagcaattgaagtggtttagaatcttgtggcctctagctgtttggttcctaagccataatttctaatcttgtgacaaatttgttagtcctacaaaggcagtctggtccccaggcaaggagggggtttatttcgggaaagggatattatcatatttgtttcaaatttcaattataaactaaagttaattcaccccacactcaggaatcaggaataaacaagaacagcttggaggtcagatgcaaaatggagttggttaggtcagattttttttcactgtcataattttcttgctggtataatttttgcaaaggcagtttcaatatcaccaactaaacctgtgatgtcaacactattgctaaacgttktagttatattaataacaagttctgtcatttagctagtttacttttagttttggttgcaaacaaggggaaattagggatrggaagtgaagaaagaacccaaattggggttgatggatttcaaaagttgaagctagaaagacattaacaaaagccaaatccaaaaggcaaggtcagtggggaggaaaatacacaaagcagaacagtgagcaatgaggttagaatctggaagaatcagcaacagaataaaatgtggtgtacaaagcagattacattaggataatttagaacaaatccatgaataataagcaaatgttgtgatgtatcatttttgtggtacccaaagcataatataaaaaagacatcccatgtgtccatgaccacaccaccctgaatgcacccagtcaactgatctcgggaaaaaacattttatatgtacaccactcaatcattaattctgaaaatacagaagattctaagacactaaaaggaaactgtcaattctaagaatatacacatgggtcagagtaagatgattttatgacttcagataagtttataatttttatttatgtaaattttcataaccaaaagggaattctggaaggtatgtttgctattaacctaagggaagaataaaatttgaccttcctaggaaagcaatatttgtcttaatatttttctccctataatgttactattgaacaatgtcaaaataatttgactttcttgtgaaaatgtcatattgtcattatttctatatccttccactcaacaaagtaccttgtgcttgctaaaaaacaaattaaaatgaatgagacagtttgatatctcaaggagcttgtaatctcagggaaaggagaaggcttcacaaatattcaactagaatacaaaaataaataaacratatgaagaaataaaagcaaaacactatgagactatatagaaaaggaaataattaacacccacaaaagaagcagacttgtcaaagtcaatgaattgcctaaattttcaactttttaatcagttgtgttgatagagtatcaatatatagaccatttatatcctttatatccagaaggttatgtaagtgggctttaatttgtttaataaaaacattcagaacatcaacaaaacagctgtaactttttttttttttttgcaattacagtgtggtattcagttaactaaacaacaattattttttataaactgcatcagagacaactgaagatgaaaaaactaccatcctcatatacaactaatttgggctgtgcactgacaagaacctactttaaatttccacacccatttacaaccccagtactgtagcaggcaacgttagtgtcttattgaaaataccaccaggacaggacaatcagaagatacatttagtagtgtgttaaccataccgaaaaagatagtatacagtttaaaaacttatcttaggcagccttacctttcaattttttctttaaaaggagtgagggtttacaggggatttaaatgctttatagactaggggaacaacttgtactagagccaacttatttatcattatcttcttcatcttcaatttttcatctttctcctcctcatctttttcatcttcttcatcttcctcttccttctttttcttgcttttttcagacttaatgacccctttttttgctacatcaggctttccttagcccagagtgcaacaatatccttttcatattattctttcagcttcacggccttcttttcgtaagtctgcttgtcatctgcagcagtgttatttcctatctctccgagtttctttacaacatcactgatggataggccgagatgttctgctttgatttgggggcaaaatcaggaaaaaggctgaaagtggcctcttgggcacattaggatccttgaactttttttccccctcttaggaaggatataggttttcatttccttttcacaacaggccctgtctgccgttgccatgtattgaaattttcctttctctttagcagagagggtcttccacttctctgagtgcttcttagamaactctgagaaatcgactgaagcatctgtgtgctcctcctggcaaatttgcacaaagaatgcatatgatgacattttgtctcttggcttctgaggttttcctttgcctatgtttggttatttttcctcagtgaggcatggagtcatctagtgcctgaccagctctcacttgttctagcactttctctatggatctcaaattatggtaatggctctttaacttttaaaaaaaatttgttgtacgcagattattgcctcaggtgaagtggaacagtcaatactgaaacttaaggaaaaagttgcctgtctgtctaaggcagacattgatggttaactattgttaacaatattractattgcacagaatctaccatggcctgcaaggaggaagtctaaggtaattctaccatccatgacaaccctggccagtgagttggggccgcccttaatgcctcccarggctaacgtggtgtttagtgcattttgtgtgtgtgtatgacttaggatccaatctaggatgtctctttagtcttctttaatctggactagttcttcagcctttatccttcataatattgacatttctagagggtaaatgtcagtttttgtgaaggatgtccctcattttggtttgtctccttgtttctcatgagaaacaaattatcttaaaggttaaagagccattaccatacattgagatccatagagaaagtgctagaacatgtgagaaaagccttttcaacaaataatagtggatctactgaatatccatattttaaaaatgaatgattcatatcttacactaaagactcatatcttacataaagaccccaaactacaaatctcttataagaaaaaaaataagtgaatgtgtttgagaccttgagataggaaaaattcctttgaaaaaatgtaaagacactaattataaaagaaaaatgttggtaaacaaactttatcaaaattaaaaacatctgttcatcaaaacatamcattaagaaaataaaaatgcaagccacatactgggaaaaatatttggaacatatatttctaacacaggtcttgtatccatgctatataaagaacggctacaacacaagaattaaaagacaaccaatttctttaaaaaggcaaaagacttcaatagatgcttcacaaaagaagatttacaaatgatcaataaacacatgaaaagatgttcaccactactaatcatcagggaaatacaagttaaaattagaattagataccactttatactcattagaaacaccaaaattaaatactaaaaataacaaggtgttggagagaacataaagccactagatactgatggaagcttaaaatggtacaaaccactatggaaaaattgtttagcagaatcttattgtgttaaacctagatttacactattacttaacaattccactcacatgtccacccccttaaatgaaaacatatgccaagaaaagaacttgtacaaaaatatttattgcagccttattaacaataacacaaaattggaaacaatataaatatatatcaacagtaaatagctaaacaaattatgacatatccatacaatggaatatcacttattaataaaaaggaataaaccaataataccaacaaagccgagcacagtggctcatgcctgtaatcccagcactctgggaggccaaggcaggcagatcgcttgatgccaggagttcaaggccagcctggccaacacrgcgaaactgcacctctactaaaaatacaaaaattagccaagcatgatggtgcatttcagtaatcccagctactcaggagtctgaggcacaagaatcacttgaacccaggaggtagaggttgcagtgagctgagatcacacgccactgtactcccacctgagtgacagagcgagactctgtctcaaaaataatatcaatagtaataatggtaatacaaacaaaaatactgataaatctcaaaaacattatcttgaatgaaagaagccagaaacaaaggaatatatattgtataatctcatttacattaagtttaatacaggcaaaattaatgtataaagccagaaatcagagtaacatttgcctgagaggagtacagaagtagactggaaaagtgctcaagggaacttgttagggtgatgaaaatgtgctatatcttgtttgggatgtttattacatgggtttacacatttgtcaaaactcatcaaactttacactaaaatctgtagaacttattgtatgtaattctcaattcaaaacagaaaaaaatacaaaatagattttatttaaatctaatttactctcagactattcaagttctgatccaaattaaataagttgaatttgagagtatttactctatttccacaggtgttgagagagataccctctcagactttacacagctaccaaggcaacaatgccaggaaaactattaatcaagatatgatagttcctgtttgcaatcaggagaagaaagcaaagaacactcaggattataaaagyagatgagacctacccactagacctggtcagacacaatgttggcrctcttggttctggtgactgtggccctggcatctgctcatcatggtggtgagcactttgaagggtaagtaagccatctttarggagcaagtccttcttccttgctagcccccaaatttggacacattactcatttccaattctctgtgcttctattatctcattattcagcgagaaggtgttccgtgttaacgttgaagatgaaaatcacattaacataatccgcgagttggccagcacgacccaggtaagtaacaattttgatttacttcacatctaatttaaaatcttagatcgcactgtgattccgacaatggaaaaaaaaacatgaaatattaactatagcattttggtagcaagaaataaaaacttggaaarcatttrgtgccataatgtcttcttyttctgcctaaattagattgccataagccctgtagtattataaatccatrgtaacttttaaaagagctgacagtgtgacaactggatgagttgcaactgtcacgaaggtcacagaacatctaatgtacagtcactttccttctaaggcaaaagagaaaaatgatcaacttggatattactgaaaaactgggcttttgtccaacttcaaattcatttccacatcccatgtatcatctgtcctctttgattttctttcattccaaatcaaacagcttgggttttcatgaccttgattcaggtccccttaatgatatgacgtgagggggaaaaagagggtaaaaagccatgagtgattttcatacttttcttttgctttcaaaaaactgacatctctgtgctaattttttaatccactatatatgaggtgagaactgacattttaaactgcgtatacaatgtggcaggaagctattgctgaccacaaatacagtagttccacttgggccaatgccgtttcttcataaatatataaactaaaataatctgctagcttatacacacacacacacatatacatacataaacatatatagtcattttgtagcttttaaggcatagaggaaggaagaagaaggtggagagtgtcataatcacaggctcagaagttcagaattgaaagaaatataaactcatctattccagcaatccactcaaatctggaatttccttctgggaaacagcatccccagttactactcctggtaaaacctgtttgagtacttccaggaatagtttgtatactactttttggaatagcccacttgccttacaaatcattccaactgttttcttccttattctgagctgaaagcttccttctctaactttgacctgttgggcttagctgagtcaaatatcatgttacctctaagatttatctttttcaagctttccgtaatttttcttagcactggtatacagactcttgatcattctgctcagatctagatacagctcagtctttctgtctatatttctttttttaaatgtagttaccagaattgactatggacctccaggtgtgttctgattaatgtatactacagggccattgcttgccttcatttgtaaagcagacatttattaatggtgcctaagattctttttagcatcttaaacagtcatagaacactatgagcttatattaacctgtgttcagtcaaaaccattaggtaattttttttcctcacatgaatcaccctcaaacaggatgtccctccttttgtgcttacctaattgactttyttcacctaaatgtaggattttagatttacacttttaagatttatcttgacagcctgttttcagcatgttgagatcttttagaaaactaattcagtcatccagggcaataaytcttcccctaactttgtctctccaacaagtttgataatcatgtctttttgacttttatccttgtcactgataaaagaaaacattaaataggtcaggagtcacagaattagaggccttctttacgtttcactcattcagtacatatttatcatgaatctccaatgtgccagacatagtgttaagcactgaagagattcattaacctattctgcttgcataagtttactcaactacccaagctaggggggtgttacctaggggtaactctgcctggtgctttctggkttataaagaaagatatcaatgcagagacttcatcaaatgctttactaagatcaagattcracattctaccaggttagtgctctcatccaaaactaaggtgaatttaattgggcctgacttattcttgctttaaaccatactggctcccagagaccacagcttcctttcctcagcattcacaatccatctgcttccagttcactctgcagctttgccagaatccatgccaggccccagcagctcctgcttctgggcttcacctgttttcgtgtttataaaatctaaaacttgccccctctactcrccagtgagcccttcgagctctgattcttccaagattgctgagaaagttctgcaatcacatctgcagtatttttttagttatctaaaattcagcatttcatagtggtcaagagcagagagtctggacttagactgcctgggttcaattcctagcctttctacytgttagtcaaacttggacacctctctgggtctcaacttcctcatttgtaaaatgaagatgataatactatttacataggagattgttgtgagaggtaaatgaattaatataggtaaagcaattagaaagaacttaaatagtaagaattatatgtgtttgctgttactactatcattaggtctgggattttgaatacaatttatatggctagtataatcaatcacctatgtcctcatctaccttgggcctcaatgttctctttccaaagaaggtatttctgtttaaatcataacatgaaaaaatctttacttatccttgtggtaatttcatctctcagtagtaatagaataaacaaggaatagtgtaactctctcttggaaaagacagaagccaaaaaacagttaaatagggcttctttctttcctctggctgcaaacatcatgctttagctccaagcagtgggacacatatttcttctttattcttttattttcaacatgattgaaatgagattttcattctccttagcagttacgggaacagcatattctgggctgtagccttcctgataagatcattacaagggcatccagtctttgtattcatccttggccatgtgtccttcctctcagcttttgaacatgtccttttaaatgctgaatatattgggcagatccgtgaccacactgtactccagcagcccttcttttgtcatctataattgaatattaaggattttattttatctcctcacaatcagggttgtgcttgttcctttattgaaggcattcaccataaaacctattcacttttctctggactgtcttgaagtctgtgtttctcaaatttaaggtgcatttttctctatgcctggagtaacatggttactgtcttccaatgttcttatcattcctactgtaccagtaagttcctcactgctgtctggaattgggccttgagtagaagttgttttcttttccaacaaaaaaggaaaatttcaccaagataaatgaaaagtctatcagatgtttgacttacagtcaaatgcaatgtgaagaaacaaattcatgcaaatttttgaagaaaaaaagatccccaacaccaatatttatttttttattggccaatcttattcctggaaaaatttcaggttggcatgctactttatcttgcttttaggctagttttctgagatattttaggaaggattctttagttgttaggcagccggctgattaaattgatattcttataatgctatcatttaaagatatctcttgatcatccaataagtgttctatayggttctttgtcacatttataattttataacttcagttttctaacttcataatgtatagtttaattccctacatctacatcctatatttcactccatgtttatatttcagacatacatctcattcacaaggtcctggtaatttctgaaatttatatttatcaccttatgttattactttgactttattacctatattcatatttggtgcattggtaaacagctgtgaggctatagcattgctcctgatttccagccatgtttctcctaggaagtatcagagactaactccagtatagtgsgtctgtgtcacacatgcaacactccagagtgttgtatgtatgttgayaggtttgctaactggttttctccatgtcaaactgaaatttttaagcaacctcaggttagttctgtaagtttctgtcaaacatatttatgagatttatttgccccatcttaaagaatccataattcttgcactgaaatcttaaaagtaacactttctctaaatatatagactcttctaatatttggcagagctaggaccaatgggtaagagctgaggaggatacagatgacaattttcagtttaatattagaaagaaaaccatttataagcaattaagctgttctgaagtggcactagatatacacaaggttctgctagaaccaccaccaagaacatcatgcaagcatttratgctttgagtggaaagctagcatcttaatacaggctcttccaaagcagaccctgagacaaagattcaagggaaagaattttatctgggaagtgcagggagccctggtgaagaagtggggagtgctaaatagaagtaaaggcagccaacaaaggaaacagtgttaagccagctaccacagaggacaactggcggtaaacccacagggaaactctaggaatgtgtgcaaacaacacacttcagaattatcccacctgagaggtgaaggagttggagtaattcatcattcgcttttcaggattcttggttgaaccacaaagaataatttccttggtacygcctgtctacctggagctgataacttggcttttcccagttctacaggaaagagccctcaggtacagagaggcagatcttagcaaggggagtacactgagcacactaaaaggtcccagcaattatgtgccagcgggacactgtctggtcagctacagatacatggaggactttatgtgctttgccaattctcaaccttgtcgtctataataaagacatatctctctctcccaccacaccatagaatgacaggtgtttattaggaacacaaattcagagctaagtttcaaaaatatgctttctcttrtaatgtgcttatcttcaattgcccttctctccacaatgttggctaactagaagttgtcaccagccccttgctttctctgtccttaycttagcatgtctttatacttcctcacttcatttaacctctcatccttgactcactaggtcaccttctacagccaatccttatccaaacattgatactctatcctttcaatccctttgtgacaacctcactcatgcttttttcttctggaacaccagtatccctgcctcccattgccctgacattccttatgggcctgattcgtgactcaccacctctagatttctacagtggtttgaagcttaccaggacagaatataggttactgggagccccacaagtgtatctgaaactgagatgccttacagtattaccttgtcagtttctgctgcataacctctaagtctgcccaaactcccttccaagtttccaatcagtggtcctaaatatcaccatcagacatatctctagccccaaagcagtgcgcaaacatccgaacagagattggctgagacacagggagaaagaaagacccaatgtcaggctgacctcaracttctaggcttccactcggcacaagcaaggaagagaataacagacacctacaagacacagtatgttttagttaatatttttccactgaaaggtgttacttaaaaccacacatccacagattaaaaaaaaaaaaacagctatttggggcttcatcttctctaatgtctcccccataaagacaaaggccatgtttgatttgcccactaatgtattcctagtctcagacacagagcctagcatatcgtaggttctcacaatagttgatgagtaactgaataaatgaaaatgtcagtacatgactggatccccaagagcaatttgtctccrgccacagtgtcaatatacccattgtgaaaagatgccatttttcttcctgatgtatccaccacaggtcagggatcctcctggttccacatattactgtgacttccaagataaactcataaaataagtccattaaaaagtaaaacagcttcatatttctccattaaattttgtaattctagttaattcatcattcatctggcacatagatccattaccacatagcatctattccaacaagttagtgatccagaaaatcaataaatagaaaagaacagttacagaatacaaccaactagcattatgggaaatgattctatgttttttcatgttcattgataatcaatcaaggttatgtatatatttgttaacacttttatcaacatctaactgcttggttccaacccttgttcactcaaaggaaatattttcaacagatttcatggatgatttgattytgaaaataactcaattcagtagagcaataatgtgctcgcagattatccttcatccattgaattataggtatccaatatatcttgtcctttattcagattgacttctggaagccagattctgtcacacaaatcaaacctcacagtacagttgacttccgtgttaaagcagaagatactgtcactgtggagaatgttctaaagcagaatgaactacaatacaagtaagtttatgttttataaatattaaaattctctcccatgcatgctttcatctgagcctttgaataactctgggaaggaagaaatgagaccaagaccaatgccttccccaggaccccacaaataggtaayggcagagctggccctggattccaagtcttaagacttcagttctgatggattttgtgtttagttattgctctaattaaaatggtttttattcttgaccccaagtcttctgccagatatctgacttggtccattttacaagcaatgtatagagtacaggcctagccaatggatactctattctcagctagacatagttttaaccccaaatcttatcagctcttctttccaggggatcagcgagacctattgtgagttatgagggctatttgtgctttttttagcagaaggataagtctagagtcagtctgaatggcccttctgtccttttttctctaaagtcccaccactatctctaatggtaggagaaggcatggagagaaagacgcaaagaaaggactagagtagttggctaagctgatcctgtctccctcactgaataccactttcgttcatctaggtctttcatgacaagaatgtcttcctaagtaaaggcaattgtccatttgctgatccaacaaatcaatattgaatgtctacatgtatcaagttccaataaggacagatatgacctcacatcctttaggggaaaacagactttaaataaggaattgcagtrgtatttaayagatggaaagaagagtaaagtgctggagttcagaagaatagagcaagtctaggggtcagggagggctgtcctaggaaatgattcttcagctgagaactgaaagatgagtaggagttgattagccagaaaaagacaaggaaaaaccatactttaggaagagaacagaccatatgctgaggcttagaagtgggagagaccatgctaacccaggacacttgcataagagggaaggaggaaataaagtctctagtacaaagcagaggtcctcctccagggggtagattagggaggaacaaagacaaagtcttgggctccrgtcctgaacattcaaatgtttatccggcaatcccccatcacaagctcaagtcttcattatgttttggaagaatgtagcckatataattttaacagaaatttctcttgtttttcacgtcttaaaaatgtaaaagaatagtatctgtgccagtgaagatgtcagaattgtcacctataaaatctgtacctccatcaggagaagtgggtagcatagtgcaacaagtaaaggctttgggaaaaaaacagattagattctaatcctggctttgcacattgctgtgtgattgtgggtaatttgctcaacctttctgagcttcagctttcttatccataaaatgaagatacaatgcctctctcaaagggctgttgtaaaaataaaaatatatatataaataaattacaactggtattatattgctgagaatgctgctatggtttactgttgtacaaagaaggagattatacgtttttttttttaagagtcaacagtaactgctatgtttaaccccattatcatgcctcacaaagcttagctatgtgctttctgcctgaaggaagtgtcaaaatgtgaccttaagaattgactgtctttttaaaacaaagatataacctggtaagtctcaaaatgtgattaagattcatgtctataacattttgctctttttattatactgaaaaggacagctaaaattctagtccttggagccttcagtagcattcaaaaagatgagtttctttgtaattctttaagaaaaacaaagatcagcgaccatagattaaccctagctacctgaatgatgtcttaattctacccttatcacaaaacagtaaaatggtttctgatagaatttcaayctctatttataatcagatagaaagttcactttcttttttagtggtgaactttttrggaattgtgtatgaatgttgtctcatctagaacataggacatcccctgagggctaagagcttgttaatttttgcttcgctgttcactgcttagcacatttgtagcatataattttctaaatattaaataataataagtccctggaaatcctggagaagcataccagcaayatccttgctggggttgcaagcagtccctgtgcatcccattattacctcatatggtaactagtatttagacgatttcctgctggcaaaaatttgcagtagtgtttgtatrtaacaagagccatccactgcacacaagttctaccaaaataacttttcagattttttcagtgtttccaaccctcttcaccaagacctgtatyatttggcagctttaatcagatcctgaattatcataggaaaaaaatcaaaatgtgtgcaaaaagaaagataactgtaattttcaatgacaaagtttcactcttagtaacagaaagactaggaatcagatagtgtaaatctccaacttatggttatgaagctaagttgacagaacctttaggtggcctgccctccatggaattccttgctacagactgtagaaagattgctttgccctacttgattcagggagactgattgttgctcacacgtatatcagcatttttctgcatatttcagaggcgtacaggaaggtgtcccaggacagcaataggcacatagcaatgttcttcaataacagtgggcgcaaagtccaggtactgatcaaatattctattttccagaaatctgaaagggggataaaactgagtcatgtctttctttacttctcagacattgtgttccttrcttttttgggagtcccagttatctaatttgcttgtgtgttagaaaaaaaaaaaaaaaaaggagaagttggatggcactataaaacgagcatataaaagtataaaatactatacatgcttctctattttggagctgtgaggcattgttttaatcttctagaatggaagctcattatttagtaataatattttgtaatatagctaaagtagtactttgtcctaaatctaataaaatcaaataaccacagggctgggaaggatcatttgaggtcagtcccccgccttcaagcagaagtcagcaacacatttcaacctcactctgatgctcttttgcaagttactagaggatatttttactcttgggtgtcatcttcaatttaactaactggttttttatgcttctttgtcctggatattgatgaaaatgtttaatatttaaagtagtaataactctaacagaatgtctcttagtaccaaacaaaatgccagcccccacacagtcactgatcctcctaaataatttaaactcggccaggcgaggtggctcacacctataatcccagcaccttgggaggcctaggcaggtggatcacgaggtcaggagatcgagaccatcctagctaacacggtcaaaccccgtctctactaaaaatacaaaaaattagccgggcgtggtggcgggcacctatagtcccagctactcgggaggctgaggcaggagaatggmgtgaactcaggaggcggagcttgcagtgagccgagatcgcaccactgcactccagcctgggcgacagagcgagactctgtctcaaaaataaacaaattaacaaaaataataatgataatttcaactcaagggttgggtgcaggtaagaggatagcaatatgttctggaagctttgaaatgaaagaggatgtcattttctggtcctcttgggtttttttttttcgttccgagaagctcatccttattaggtaagatttgttctttcacattatgatatcgagacataattgtcctcttagcagtttctgtcggttgatttttttgtttgtttccaggtttttgtcttacttggcttgctttgttttggtttggttagtctgtttttakttttttgttatccttgaatatcattttcctgaactattttttagttttcctccacgttttcctgagttatgacagtggtaactgggaaatttttatttttttcataaacttggaagacatgtatgtaaatgactaaggcttatagattggaatcaagtcactgcattttagaattgaaaaggatgttggatatttactaatcaaatgacccccttctaaaacttatgacattaaggtccagggattagatgacttttctaaagccaatttatgagttaggcaaaactatgaccttgatcttttgattcctcattcatgattccttctacttccaccctattccttaacaattcaactgggatagtaaatataattatagtgctgactaaaatcattgttcctaactataagagacagactgatggtccccaaaaaactctatatcctaatccccagaacatgtgaatatgtcatgtttatcacaaaaaggaatttaggttatagatggaattaaggttcctaatcagctgatgttaaaatagggagattattctggattgtcctatatgtccactgtaatcatgagtctttaaagtgaaagagagagggagaagaggtcacagtgattggatgtgaggactttatcccctgttgaagccttgaaggtggagaaaaagggtatggccaaggaatgcaggcgacctctcagaactagaaagggcaaggaattagattctcccctagagcttccctgttgataactcttttttggccacacctcatttttatcccagtgagacttgtgttggaatgctaacctacagaactataaaataaaaaattcacgttgttttaagccactaagtctgtggcaactgacaagagccatagaaaactaatacactcacaaagcattggcagctgctcaatagaaaatatttctccatggaataacttttaaaatctgcattttttcctttttaaatactaccttaagatagttaagaccttaagaaagtgtttatcttttgctaggaaacagattccagttagtattaatttattacactttccaaaaacagacacaagttcgtacccaagttcaccaattgaaggagtgaccaggaggaaggttcagaggatgtccctgacatacttcatcagaatgtccttggggcagccagaggagaagcagacttttgatgtgtgtctgmaattctctgtatgtcagataaaatcatttcaaggtttaactgtggataatagaaatttctgcaaagtggcctctrtctgtaatattcactgtactgtgatcaaggatactaatgatcataaacttttctctcttccaagcatacttttcactcaaagtagaaagggaagtgaagtcacacacayayacacacacacacacacaccttcagactggcctcataatagaaactatcacctggacaattcatttctctaaatagtaggcctcaaagatttctgttaccacttttcatattaccttgctacagaactattattagattacttaacccacccaaaagacaagcaaatagaaactagttttttaaacccattcttcttttaccaagtaaatcttcagcttgttaatatttctgaatttccagacaagatatttttctcagaacctagagacaggtccaaagtgacaactcctcccatttacccaggactgagtagcttcctgaaacrcaagacttttagttctaaattcagaaaagtcctgaggaagaaagaccaaagataggttttgagtacatagtgttgtgtggaagcccaaggccctgacccaaaatgtcccaggtaccaggagcaaccattttccaagtttaaggttcacagatagtcaaatacctgaggtttgggctgtggaagatcctaccttgcttgcattctccagtatccttctyagtgacttactcactctttatggtcagtaacagaatctctctggagcagctgaaggtcatcaggaagaaccagaggacaacatgagaatttatggagagtgcaatgtgccatctactaaagcagtggctctggggttttatgtgtgttcactggagaaaaatacacttatgttcatargaacacccactttggttcgttgcagggtactgataagcaacctgagaaatgtggtggaggctcagtttgatagccgggttcgtgcaacaggacacagttatgagaagtacaacaagtgggaaacggtatgatgtgcacatgatttagacagatattactttgggaattgaaccaagaatgccacattgatctacaaatgattccatttggtagatagaggcttggactcaacaagtcgccactgagaatccagccctcatctctcgcagtgttatcggaaccacatttgagggacgcgctatttacctcctgaaggtaatcatttttaaccatgaccttgccatgtctgagggctttaaatcaatgaattctaacacatgaacatctgtttcacagacacgcttatcccaaacattgttataactctttcctgcctacatccccgagggaaccagattcccyagcttcttttatcatatgtggatttttaaatcattattttgatttattcaaaaggaaaaatgcaataaaataagagaagacctataaatttaaccacattcttgtaagcaacgtaaatgattatctaccttgatgaaattcttctttcccagctgtggtttgcaaatccatttttaaagaggttcataaacttcatgtctatcagacaacattacaaagcacatcaacaatttgtttctgtcattttctaacaccatttttgtcaygtaattctaatgaaggaaataaaaagacagggaataagtgagagagtagtaaaaattcttacaagattagcgacaatcatgattacttctaattactcatccagttgtcttggtcatgtcacctaataacagcagctgaaaataacctccacatgagtacaattaagcagggtaatcaagcatcatctgaaaatatgagcttgtcaagcttaataaaaataataaacagccatataagctttcagctcaaacattgtgagtctagaagcgagaacatactgtgttagtattatattttaatttaatcatgggatccagctcttgctgctgtcgggtttcacttgttgagtctcaagcccagatgggtagtggaggttaacccctgaatgtcctatgatgaatcatggtttcccttttccttttgtttgcaataggttggcaaagctggacaaaataagcctgccattttcatggactgtggtttccatgccagagagtggatttctcctgcattctgccagtggtttgtaagagaggtcagtgtgtagagtggtttttggcaaagagaaatgtatgttttaattttcaattaattccttaaaacctagagagaataataacacagaaaaaaatacacaattacaagtgcccaattttggaaattagtttcaacttccaccaacagacctttataaggcagaaaattctatttatgggccaggtgcagtggctcatgcctataatcctagcactttgggaggccaaaacaggtgaattgcttgggcccaggaattggagaccagcctgggcaacacggtggaacctcatctctttaaaaaaaaaaattgtatttatttgaatttcactcatctgaactttctcacccacatttggtagagagtccaacaactagcatagtgattggtcatgtaaaagctaatggttgtggttaaaccaatttgatcattatctcttggctaataatcattgtacacttcagattaaaagaaaagagtgcatagtagtccttactctaaatgacactgtttttcattccttatcattctaataataagatgaatgtaaaggccttttaaaaacaagttttaaaatatgcatgagtctatactgatatgcatagatgatgcaataaataaaagagaggcaaagaacaactccttcttgcagaagaattacaactaatatatgtacaaagaatgagcaaaacataaaatcatcactagaacatcacagcaataatcatgtcaggcaaatccacagatggatgtaaaattagtgggtaaaagtttagggagaaacaggatatttacagagtctaaaagttatctcctcgcaaaaagtattaattataaagggaaaacttagagtggataaacctagcagaaggaactaccttaactaagtgatcaaggttaacatcaccaataataaataagacatatcaatataacgtagcttcagatatgctgtgaaaagacatatcacctttgtgatattcttccttaaaataaatgacctccctttaatcataaacaaaatttaattttgaaaaataatttagacaaactcaaagtaagggacattctgcaaaataaactgaccagcactcttcaacagtgttaaagtcataaaacacaaaaagactgaagacctgtcacagatcagagaagactacggagacgtgacaaataaaggcaatgtaggatcctagattgtaacctagaatggaaaaaggacattagtggataaacttgtgaaatctgaataaagtctacagyttagtttatagtattgtatccatgctaatttattcactttaataattataccatggttgtgtaagatggtaacattcaggaagctggatgacgggtatgtgggaactacttttgcaattcttctgtacgtctaaaattatttcaaatttaaaagttgaaaacattgaagtgctttaaatatataataatattattatatacaacataatttttgtgtgaagcacttccgtacatatttgttatgtagtcttggtttctagacattatgtatcagattggcatcacttagcttcactatgtagctcaccatctgcctttcagaagaggataactggatgttagaattaaattttactatttttccaatttgtagaccattaaaagaacatgattgcatagctcctccaacccaaaaagcacatgctttatcatgtaatattgtaattaatttatatatataattacaaacagtatataaaaactgttcacacatagaagtctaatctactttaaagtttattcaagcaagcctagggaagggttgaatttaagtttaatatgatgctggagcagagggactgtgactacgagaacatattaaatgggyatgatgtccctcattcatagataagtatctacattatttaacagggacaacaggattgtcccttcttgagaaagacaacaaaggaaactcccatcactatgcagcttggagtgttggtgagagcctccccaaaatccatgagtgtgagcttattttgagaggcattctcattaccttgttatattggacattccctctagtgagatcatctacaggaggttttatagaaaagaaatacatttctaaatgacattattaggaacatgcacagctatccacagacacgtcttacttactagaactagtaagttctataccttacttacacttataccctactaactttgtaaaaagctattgtagttgttatcttaaaagaaatgagtatatatgttctttagaagtctttaattaaataagtttctcattaaagtaaaaagttaaaataagaaggatgcaatagaaatatcctggaagcagagaagaattagaaataacaattataaataaaaatatcaagtattggtagtaatttgctgattgctttttaaatattaatattgtccacctcaataggaaatgctgctcttattaccaaagttaacattcaacagtctttgtaaattttaacagcatcataattccatttttccatgaaattcctcttcataattcacatacaggctgttcgtacctatggacgtgagatccaagtgacagagcttctcracaagttagacttttatgtcctgcctgtgctcaatattgatggctacatctacacctggaccaaggtatatgcaccaatactgagasargctgatgaaattaaaaccaacgcctstctattatatttgtcctaactatgtagtccactttcagagccgattttggagaaagactcgctccacccatactggatctagctgcattggcacagaccccaacagaaattttgatgctggttggtgtggtaagtatctggctagccattttgcatgtatccattgaaaaacataagaggaaaaatatgaaaacrcaacagtatctaaaataaaaaaagcaagttttatattttaaagttctaaccytctaaaagcaccaaaaaaaaaaaaaccagtttaattcatttgaccaaaacatattgagaactctgttgcgttcccagctgtgctagatgctgaaaatataaggctgaacaaaccagacataatcctactactcatggaatgtatagtctagagggggagacagctattaaataaataattatttacataaaatcgtaatgcaattaagaatgatcatagtaataattttttcatggatattagtttgtcccttacttattaattttcttgcactatattgatatcattgtgtaatactacacggagacacattggtgattccatatgcaacttcttaccaggttagcttaaaaacataccatcctaatcctgtgattaaatggatattttactatataatatatacataatagggacaactttaaggactccttgataaggrctcctatgaaaacaactccctaatttgaaagtttaaaacatccccacaagaayttcactaggtgatccttgccattaacatcatatgtttttccagaaattggagcctctcgaaacccctgtgatgaaacttactgtggacctgccgcagagtctgaaaaggagaccaaggccctggctgatttcatccgcaacaaactctcttccatcaaggcatatctgacaatccactcgtactcccaaatgatgatctacccttactcatatgcttacaaactcggtgagaacaatgctgagttggtaagtagcaaagtagtaggtatgacattttactattgagatttttwaaattctaatcctgaaaaaaaaatcattataaraacactttctggaagtccctttattgatttttttggtagtagaattgaaaaacttattacagatttataaggaawctggagttggctaaaagaaatacaattttcacgcaggaaattgttccccacatgcgatttattgactaatcttcaaaatgacaatagttccatttcctctggcttcaccacaatgctgacttacatgatgatttcagatgcatatgagataatcaacaaagttgcttgatcacatacatatttttttttcagtcagttttgtgaagctgccctgagctgaatttgacacagatccagagcatagcagagcacagcagatgtcattaggaatttgtcacatttgggtgatatcaagtttagtcattaaatactaaaattgtttatttcactttttgattgggtgagactcaaaagtaaatcaatcaatgaacaaataatgtgaatgagtctttaccacatacagggaataaagcaaagaaatgtaagaatctctgacatcaaaaaaagctagcaatcttattgaacaatcaagacataatcacttgagcagctaaataatgagttttctcatagaaatatcacatgtcaatgaataattttttaaataagcatgtttgaacctttcaaacaatatttctttaatttatgaaacatctggctgccagaaattggcaccaataaactaaaagagcaaatataagatttaaagcatttgagttaygccaaaaaaaaaaatgtattccatttagacaatgacatggatatttggcttacctaaatgcataaatttgaagacctagtaactttaaaactgaaaattgttgttttatactttcagattcagtctttcggagaccaaataaaatatgtaatgccgtaaatattttgagaacaaatcagaaaaataacccagtctcctagaaaattgatagctaatagttggatgggcccttttctttaaaaaacaatacaatttttcaaaaagcttttcatttttccccatccatggccaaaaatatatatatatatatatacatatatatatatatacacatatatatgtgtgtgtgygtgtgtrtatatatatatatatatatatatatatatatatatatatatatgttagcaccgccaagcatttcagtttttcacttaagcttggtctgtatgtgttcccaatgggtgctcacagtattgytctcccagagatgggtgtggttggctctcatttctgtccaaaatttctggccaccagaaaagaggaggtgggggtatgtagtttgtataactcatgtaaatatatttaagttgtgccatatcagaagagaaaaagtcaaagtcataactacatactaatgagttaattaaaataaaaaaattacaaaacacattaagggtagcaataacatatatatatccagtttgcttcaatatcaactagttttagacataactactaaaagactaacactaaagaataaagtttaaagtgttcctggaagctgagctaccaaagttttcttattcaatacattttcttattggaggaataagtttaagcccttttagtgatgagacagctttgttgccactagttgtatacaataacaaccagaacctgggctactctaaaagtctccaaatcattcttaaaaaaaaaaaaaaaaaaaaaaagrcaagtaagtcctgcctttagaatattatgaataatttttgctacttcctaaggaaattttctccagtaaaagaaccaagcctcagagttagcaagtttaatgggccaattcacatgtgtgccaaatggtgtaaaaatgttccaacagaacatgagtcactgatactcttccctaagagtcacttctttgtttaaagtcaaggagaggtaatagtaaaagagatactattcaaaatcctgtcctccaaaattgttaaattctaattgccaaagaagtagagtaagtagaattctaccraagtaaaatgttcataatctattctcaaaaggagaaaaagcacaagccacaaaataatcttatcttggatgtttgtttctacacatacaaaactaaaaagttcaaataaaaatacatgccacttttatctttaccagagtacaagacaggtraytaaaaygcaaaaatttaatttgatgtatcatactcattgatttaaaagttatttttaatttccaataattttctctattgattaagcttttctctagtatcttaaaagaaatatttaaatgccactagtaagtggcatgctacttaaggtgactgttatttgattatctgattcatttggtgtctgaatttagtttagcacrccaaagcaactttaatattttgagtagctggagatccttccaactttttcttatattgtagaattctagtttacttacttccagagcacattttgctaaaacaagctcattaactatagtgcaattacaaatatatgtatagacaaaaaagaatatgagtctctcaaaaataacagtattaacagttttacagtttttatttacaatgaggatttcaaggggaaaaaaatgtcttggtctagaaaagttaattttgcacccaaatctagtgcctccatattaattcttacatagagaaatgtgactctgctgcakaaaacaaaaggtagtaaaacattaggaacatgatttcttgcatcataccacattaaaatttaaaggaaacaatgaggacttacagcgttctgccaagtcattggtgtacaagagatttctatttttctttatacctataaaattattattttatttatagcaaaaaaatatatatgtttcaaggagaataagactagactaaaggaaattattttgtgcttatgttagcattttcagcccaaacttaggacatcctataaacagcagtcctttgatatctgagtcatgataaaaatgtatgtgccttcatttctgaatgattttacatgtagcttgcctaataattgctcatatcatgagacaaccttcagaagaaagaaaggcagagataagaatgcaaaagaccaatgaagtaaagaacaggaaaagtattatatggattgcagagaagactacaatgtttctctaagatatgtttagcagagcagtagaaagtagatggaataacaagaatatcttacacatataatgctttcccatttgcaaactgcttttactcatactatattgtttaaagcaagaatacaaagtgcactctgagcttctaatggcctcataaactgtccagtctctcagtgtagacctctttaatataaagttgccactaccgtcaaaggaagttttgagacttaaaagaaaaacaatgaatttagatttccaaaattctaaaggacaatgaaatattgaattctgtgamcttgttattgtcagagaaattaaaactgggagaaaaggctctcaaacctagccatatggctgcacttattgggcaggaagaagctcccaatctttggtgcacctcccctgcaaagatgtctacatgacactgttaataataataataatacaacttcaaagtgaaaaatgggaagccagaagaatatccagccaacaagtatcttgtccctctccacagattaacaaaatggaaagcagagcgcactacacaaaggtgccaatccagggcatgtgtcttgcaccatttctctgcattagaagcacagaatgttatgcctagaaaagtcttagaaattctctggtctgtttctcattttccagctgaggcatggaatgcttggcgaagccaacactagtagtcagggtagccctgggtctaaggctactggctcctgaggaatcttctaggctgcctcaatttccaaagacacacagacacatatttaagtggccacatgctatggtggtaccccatataactgctttgcagaataacattcatcagaaagtctttaatcccacacagtacatcataattacctctgcctctggacattaataaagatgtactctggttagctaagatgactaacttctcatggcctagtctttatgattctggcccattcttttgagagatatatattcattaacgaggaaaaagataacagtaaccagaagaagaaatatgacagactttctgaaaaattattaaatgtgaacaaaagatagaaagctacttccaaattctaacaccttccagtccagtggcaactcagtcactgcctcttaattgaagttttttttktttgtttgtttgyttgtctgtttgtttttgagacggagtctcgctctatcacccaggctggagtgcagtggtgcaatctcggctcactgcaagctccacctcccgggttcatgccattctcctgcctcagcctcccgagtagctgggactacaggcacctgccaccacacccggctaatttttttgtatttttagtagagatggggtttcaccgtgttagccagggtggtctcratctcctgaccttgtgatccgcctgcctcagcctcccgaagtgctgrgagccaccgcgcccgtcttaattgaagttttaattaaggcattactaagatagaagtccactgctctcctcaagaatttgagtataatgcaagattataactaaagataaacgtaaaaatcagagggaagaaatattgtgattagaaggcagacagttgcagggccatgcacacacccatgcacatcactcatcacagctgtaccatgtccctgcctaatagcaagagtagcaagccacaattatgcttccaggcaggcttaggtgaacagggctttaggcacaaaacatctgctgcaggaattgtctccaactttatactctcatttaaaagacaaaaattttaaatgacaaactcagaattcatttaataaactagtcatttattcamcattatgctctttaagtgacttcttggcctgataaaattctcctaccaggcttgctcagtacatggcttatcaatcatcgaaaatttcatggccaagcctggtggctcatgcctgtaatcccagctctttgggaggccgaggcaggaggatcactatggtcaggagtttgagaccagcctggccaacatggtgaaacctcttccctactaaaaatacaaaaatttggctggatgtggtggcacacgcctgtagtcccagctcctcgggaggctgaggcatgagaatccatttgaacccaggaggcagaggttgcagtgagccaagatcatgccactgcactccagcctgggtgacagagcaagaccctgtctcaaaaaaaaaaaaaaaaaaaaaagaaagagaaagagagaaaaaaagaaagaaagaaagaaagaraaagagaaagaaagaaatttcattgagcacctattaagtgttcattataaagtatgtttcctgccactgagaatttacaatcctactgaaatgataagacttgggtaccagaaaccatacaaaaggagaacagaattgggagtttccagttagtgcaatagtaagaattcaggaaaggaaaatagcaatgtttgctgaagctgctcagtgaagattatagagaggggatgcaatttgttctgagctttgaagtctgggcaggatttgagtggcagagaaaggaatagggtgttttaggcagagaaaagagccaacaaatgaacaatggagaaactgaaagatgaagttgaggaagaaagtagaagagggtcatcctgtatcgagtgttctccttagggaagagtcggggcaagggccaatcaatgaggtaaccaggttgtgtaggcacttgaatgccaggatgaatcctgtgtcacagtgggccctggagccagggacctggaaaataggattgcaggtccattacaggacttccagtagaatctggaattcaaacaacaaacaatttttattgtaaccatgtccaaatatttcatgggacagacttatactgaaaaattattgttcctctgaaatttaaatttaactggtcagtctgtattttttgctaagcctgaacgttctgggaataaagtgatgttttagcaacagtgacctagcagaggtgtttaaaagatagctgtaatgtcatcaacgagaaaaaggcattctcatagcacctttaaaatcagttgtctttctttttaatctttttcctaaaataaattctagtttaccataactaaatattttatatgacttccatttcaactaattttgccccccactcccactcccacccccagatgacatttggcaatgtttgggagacatctttggttgtcataactgtcgagctctactggcatctagtgagtagaggccaagggatgctgataaacatcctacaatgcacagaacagccctcccatccccaacaaattatccagcccaaaacgtcaagagtgccaaggttgagaaacttgctttaaataamtataagaacaaagtcacattcctggacaaaggctctcgcctttcacaggatcttatactttcttcacaaaactttacaatgttctgcaaattacaagtgcaagagaacctacaaatcccccattagacagtatttatttatttgggagaaactccacttccaccagaaaaataaataaataggtaaataaataaatacattctctagactttgcaatttcagctgactcacacttcacatttcccttgaatttcaaagagcttaaaaatatgtatgcagatcagccaaataaaaagtttggttttcatcagtgaaagcgttcccacactccccgtgggctctgtggaaatcggcaggcctggttctcctaagccaaactttttcctaactccttgcccttctctaatctcagggcctcctttttctcaaaacatatttgctttttcaggtctcaaatgctttctccttggttcctgcttatagaccgtaagggcttcttcttttgcaccaaaattataaaagttaagtttcttattggtcccttggtgtaatttacccattatcgcasgacagaaggaaggaaactgcagttaaggattattttgatgtttctcttatcacaaatattcacccatagggatggctaaactcagaactttcagttagaaacaaagttctacagaaaattttctttaaattgttttataccttatagttggtttggagcttttgttttcttatgctgtaataatgggtcactggaagattagaagaggcagccccctgtcatgatgctggctgtgtacaagagattggaacaagggctatgtgcacagtcacgaaaggggagtttctttatcrtatattcgatgggaatgcaggtcagtggaaaagaatatcctctccttattcatctcaccaggtccttggaactcaatgcctggagaaacattacactaagcttttactttgtctcttgggctacgagctagatgtgacattttagactctctctgtcttttgctctaggaccaaggcctcattttgaggaaacagatgacaaaagagaacatgcataagatgtgaaaattcatagctaaggattaataaaggctgaccatgtttggccttgactgaaagcaaagttttctctcaggctggtttatatttagcttccttctgttctttacaattggtaaaaccagctccagcaacacttcttttgaagtattccaaggccacaaggagaagtgaaaaagagcagaggatttaaagaaagaagaacctagctcaagtcagccacttatggggctgtgtgcccttgagcaagttcttttatcctctgtgagtgttagttcttttatctgtaaaatggggataaaaatatctagctcttatcaagagctctttgtaaagcttaagtttttatgtaaatgttagttctgattttgaatccactgagaaacaatgtaagatgtccctcaaaaggcaagttttatagaaatcatcactaattggagtttcaagatatggaccgagttctctgctgtgtcgttgcttcttggttcttccatcatctgccctcatctctttttacagaaacatgaagggaaaagagttaccactctaaattgtagcaaatgcaagaattacctttctctctaccattcttrgcaggggtcagtcatctgggttgattggaacattcccactgagcttgctgccccaggtggaattccattctgctagaaatttctgtgttggtgaaatatggacagataatgttgagaagataaatgagtaacatttgtgaaattatttgaactcttctaaagaaaagacccacactgattccagggatttttgttaagataattggaatttaaaatatgatattttacttgattaatgtctgttctgactttttttgtcttttggccttggaggggctaagagaaaggattcatagacttttttttttaattaatagaaataagtaaaatgcacagaagatgtcaatgtctaaatgtggcatcctatcaaccatcaataaatggtaccactgccctcccccagaagcatccccaatctccactcaggtgggttcagcctctgcaaagctcagcactctgtacctccacccaaatcttgattattcataatgcccctaagccagagtgttagactcagtcaactaatcatgtgctaggtgctgtgcaatctgctgaggatacaaaatgaatagccaacaattccttccttcaaggagctcacctggtgaggaaatagatgcaaaaacaactgattatagcatacagtgaaccctgataaaagtgtgggcccccaaaaaggagaggggctcaatgcttcctaagagagtagaggcagcttcacaaagaagataacactaaaactgaatctggaaaaacaatagcaattatccatattagtaaagagagaaagaggattccagtgaagagaaaagggtacccacagtcatggaggtcaggagaagcaggaaagggtgtacagggaagtaattcaggaaaatctacctcagaaggaacacgggaatgcacaacaaataatgtagcctgagagacaaggccggacctggtttgcaacaactgtttttgccaaaagaggtttgacatgatagagccatcgaagacgtggtgatgaggtgatcttcagaagatgagagatgaggtggatatcaaaatgagagagcaactgaggacaagagctgagaacttaggcataaactaaatgttcctccagtgtgcacctgtgacaggaataaaataacaacctttttaagctcacatcaacctcagatattgcttcagcatcaaaaaaaaaatagagcaactgttgccaaaagatgccgatgacggtgtagagagaacttggatgtcacttcacatgcccagagtgtggtttgaggaaaggacaactaaacatttttctgtggccttaatggaaatcatgtctaaattgatataataagtcaaaagagataacagatcacaagtagccccctttggttttgtctgaaaactgtattactacattgcaccagtaaatatattgagagacttgaaagacaatcaatcaacacacgagtccaatagataatgacaatgactattaaatcttctctagtcttcgtaactttatatgtttggaactaatattgaagaatcatatttctactaactaaaaataataattcaaggcttaaggaaaaattgaagtaaagcctgaagaaggcaaccagggaaggaataagaattctttaagatcagaggttctgcctttcagataaataactaactggagatttcctttgataaatggcaagataaagaaattgtagaatggtagaaaatatcatgtttacstacaaaaagaactattgcctcaccatgtttcacatctctagaagatggttttaaatctattatgagcattatgtaatgtttaactggttctggtttcaattggcagtggaacctaagggtttaaacaaagggttaaaaaaatctaaatctagtgtcttcgttacaataagattaaacaagaggagcaatatatttaggccacaacagtaaagatttcatgcagttagagaaagcatgtcttagtttatcagtttagaaataggaaaatggaaccctaaaatttgcaagtaccgacccaaaactctgagaataatgttagttccaggaagctgattgcatcatttcagtggaccagaacagaaaataatgagttacatttaataactctttttaagttttctaatttaccacctggctgataaagtattaatgctataggaattggaatccttgaagtcttacggccacgccctcatcagtttgacataagattctactaaactrgtttcaacattagaataaggaaaggaaaattcctactttgtaaaaatcatattattctgatttcatcaccaacctcacagttttccaggcatatgtagaagaagtaattataatgccaaagtatgaaatatagccggtttcataaccggartgaattatggctaattctcctgcagtaaataatttgtttttcaaatctgtattccccagacagctgagccaggccttgcttctcaagtgttttatttaaataggcagtatgtcagtggagttttaccacagagtttctgagcgcagagagcctttccctaggagtrgggtgcagggaactggagggcaatggttcttatgagaaggtgatgatgcttctaagaaaaaagattacacgtaagttaatacctaacaattktttttaattctgaaattcaaatgttctgcattttgaaatagaatgaatattctctaactttttagtctaaaaaatttccaagctggagctaccactcatccttggaactgccaattcctaagcattttcatgctggcactgaatgttgcattgactagccattcctatgtgcagtttctaatgctcctgccctaactcacacaaccctattgtaacttaatctggctttataaactgccacattgccaagtgtttttttgtttttttktttttttkttttttgctttgtttkctttgcgtttttgcatgcgtgtgttttggtttgtttgcctgcaaacaggtaaacaacttctttgcacaaccataaagacttccttgtctcctgcttttctgttacaaactcttacaagacaagataaatagaggctcagagtgaatgcttggggagggtattagggaagacattcttgcacaagaattacttggatcatatcactaggttaagtagaaaaatgaaaatgggtcctgaataagcatataatacgatccaaattgttacttacatgytttgaatgccttaaaaataatgtacagggcatttgtttggcagtgtgcttttatttatttccttacttattcctgtttcttttgcagaatgccctggctaaagctactgtgaaagaacttgcctcactgcacggcaccaagtacacatatggcccgggagctacaacaatctgtgagtcttggcttcagaactgtgcaaagaaccatgtgcctaaaaagccaaygaaaggttcctggggcctttcttttctgatagtttaaagcatgtggcttttgcctcacagyaaatttttctaaaatatgtaatcagttttctgttcaaaaaaaaaaaaaaaggagggaaagcctggacaacatagcaaacttttctctaaaaaaaattaaaaaattagctggtcatgcacacctgtaatcccagctactcaggaggctgaagcgggagagtcacttgagcccaggagttctaggttacagtgagctataattgcaccattgcactccagcccgggtgacagagcaggaccctatctcaaaataaaaagggaggaggagaaaaatatccttttcaacccacagagacatttcctccctgtaagcatctactgagcacttactatgtgccagggccttactaggcactaagagaacaagaaagtaagaatagagagaagaaaagatgaaaagagaaaaggaaggagggagatcagggcaatctttaaagaactagcagtagggaagcagcaaaaataagcagtcttttgtgatacaggtgctaagtgctgtgacattaggatgcacaaggaaagaacacacccaaagaccaaccaaccccacagtatcagaattaacttcccaagatgatgacacaaaagttttatctgaaaggattgttgctggaggaaaatataagacagagtgttttcagccgggtgcagtggctcatgcctataatcccagcactttgggaggccgaggcaggcagatcccgagatcaggagctcgagaccagcctgcccaacatggtgaaaccccacctctactaaaaatacaaaaaattagccaggcgtggtggcgggcacctgtaatcccagctgctcgggaggctgaggcaggagaatcgtttgaacctgggaggcggaggttgcagtgatctgagatcctgccactgcactctagcctgggcgacgagagcaaaactccatctcaaaaaaaamaagacagagtgtytttttggctaaacagacgacaaacaagtaccagggctacctgaggcacaagtcaccttcaagaggtagacaccagtccctctaattagacactcagtgtatgcaagcaagtggctagagtggtaggggctagacccragagctgtgggtgctgcagcttagatttatctggaaggcacattccacaggcctcattttcaatttctacgtatatcttcytttgccttcaaatggtttctttctgcctgaggttggaaagaaattgaaacacacacatgacaaaagacccagtctcatcatcaagtggcctccagtgcagttggagaggctccagtcctgagttgttgggatttattttaagcctttatgcaaaatacaattttctttatttttattatttttaaaaaactgctctgaatcatatgaggcatactgttttcttaaggggtttctagcagagatagcccacctatttatatatggtgaacttggtgcatgttttattcagttcaactaggcttctttttccattacaytgtaagactttggagggcagagccaacatctctcctttgttctggcatcttcagagttgagcccatagcctgctgttcagtgggggctatacaattgttgattgaaaaaacagatgagtgaataaatgaacaaatgaattaattagtacatattctatgtgttagtgacaacatgattgttattgaataaattaataacatataccttatctacaccaggccctatgctagataaacactaaaaatatgaaaatgaaggcatagccctgccctcagcttcttcaatcttatcgtttggcacagtttcagccgggtttagagttttctcctcttgccaatcatcatacggctttccttattttcctgagagatacacatcctttcacatataaagtgtagtttaccatagcatacaagcacactgggaattttgcattacagattacgtactttctgaagtattaaacacatcatttctacaaagtgaagtggtgatacgtttaataaggttggagtaattttttaaaacagcccccataacatttatgatccagtttactagaaaattggcctactcaaaatattttgcacagtgaaacatttgtaatgaaaaaagaaactggcaattttttaaagctccttcctagatttaaagttttttttcactgctgtttgcacatttcagatcctgctgctgggggctctgacgactgggcttatgaccaaggaatcagatattccttcacctttgaacttcgagatacaggcagatatggctttctccttccagaatcccagatscgggctacctgcgaggagaccttcctggcaatcaagtatgttgccagctacgtcctggaacacctgtactagttgagaaagctgatggccttgtttcaaaattctcatttttcatttcttttctttcttgaattcttattttggtttgcctggatgttttgcagatcccaatctttcttttaagcttctgggtctattaaactaggtagatcttttcgtattgatcataataaaagtgaatcattactattggaaaacttgacatatggtctacttctttggggaaacactgatgtgaatgaatgactaagcaagccgtgcacagtgaggatccggtcagctgtataggagttaacatcctggggtgctggctgagaccatcagggtgtagatgcactgattatagtgggaggcttgtgagctaagaagaaatgtaaagggaaatttaggactgttaaacctggcatacatgaaaagacaccatctttcttggtctagctttcatctcagctcattaaagttattttatcggctgtctactacatgccatgcactttgctaagcaattgaagatggaacaatgaaaaagaaagataacatttctgcccttaatgggtgtataggccctttggaaagacagacattacacaaataattaactcattaattaacaatttattaattagtaatctaatttacattaatcaaataagtgctggatgaactacrcaaaaagaacatacaaaaagtctacctgcttgatgtacgggagaagcctccctcagaaactgctgtaacctragaaataagtcacagttagctagacaaagggagcaccgcttccaggcctgtggctatcccaaaagtataagaagaaagccagtgagggtgaaatttrgagagctgaggaaagaggagcatgtgtacaggctggggagggtggtaggaaccatgtcaggcagagcttagaggtcacgttaaggactggggacactggtctaagaacaatgmaaatccattgaagatattaagtcatcaatgacatggttacagtgtttttggaacaccaactaggctagggtgtggaaagcagatcagaagtgagacaagaggataccagggaccctgactggaccacttggaccaatgaaagtggcaaaaatcactccagaacttgatgttttccgggattggaattggacatgctgtgttgggaagtattgtgccaagttcaaattttaaaatagaatgagatgtattaaagttacgatttgggggcatctcttacttaaaaatgatagactattaactcattactttctatagactttctgtagtctactttcatagactcttaacttattactttctatatggcttcaagaaaaatgagactccatatagggagggcatgatgtgctaaaatatctataacagtgttctattcataaagagaatccattgaagtaacaacggtttgtgaaagttgtcaagccaaagaataattaattgcattaattgtccactaggtggtagcagtgcagctgctacaatgtgtcacacactcatcttcaaactcatttagtaatacatcatttaaatagrcagagaaccatatgtgaaaaaaaaaaatcccattaatttgtcagcaacattggtggtaatttaaaaatagatgtaatttagctaaatattcttcctcctactctttaagttatatccactttgtgtattggagggctaacatagccatagttacctgagtgaggtaatcttgctggaggtgtatcattaaactcctgttccacaggatactcccttgctatctctggcaagtaacaccaacccctgactaagggaagctgtggcccaaagtatggaaatcttggcaaaccacaaagaactctcctaattccctaaattgaatgctttaaaatagaaattaggaataatatatgtggactgcttktttaaaattccaaggaatttttaagggtaagaacaaagaataggaaagcaaatatgcaaatattcttatttgaaatcccatgtatctgagatgtcctgcacctgagaaatttttactatgaccactgtctactgaaagttaacaggaagctgggtagaatttccacttgcctgggcaaaaccaagaaaaacagaaagagaaatctgccttagtcttcactgtagtagtatctgaccagctaatcagagactgctgtgagtccacccagccttgcccacctgagagccccaggttggggggatacctcttcttctccctcttttatcccactcccaccctgagatcccagagcaggctctgagcctttccttcagctccaagctctcagctcccaaagcaacagtgaaccaacagcacaagagtagcccctgaatctttctttctcaagtggtgtgggtagaaaatagcaagactgattttctcatctggattatggaattcctacatacctagaatcatatgccatttgttcatcttattctgcaagctgacctatatgaattggtcaaagagagaatttctagaaggaaaagaaggcagaccatarcaagttaacatgttaatttgggggcaaaaagggttctgctgagtgataatgattaaaaatatatagagaaaagcatagctaaactatatggtgatattttaaatcatggctagacgtgcactactacaaataccatagaaagtgcagagctcaagaaagatggaaaattatggctgcatgaagtattcacctctaagtcactttttaaagaggttgatttaatctgtgaaacatcacagtcttacatagtcaatcctaaaatgatacggggtttgacaattattcatcctacccacacatatgccaagaccttttataaatcttgatgcagtaatataaggcagcactgatctatgcttgccaagaaatagcgcttgttctgagaaaaagctctagaacattattgaaatccatctattgtatttttcttcagaggctaaatagattggagaggcagtgggagtctcaaacacatcacatrtttatatcatattccagaaagaagaaattgccaatatgtaatctattaagaagccaaagatgtacttttatttattaacaaagtcttatcctgagaaataccaargtcctcaaagcactcacctagattccccaaataaaataaaagtgttcttcctacttgacctgaaaaacagacatagaagctttctccacacaattttaaaaccagtcacagaggaaacagcttcaagaaaatataacagaattctaaaattaagaggatttctatttttcctctttcacctttcctgtattttccagaatcattttcaatgggcatttataatttttagaatsagaaaataaaactctaaaaagcaaagctataacattaaaaaaaattmttgaagtagtccacatgaaaacaaatacagagacatattttatccctaaaggtcacggccaccactttaatctaccacatgatctattttgataccggttctgcaggctggcagtggcccactggaagtctctgttgacagcacatgaacattttatcaactgtctagagagcatggacgtgttttttagcacctaccacgaagtccctaacatatcctgtctcactaagcctcacagccacttgttagagtcacattagcattcccattttacaaatgaggaaaccaaggcccagaataactaggcagcctgctcaaggggatgtagctagcgtgtgggagccacattgaagtgatgtctgtcgaaacccaaagtcaaggtctttctttttcactgttccctggtcaaaagtatctttagtcaaaagcaatggagcaagcatttgctttgggagttctcagtgctggtgagcttgcccagtgtcaagaacatgaaggcatttgtaaaaccctcctcttccttacctgcaaggctggagccggaaaatccatttggggaaataaaaaaaagtcccgagttctaccacacacccatcagatagagaagaatggaattactgctgctgtatatataacaggggcgtgtctccaaccacactattttgatagtacataagcgtgactctgagaagttttatctacagtcagctatacgtttgtcaatgtgaagaggtggttttcaaaaaggaaattctaataagttaactgattagataaattcacttactcttttaggttacctatgattctaggtaaaggtgttattctcccataattaaccaagttgtgttcaagactaaacatccctccagagatggttgtgaatggtctataggtggctttcattaattcaactctcaaaaggcattatttggcaattacagcatccaggctctgaagacagtgtccaattaataaacattacagcattgatattttcttgctgtcaggtagttctcaagttgccttagaaataggggtcacctctgaggacagagagaagagaagggcaaagagttagggcagtgctttaggtctttagtgtttatttctttacccagagaagtacaggaaaaatataacaaaaatgttatcattgtaaaatctaaatggtgaacatttcaatgttcgccatagtacttacagcatttttagtacatttatattttgtaatttaaatttttggggktttttttgcctcccaagtagctgggattaaggcacctgccgccacgcccggctaatttttgtattttttagtagagacagggtttcaccacgttggccaggctggtcttgaactcctgacctcagatgatccacccgccgcggcctcccaaactgctgggattacaggcgtgagccaccgtgcccagtcaatttaaatgtttttaatttcacaacttacattctagcttcaaaaatatattttacattattacgaaccactcaccaagattttatggccagatacccaaattcatctcagtctccaagtgcaaattttaaaactaatttcttccatcattcaattcaagcagaatggtagagtagtattttagaacagatagaactagtaaatcccagctctgtgaacatactttctytgttaccttggccaagttatttgctaaaggcatttgcttcccatcctgtatctgtaaaatgggtatttcctattgcaaaaggtagataagtagcatgtgcttggtgggttagtgtttttccctctccagctggaaaaaaaaaacctggtgtgggggaagaaggggaacagtttgtgcaacagaaccctaagaggaaatcagctgctcatcaagataagggctgaggcataaaactgccagagggtctcaaggcaggcaaagaagaaccatgaggctcatcctgcctgtgggtttgattgctaccactcttgcaattgctcctgtccgctttgacaggkaaatcttacttcctgtgttccagtctctgtgtagaagagaattaaaggttgtttccttacagttcactttttttttttcatttgcctccrcaaagggagaaggtgttccgcgtgaagccccaggatgaaaaacaagcagacatcataaaggacttggccaaaaccaatgaggtaagcatttagagggatattttatcttttcttactgttctctaaaagatgcttcttcttattttactgtcaatgcccatgggactacaaaagactattgaacataaggggaaagcaggagctatctggataattcagccaatggccaatacttcacctgttctggktttggtcttggtttccaagactaccacttctgtttttcctcccaaaagcttttcaaacaccagctttttcaaggtaaaactatgaaatcaggagctgttcttggcctccttatcagggcatctttctcttgcctacgggtgccattccctctccattctccccactccgaccctcatctcctctggtgccataatttctcttgagtactaactgaaaacgttgaggcactggctaatatcaagatgtgaccctttccaagagcaggtacattttcaaataagacttttaaagttagatcaatcctttaaaatccaacagcctaatataattttatcatgtattcagctgctcctatttatgttgcaccagccaccttatatatgccatttcaaattctccagcagattctcaatgtcagggttataatgtaactcatttgaaacagaagagctaaagtgcaaagacaataaatt

SEQ ID NO: 13278 - DNA, 137935 bp, Homo sapiens
  misc_feature (1)...(137935): n = A,T,C or G, or insertion/deletion polymorphism (see Tables 1-2)
ccaacatttaaactattgagaaaataaaaccttgctcactggtgaccacaaatttactctgtaccttcccctagactaggtatgctgttcagcatctgttttttttctgttttttaaaattgtgattaaaaacacataaaatttaccatcttcaccatttttaagggtacagttcggtagagttaggtacattcacattgttgtagagcagatctccacaactctttttctcttataaaaccaagattctatatccattatatagtaactccacattcccccatcccttcagtccctggcaaccaccattctgttttctgtcgcaatgaatttgactactctcagtacctcatataagtggaatcatacagtacctgtccttttgtgacttatttcacttagcataatgtcctcaaggttcattaatgttgtagcaygtgtcagaatttctttcctttttaaggaaaggaagaaattcattgtgtgtatatgcaattttgtttacattttgtttatccatttatctgtcgatagacattaggttgtgtattagtctgttcttacattgcaatatagaaatacctgagactgagtactttataaagaaaagagttttaattggctcatggttcckcagactgtatgagaagcatgatactggcatctgctcagcttctggggaggcccccaggaaactgwcaattatggcagaagatgaagagggaagccaggcatgttttacatggcagaagcaggatcaagggagagaatggggaggtgccacacactagaacaacaccaaggggatggtgctaaaccattcatgaaggatccaccctcatgatccaatcacctcctaccaggtcccacctccaacaactgaggattacaattcgacatgagatttggatgggaacacagcrtttttctgagccctccatatttttccaacctctgcctgttacccaattccaaagttgctgccgcattttcaggtatctttatagcaatgacccactcctgggtaccaattttctgtattagtttcttcccacattgctataaagaaatacctgagactggataatgtataaacaaaagaggttyaattggcttatggttccagggtctgtacaggaagcatgctgctgacttcttcctgccttctggggaggccttgggaaactcacaaccatggaggaaggcaaaggggaagcaagrcatctcatacggtgggagcaggaggaagagagagagggggcaggtgctacacacttttaaactactagatttggtgagaactcactccctacatggtaccaagctaatccattcatgagaaatccaccttcatgatccaatcacctcctagtaggcccctctccaacactggagattacaatttgacataatatttggatccaaaccatatcaggttgtttccatctctttactattgtgaatagtgcttccatgagcatgggtgtgcagatgtcttttcagacaytgcctcaattcttttggatccatacccagaagtgggatgctcttcagcaccttttattcgtgtacagtcagcaacactttcatttccccacattgtctgttcactcacctcgagccatctactctattctacattcattcattcttccttctattaagggatgatgaaaacatccgaaggtaattctcttaacttcctctccctccaccttccatcctatctacatccactcacccttaccctcatgtctgtcttccacttttcacagcctatatctttcactcttcatccctttctgtcttttccaggacattgttccttcagttagcccctctctcatcattggctccttcgttccacctccaaaactcctgaagccaagacctgctgagctgcatgtgacagaaatccacctcacactggcttagaccaaaaatgaattttgctaaatcacatgacagaaaagtccaagcatgtagctggcttttgtcaaaacaggaatagtcaaagggtgccttcaggaatatcttctccttctgctttgcctggctggcttcattctctggaaaaaactccctaaaaactggcaaaatatttactgatgatgcaacatgcacgtctcatcagcttagccttccagtacaaagagcctctcgtccaataagtctttcaaaagtcccttcaatagctttcattctccaaatagggttacatgcccccaaaggaaacaataactaggagcaggacagtgaaataaacacagggcaaggcctgagttgcctgcccagccttggagatgggggtagggttggtctacctcattggttctcaggtgggatgattttgccctcccaaggacatttggcagtgtctagagacatttttggttactacaactgaaggacggaagggyttccagcctctagtaggtagaggccagggatactgccaaacatcctccaaggcaaaagacagccctccagaacaaagaattatctggtccacgatgtcaataatattgaggtcgagaaaccatagtcttccagaatcacaytgaactatgggaaagaggggatttcccagtggaaaaatctaggggcaaatcccagaggaagggacccatttagagcaacagatatccaccttcacctccatctgaaaaaaatcttcccccaaaccatctatgtttctcgtttaaactacctctcttacaccaaattttctgaaagagtggttggccttagctgtctcaaccactgtagtcattcattcaagtgatgataattatggagctccttctrtgtgctaagcattattttaggtcatgggatttggcagtcgtaaactgacatgttctcatgcagcttttattctggtgggagagacacacaataagcagattttcagttggtaataaaatgaaaaaatgataagtataattttttaatctatatgaaacaggcaaaaaggaaaggaagttctgaattaatgtgcaattttaaatagtggccaaggaaggctccattaagaaggtctcatttgagccaaataactcaaggagatgaggtagtagccatgcagagcgatatstgggcaaagagcattctaagcaaaaggaatattaaatgggaggaaaaaactgaagagaaaaatacacctgctgcacttggagaaataatttgtttgcaagctgatggtaaaaatccagcagaaagaggtgtatgatagtgctggaggaagtgagaattgctggtttccttgagtgagtgagagcaaatcgaatctagggcacaagtggagagatcacccttagacttagactgtgaacagtataattatattaacaggagagacggaggtttcatgggccaaatacaagaatttgggtggagtgatggtagaaaattgtagatctatttgattgtttctattttctcaataaagaaagaaacaaagccattcacagaaattaagaatgttggagaaggtgtcagaaataaatgtcaaaataaaaatatgaaatagtcatttaggagaatgggagaataaatggattagacaaacaatagtgggaatgtcaggcagaagtataatggtccatttgaaattatttgttactaaagtaaggctagtcattgtggctatgtgtcttttccagccacattcagtttcacaggtatgasagcaaaataatggagaattgattctaaccagkaatgttgttttgtctaatggctataataacccaagagaagggtgagggagctaacagtgggtgcaagatggtgattataawgacagagtatggaatttaacctggtagtgatgaaagtgaagacacaaaggaggtgagaagctgagagagatagcggtaggatcaatgggctgcaggcactgagacagacaaagattgctggattcagtttaacgttactagggtaaaagaaaagagttggattggtggttagagagtgggatcattgaaatcaytgagaggttgaaagtgacaagtctccgagcatgcacatgagcattagagtcagaggagagtggaggacaagaccacaggcagagaagaggtcaaggcactggaaggccagggatttgaaaatactattgctgtgaatgttgaaatcaccaggaactgtggcagaagtaacagtggagaaggtggccatgagccaggagctcaaactttcaaggaatgagggagaaagtagatactaggagatggataccagcagaagtggtaaggagtggcaccttctgatagcatgtgatgtaaaactggggaaatgagccttctcctcttctcttttcctaagcctactacaatctggctgctactcccattactctgttgagaataacttgaaatgatgatagcaaatccttaaaagaatgtcactggatgtactaaaaactgtgataagtgatatgatcaaagtagacatttcttccactagaattttgggagraagcctaatggaaaccaatgcgcacagaaagacaaatgctgtatgttattagtcatatgtggactctaaaaaactcatctcatagaagtagagggtagaatactggttaccagaggctggggaagggagagacaatgggagatggagagagattggttaaagggcacaggatcacagatagataggaggaatacattcatccttgaatacttaaccctctgccctaaatctgtcagtcctacatccatayttcttatttcagtaagtagcaccaccattcatttctaatcctggggctaactcttttttttttttcttttctgaatcatgtctccttttaatggttaaggaaaacaagtttaacataaaattagcaacaacaacaacaacaacaacaaaatcaaggtttaaagtcaaaattattttaasagaaaaacccaggcaaaatagcctacctacagrcaggcagtacatgtcaraaggacaggccacccccaataaaaaagataaaatattattttttctaccttttttaaacttaattatttaattatttctttcttttttcttttttttgtttcttttttttattatactttaagttttagggtacatgtgcacaacgtgcaggtttgttacatatgyatacatgtgcgacgttggtgtgctgcacccattaactcgtcctttacattaggtatatctcctaatgctatccctcccccctccccccaccccacaacaggccccggtgtgtgatgttcctcttcctgtgtccatgtgttctcattgtggaagctggaaaccatcattctcagcaaactaccgcaagggggctaactcttgattgctttcttctcaccaccaaccttaagaaaggaagtaaccaaaatccaatacatgagcaactgttcattccatctccaatatctttgttaattgtccactttatccacccagtcagggccgccatcaaacctcacttggatgtcggcaaaagctcccctgactggtcttcgcagtccattattgccctattctaatmtaccttccatactatacacagatttacattttttaaatgtgtatctaattgtccctcccttttaaaaaatcttacaatggcatgacgtctcaattcagggtaaggaaattgtttcttcacattccctgtacaccgtacacatcgcctgcaattgcccttcaacacggagagcaggcatttcattagctgaccttcccacacacattcttgcaaagagraaaagttaagcagggtgtttggaggcgagctgccatcatccaccgcctttgtctggaagcgcagggcctcacacgcgggatccatcggaagcccragcattgtcaakctctgctgctgcacctgggtcagcaaggtgggctctgccagcgaaactcgttagaaacaatgcaaatggggagtaaacatgacctcgcccatgaaggggaagctgtggtcaaaagcattttgtcccggaaccccgcagccctccccacactctgggcgcggagcacaatgattggtcactcctattttcgctgagcttttcctcttatttcagttttcttcgagatcaaatctggtttgtagatgtgcttggggagaatgggggcctcttctccaagaagcccggagcctgtcgggccgccggcgcccggtctccccttctgctgcggaggatccctgctggcggtygtggtgctgctygcgctgccggtggcctggggtgagaggcgggcgggcgtggggaggcgcccgggcggacgrggaacccggggccccgcagagaactcgcgtgcagcgctgagctgcgctgctctgcgcgcccgggtccgaaggcagcgcgatgggtgggctgagcgcgcgacccggcagggcggcgggtgtaggatccttctgcgcactggagaccctcgstgcttctgggtaagcgtggagttcccasgtgcaggggcttaagtcgtgacgagcgcagtggaaggcgcagatgctgagcgggtgccgcacgaaattccttgcctttgtgtattcacagcctcggctggctatagccaagacgtggcgtygatcctagygaaagggracttggggatccgacaaacctgagttctggtcctagaaacttaactgtgaggcaacttagcacacctgagtctgtttgctcttctgtaaaatggggacactggtatctctgcatcgtggagttgctgcctcagtggcattaagcctgtcgagtatctaacacagggctrtgtgtccccgagtccatttctatcccccaaccgttacctctgtacttwgctcccaatggtgtttagacaagcagtcctagggatgcaggtgttacctgacaactgccccgcatggaactgtcctcgccccccacaccaagccaccacggccatcatcaccatgcacttaattgacagcrtactttaagacagatgcatgccaggcacttgcggattagaagagcaagggaagccccagaacatgcaatgtaaccgttgcaggtagaagggacagtagatatgtttacagttcgcattttagtgatgtgtttagtacaaaataacgcctattataattattatggaaattttgaggccacatctcttcctttttcttaacttcaaataggtaaacatcttcagttagaacccttctattattatttttcggctccccagaagtcttcttggttgcctagactcactggcaacatctcatttgaagygacagtcttggttgtttttgtccagcctattcctgacaactccgggttcgcccttctctgccactagacattttacattcattatttgagtgttccttcttctctaaaagagtaaataaaataaaataaagtagaaccaagtcccgcaagagttgttattaatatttgatctccttaggcaccrgaaagtaacctgtcaggtgcagagatgtgataaaacgtacaatcttatttttaggagagaagcatgcccagtaagttaagcaatctgttgtcaacgcttaggaatttgtgtcatctttgggagtactggccctcttcttactagaatgttgttttacttagcctatgttgattaagttactgttataaacaatcccagacactattaattgcaaaaaaaaaatttactgaggttatcacaataacttccaaatgtgaaacagcctaaactaaactacctagaaattttgttgctgacataatttaaattttaaaatgctgatggatgcttccagtgtgcayggtcctttggaattttaaagaagtataagagctctgcacccaaagtgtatgcatatagaagtaggtggtggagttttatgaaatctacttattaggaagccagcgttctgctttttccagcctctgctacttaccagctggtgtcttggacccagtaagttaagtcacatcactgaccttcagtgtccacatgtataaaatgagcayaactgacatcctgatctctgagagagacgttttgaaaatcagatggtgtaatgcatgtgacagtgttttgtaatctgaaaacccccatgcatgtctgaaaaaccatgactaagaagtcgtgcaagactgcaggatcaccgaaaarcgagaaatctcaactcctatgatcaggaaaggatgagtgaaaggtatatggctttactagcacttaaagagtgaatctagaaacagattgcatacgacaaaaaatagcagaggagctaggattgttttgttattatgagttactcacagtacccgtaaagtggtatagtgctatttgaaagaggacttagattagctgcaaatagatattgcaaatgtaggacaaccmctgaaaaatgtgaaaaaaagaactataatttatatgttaataagtaagagagaattgcatcatataaaatgctcagttaaaacaataaagatggctggggacagtggctcatgcccataatcccagcactttgggaggctgaggtgggtggatcacctcaagtcaggagttcaagaccagcctggccaacatagtgaaaccctgtctctacaaaaacacaaaaattaccagggcatgatggtgggtgcctgtagtcccagctactcgggaggctgaggcatgagaatcgcttgaacctgggaggcggaggttgcagtgagtcgagatcgtgccattgcactccagcctgggtgacagagcgcaactccaaatcaaaaaaaaaaaaaaaaaaaaaaaaaaagaaacaaacaaacaaaacaaaaaacaataaagggcaggaaaagaatggaagacaaaaaatagaaacagagaacaagagaaaaaaagcaacaaataaaaaccagtaacaaaactaaagcaactatatcaacaatcattttgagtgtcaatgatcgaaatgcaccatttgaaacagatcatcagagtggatcaagaaacaagacccaactatatactgtgtacaacaagaccgttttaaatatagacaatatatatgaaaagtaaatggataaagatataccatgctaatgctagtcacagaaagcaggaatagctgtgttaatttcaaacacagcagacttcagaccaagaaaaattattagggataaagagggrcatcatataatgataaaggggccaattatccaagaagacgtaacaatatcccatatgtatgcacctgatggagagacaaaatacgtgaggcaaaacccatagaactgcaaggagaaatagatggatttactatcatagttggagacttctatgatatctttctgatatcagaaaaggtgctgaagtctccttatcagaaatgggcagattcagcaggcagaaaatccgtaaggacatacttgaattcaacagcaccatcaatccacttgggtataattgacatatatagatgacttcatccacaacagcagagcacatattctcccgcttacattcatggggatagaccacattctgagccataaaatagtacacgaattaagctttaccaggcagtgtttaatatagggtggactctggcgccctcacgtggtcctcatataggatctggtttggttatccctgctaggtwaaggtgcaagatagaagggaagttccaatttgctttctgtgctttgtggtgtattttggtttacatatgctcagatgagtggatgtgtgatttatattatctattttaatctaaaataagcttcacatttggacaggtaacatcaaaagtgtcctacacagaaatgctgggtgaagatcccagtaataaaaccaactccagaaaacaagaaaatggtagagttgacaatccctctcaccctctccgcaaagacacatgtatacacattttttgtcagaggcattaagtagaagaaatgctgtcagtctaatcacaactgatcacaactcgatgaaaccaaaaaacctagaaagtatcatgaagactgtcgaaataagctttacattcactattgtgaacagagagactcaatgtgactgttttttgtcccgttagatgttagctaatgattgtgctaagtcatgatgattaacaaagcatttaaaatatttattttatctgtgttacatttcaaaaatttatattgaggcatataatttatgttcgygtacatatataatttataaatttatatatttgaaagggcatgctctttttttaaactgatagaggtgcctaagcaaagcaagtgcaaatctattccttaaagggtaagtatgcagaatggaaagcagagtgttctttgggttgacagctcatattgcaacagacatgaaagtgatgatgtgttaattgtgcatatagcacagaatacatcaacttgctttgaatggaatatctgaaccaggagaatgtgaaagtgggctgagtcatacaagacaaaacccgaaatgagataacaatacatacccactagaatgrctaaaatgaaaaagattgaccgagccaagtgttgrcgataaggtggagtaactggaattataatatactgctatttggcaggtaaaattataacattaactttagaaaatagttcaacagattcttaaaaccttagacacacactcaacattttactcttaggtttttacccaagagaaatgaaatcatatgtccacacaaagacttgtacatgaattttcatagcagttttgtttgtaatagccaacacgtggaaacaatccaaatgtccctcaacaagtaaatggataaactaaattaagatatatttatgcaattgaatattacccagcaactaaaggaaacaatttgtatacatgcagcaacctagatggatctctaattatgctgtgtgaaggctaaaccataaaaaaaaacctgagtgatttcctttatacaataggatataaatgaagtgatttaggttatatgaaattttagaaagtcaaatcaatctgtagtaagagaaaaccacctgagttatttcctttatatgataggatataaacgaagtgattcgggttatatgaaattttagaaagtcagatcaatctgtagtaagagaaaacacattgaaggttgcctagagaaggaagtggatgtttggatggattacagaagggcatgagggaactctgtgtgggtgggatgtatgatggaaacgtttattgtcttcattttggtgatggtttcacaacgcatacatatgttataagtaatcgaattgtacacttcaaatactcatcaatcattgtatgtaatatatcttgataaagctataaaaacttttaaaattatggtaggtcttcagtttgtggattttatattaatatatttgtcataggaactagtcacaattgagggattggtaataaaggagagaaaggaaactacatcaagctttctttgttgaaggctcatatattccttttttgagctattatacaactttgctttttataattacctatactattcatatactactatgcaggtaagaatattatgtaattaaggggaaggaacttctttccaagaatggttcattcaatttgctttgttactttaggtctcattccttcctctcgttgcaagctttgctgtgacatttaccctctctcaatacagcttttggcgctaggcacttcacatggaatctcttcctttgtccggcatcaatggataagacaaatatcaaaattgtatttcatcccacatatcaactagaggaaaggtgaatgcataacactgaaaataacagcaactgttttactcagtgttttttttttttacagtatcctcaaagtgctgttatstatcaaaatcagctgtgaaaatttttaaaaatagactcctgggccctaacctagacccactaaatcagagatttgggggacatagcttggattcttgatttttttgagttttataagtaattcttcattttttgttcattgcaacaaatatgcattgagttcttataattgagtgttaagcaccaggactaagtattaatttagaggtacaaaaaaacacatcatctcttgcctttaaattatgcatatctaatatctattgagagaaatagatacttctaaaagcacacaaagataaaaagcacaaattgtaataacaaacaattattgatatgaaaggaaaagcaaagtgtcrgactagaaattattatagggtggggcagagggaagtagtttagattccaaatccctaagagggtcagggaaggcttcagatgagattgggtgtgttcagggtggtatggccataggcaggctggggaaggcttctataagaaagtgacattttagcagatgcctgaaggaagaattgaagtcagagtgaagataaaaktgcgtcacayagaaggaatgtcatagacgggaaaaatgtgtgtctttgggaaactgaaaaaggggaaagggccacaccttggtgaggggaccaagtggcacaagatgaggcagggaacatagacaagggcttccttgcttaacaactgctggcttaataaagcaaatgtgtgatgatggatacaggctgtctgggaaaaataagtaagaaatatgagctttcttggagcatcatcctttgcttcagtagaaagcacagagttaggcttccaattctgactaaagccattgacaacagggaaaaggcaaccttaggaattctcctctctgtccggggtcccgtgggcactatgatggagctcatgagatgcagatgagaagtcccaggctgaatccggggcacattcactcaggagagctgaggtcaccagtcactgaggtcatccagtgcattcccgacagcataggctcattccaagctagttctgcaaaggagcagaaaatgaactcttggaagcaaagcaagcactcccactttagcggaataatcgaatttaactcttagaagtccccttacccttttctaagggtaataatcgtaagtataatttatgaagtgccttctgtgtatgtggcagcatatactacttttgattctccctgcaaacctggtaggaaaatattattccctttatgaagatgaaactgaggctcagcaagattaagcggtttgcctaagacctcatagccaytaagtagaagacattgggttcaagattcaatctatgaacccaacatttttaatactatataccattctctttttgtattaatttcctattgctgctgtaacaaatttccacaaacttagtggcttaagacaacagaaatgtattctcttccagttctggaggcygacgtctaaaatagatccatagggctgtgttccttgtggaggctccaggggagcaggggttttcttgctctttccagcttccaggggstgcttccgtcctttggctcttggcctccttcctctaccttccaaaccagcaccatagtgtctctgaatatccttcttctgtctcctttcaccctcttgcctcccttttataaggacccttgtgatcacatttaaggtccacctagataacccaggataatctgcccatctcaagattcttaatcacatctgcaaagccstttaaccattacaggtaacaatcacaggcttcagggatcagaacatggatatctctgagaggtccttacttagcctaccacacctttccatatagattctcaaaattttagctgagcctaataagggagttcattaccattagggtccggtttagtagcaagtgcttcctttaagtgaaaaggtgaaagttgtccacttaataaggaaagaaaaacattgtatgttgaagttgctaagacctaaggtaagaaggaatcttctatcgatgaaattgtgaagaaggaaaaataaatttgtgctagttttgctgtcacacttcaaactgcaaaagttacaaccacagtgcatgctaagtgcttagctaagaggggaaaggcattaaatttgtgggcggaagaggtgaacagaaatgtgttctaattgacagctrtcaggtttggtactatctgaggttttgggtatcggctaatgtcttggaacatgtcccccaaagataagtgggtgactactgtatattcaaaataagcatttatatactggggagtaaatctcccatgttatttgtgttttatttgtcccacaaataaagtaaacaaagtagaattttaggcaagattcatttctagaggcagagatattttattataataaagaaggttgctctaccataaaatatagcaatttaaatttttataatcctaataacctcaaaatatataaaataaaagatggacaacattataaaaagaaatagacaaatgtacaataaataaaatattttaacacaactcatttagtatctagtaagacaagtactcccccmaaaatcagtaaagtatctagaagatttgaataaatattaacagattggattcactgaccttgttacaagaaagaattatacatgatgataggagagaggaagccacagcacaggcacttactgattaactaaattttgaagctgtgaaatgcaccttatcctttagtgaaagatgatataaatagcttagttgccttcaaactggcagagactttttgaatggatggatgctgattttttaaaaaggagcccatttctgaggcatcttttaaagcaggggtcctcaacccctgggccatagactgatactgtccagtggcctgttaggaaatgggcagaacagtaggaggtgagcagccaagcattactgcctgagctccacctcctgtcagattagtggcagcattagattctcataggagcagaaaccctattgtgaactgtgcatatgagggatctaggttgcatgctccctatgagaatctaatgactgatgatctgagtggaacagttccatctcaaaaccatttccctgcaccctccattcacggaaaaattgtcttccacaaaaccagtcccaggtgctaaaaagggactactgttgtaaaggaataagtccctttgctattattatttttattaagatggaatcttgctctgtcacccaggctggagtgcagtggcacagtcttggctcactgcaacatctgcctcctgggttcaagcaattctcctgcctcagcctcccaagtagctgtgcacaggcatgtgtacaggcaagtgcaatcatgctctgctaactttttgtattttgggagaggcagtgtttcaccatgttggccagcctggtctcaaactcctgacctcaagtgatccacccaccttggcctctgaaagtgctgaaattacaggcatgagccaccactcctgcaccccttggctattattgaagtgttctttttcttttttgatcacatctatgaagtatattggagagaaagagaaggtagaatgggaatttcaacagggtcacggtggctcactcctgtaatcccaacactttgggaggccaaagtgggtagatgacctgaggtcaggagtcgagaccagcctggccaacatggtaaaaccccatctctactaaaaatacgaaaattagccaggtgtggtggtgggcacctgtaatcccagctactcaggaagctgaggtaaggacaattgcttgaacccaagaggcggaggttgcagtgagccaagatagcgccactgcactccagcctgggtgatggagccagtctccgtctcaaaaaagaaaaaaaaaagtatggtaatttctccattaactttgatgctkctatggtcttgatctccaggtcaatgcaatgccccagaatggcttccatttgccaggcctaccaacctaactgatgartttgagtttcccattgggacatatctgaactatgaatgccgccctggttattccggaagaccgttttctatcatctgcctaaaaaactcagtctggactggtgctaaggacaggtgcagacgtaagtaactctggagtgggaacccccctgttagtcaaacatctgtaagatctgattcaatttgttcaaattttgtaactgagttgcatatgacaattagtttgccaaggtgcaatacatatgagaattattcttgtagatcataccttgttactgctttgagttcctggcgccttcattaaaagtttatttcatgagaaacagtcattgcaggacatgattgagggaaaatccccattcactgggggtctcccattttcatgactaaaattaagtaatgaatgacttgggacaagaaagagaagtggattaaataactaaaagatgtgacaatcttgggctttgagatctttggattataccagttgaattgaattacagataataacraagtttacatttttctgggaggcataatatggggatgaaacagatctgaaaggaaagttttttttgaaagggagctgatcctgaggcagtctggtgagtttcctcaaggtagcaaaatctgtggaaccatcagaactgcgtgtgttcctcagtaagctacaggcaggttgagaccttatgtactaaaaaaagtttttagtttactctacttggctycaaaattctgtttctttcctgtaggtaaatcatgtygtaatcctccagatcctgtgaatggcatggtgcatgtgatcaaaggcatccagttcggatcccaaattaaatattcttgtactaaagggtgagttggcatctcttgaaccaacatctcttggttcaagagttctaacacagccttactaccttctagtcacatgtcagaaaggacaactaaactattaccatctgctctttaacggcttcaacacagatgtttagctcctgactgaaatgagcaaaggtatgacaagatygggggaaaatcatctgtatccttgctggaaaccaaggcagagcatatatgaaaagtgtggcattcattgggtgggaaggaagaaaatgggggaagagtatagtcaaagcacacaaacagccttaacgcagaggggacattgctggaagaaagggaaggccattgagtaactgtgtgagagaaatcttaacggtcatagcacaagtagtttgctagggctgctgtaacagagtactccaaaacgggtggcttaacacaaatgaagtttttaaaattctgttccggaggctgaaagtgcaaaatcaaggtgttggcagagccatgctcccctctaaaacctgtaaggatggatccttctttgcttcttccagcttctggagccccaggccttccttggcgtgtggcagcagaactcccgtttctgtctctgtcctcacatggccgtcttccctctgggtctgtgtcctcacatgctgttttcctgtctgtgtatggctgtgtcgaaagtgctctcttttaataaggacaccaatcataatggattagcgcccacactaacgacctcatcttaactggattgcctctccaaagaccatatttccaaataagatcacattaataagcactggggattaagacatcaatatatttcggggtaagggggacacaattctcattcattgctggtaggaatgcaaaatggtaccatgacttggaaagataatttggcagttttttataaaactaaacatactcttaccatgttatccagcagttatccttcttggcatttatccaaaggaattgaaaactcatgttcacaccaaaaaaaaaagaaatctgcacacagatgtttataacagctttattcataattgccaaaacttggaagcaatcaagatgtcctttagcaagggaatggataaactgtggtacatccatacaatagaatattattcaataccaaaaagaaatgagctatcaagccatgaagagacatagaggaaccttaaatagtgaaccttttttcaccatcactaagtgaaagaagccaatctgaaaaggctacataacatatgattccaactatatgccattctggaaaaggcaaaactatggagacagtgaaaatatcagtggttgtcaggggttagggaagaaggggatgaatsggaagagcacagaggattttgagggtagtgaaactactctgtatgatgccataacagtaggtacatgtcataataaatttatccgaagtcatatagtgtacaataccaagagtggaccctaacataaactatggacttggggtggccatgatgtgtcagtgtaggttcctcaattgcgaaaaaygtaccaccctggtgaaagatgtttataataggggaggttatccatgtataggggcagggagtacataggaaatctctgtatcttctgttcattattgctgtgaaccaaaaactgtgctaaaacacaaagtctattttttaaaaytgcatagacataaatacatgggcatatgtgcataaacagacacgcacacaaataagtgcaggtaaaacaggaaatttgaacaaaatctgtggattataactgtttcaatatcttaatgttgatgttgcactattgttttgcaaaatgttattattaggggaaaattgagtaaatagtacctgggatctctctgtactattccctgcatgtgaatctgattatctcaaagtaaaaagttttttttttttttaaagttcctactaaatttccaaggggatgggcttcccctcagatcactaccccttttcagggagcaataaagtaatyttccttggaatgtagcaatctgtaaccaatcaaaatgctgtaactatgcatggtcccatatggaaaatataatcctgctaaaatttctctgtctctgccyatgtaagtgataccttatgtcctccactttggagtgctgaccccattcatttggagttggtctcttccaggtggctacccttaamctttgtgctcaaataaactctatccttaaatatattttctgaatctcattatttaaggktgaaaatgtgctaacctaaataattcacaggatttgttttttattctcattttttcctaacctatccacctggttcaaggcacatagattaagaaggaaaatggaaatgggactaatatcccaggcttcactgtccctcttcggggccctggggaggagactcccaaaagtctagacatgttcacccacatcctgtatgtggtttctggaaacgaaatgatcatggcttttcctgaaccatggcttaactttgtgaatccacaactctctcttccccaggagatccaaaaaggtagggtaggatgtaaaggcttcaatctgttcaagtggatatgagactccctggctccccttacaataagtagcatggattttstctctctgccttacttcctccaaacattctgaatgagaagtgttcaaaccactatttgttcaattgcttaatctactttgggacacaagtttaataaattaaaatattcttctatctgttccccttgatcagtgaacataaagttatcttttgactcatatttaaaatgttcagtattacaacactgaacaatagtatggaggaaaaaaaatgccaacttaagtttgaacttgcttcaccattcctatcccaacccccatgattagaaaatcaaaaagaacactttgagaaataacctcagtggggtcaaaagccagaggagcctccaggatcccttgttcctaagacaaacaggcaggaggaggtgcacmtataggattgcagctgttcttcacttcatttgttcacatacttcatacttgtgtttatgtctgttggcagtgcaatagaaaatgatttcatttttggtggtatactagaaggcattaaaaaacaaaataaggccgggtgtgctggctgtaatcccagcactttgggaggctgaggtgggtggattacctgaagtcaggaattcaagaccagcctggtcaatgtggtgaagcctgtttctactaaaaatgcaaaaatcagccragtgtggtggcaggcacctgtagtcccagcagctaaggaggctgaggcaggagaatctcttgaatccgggaggtggaggttgcagtgagccaagatcgcaccattgcactccagccttggcgacaagagtgaaaatctgtctcaaaaaaaaagaacaacaacaacagcaacaacaaaaatcccaaatgatattgaagtcattaataattacatcataatcactagtataatgtaatagtgcatcaagtatcttcaaaagcacccactgttctctcactatttatttgatcttcatttgtcactgttttgttgtttgaataaagctttatgttgccaggttttcttacatactcataaagcaaagttctcagctataccaataaccatgactgttatttgacattgcttcattccttcatgtatagtactatcaagtttgaccctaccctcactatgactagtttcacccaaccatctatcacaacagagagtctaacgtgaagtaaaataaatgtcataaattattccaaatttatggcacactgtgaacagtttgagacatactaattgagaattgctgactttagtattttaagtataaaatgagtgttcaattctttttgatcagcctggatttcctttggttctagttatgtatccccttccttccttccttccttcytttccttccttccttccttcctycctyccttccttcctttccttctttccttctttgctttctttctttcctttttaytttcytttttttttttgatacaakgtcttgctttgttgcccaggctggagtgcagtggcatgatcagcactcactgcagcctcaacctccctgactcaagcgatcttcatgcctcagcctcctgagtagctaggactacaggaatgtgccaccacgcctggcttttttataaattttttgtacagacagcktctcactatattgcccaggctggtctcgaactcctgagctcaagcaatcctcttgcctcagccccccaaagtgctggaattacaggggtgagccactgtgaagggcctaatttggccttctttaatgaatcttattgataaaagcccatccatgcatccrtgcatccatacttttaaggcaaagaaatacatacaacaggactgtatacacacatatacatgtatatatatgacagcttccctgcactcaagaactttgtgctatcttttaaaaaatgaaatttataggaaaaactacaattcatcttagatttgcataaaaaagtgtcataaggtaataaagaagagaaagctcatccaattgagaatgtatgaaaaagaaagtcaaaaagtcccaagaagaatgtgaaacttgggaaagtgatagatagtcctttgatgagtgtaaaaagtccctctgaatcctataagagtgtaatctctggaagtagtaatttaattgggtagttgacctgtgtctttagaatgtaacattccttattttttgcctctagataccgactcattggttcctcgtctgccacatgcatcatctcaggtgatactgtcatttgggataatgaaacacctatttgtgacagtgagttgaaatatcccttcctatttcttttaccgacacattctaatttttctctggaataataaaaatcttaactgaattcyttctrtgcaatctgtccttcacacggctgaagactgcggtaatgttctcgaatattcctatggggttcctggcaactctttctttaagttcttccttatcctgggatgtgtcttttctaattccagaagtttaaatacataaaagccttcaaacttgattttacttcaataaacgtgaaattatgttgtttctaccacctccagtataataatcatcytgcttggcaaatcagtaaagattttwaaaattgatactcttcaaggttagcgaagctgtggaagaacctggactctcatgtaccacgagatcaacacatcctcttgaaaggccccatgcactataaacctcagaagtgaacatatattttaacctayttcttaaaatttatacttaggaaataatcacacactttttaaagyagtttggtataaacttttcattgcagcattatttatattagttaaaatgttagagtaacctaaatattttaaactatggtttggaaataatctactagtaggaaaaagatgtgttcaaatgaccattataaagaattccctaagaaacataaaayagctatgcagaatgaaaataagtatatccatacactggcatggtattcagccataaaaaatgacagcataaagaagcacttaatgactagaaagagatgtattttacgtggaaaaagaatcagatgaayggcatatatggcaagatctcactttattaaaaaataatacacctatgtagtgagggccaggctgaggctgagagaaatacagtgtataacatctttgtcttactcttctctttggataactggactcctttacttttcttcttggtatttaaaaatgttacttttactagaaagtttamgagcttcagaatctaagtttacaaatgacattggtcacacatttattgctgtttatccactttaagaaacagttttgctattttgtaaaacaaattgggaaaccttccatcttatttgaaatctgtaataaacatggaattggaataggaattttcctggaaatatgaaaaagattagtaaaatagagaaaacaaaaaatataataatacacctatacctgtatytattttttatctctgtttctacttctgtaacctctctgtatccaaatcctggtaaatggcctcaagtcttcttggaaaaggctaggggaagatttacaatacatgcttttgaytgygtagcatggtgcttcctcaagagaatccagtctcccatccgttggtgctgctctgggtctataaactattcaagtctaggaattgttgatgaacaatgaacttcttttgcaataattcaagtcagacttctattcacttgacctaaaactcttacacttatacaaatcaagtaacactttagtcggctatccgtctactttggttttagagactccatgatcaattagcccaataacaatgtcctcttcaatcaaatcattctgattgctgtttcagctcaaatatgcattacaagaacccccattgtctctggcaattaagtgctgccactgggactctgccaccctgaggtcctttggtccccaagtgaattcagagaatccagttcaatggcaacagttcccattgtcattcctggcctacagagaatgaaccgttgcagaggatgctgaaactccccatgtgaatgtatttctcaagcctctggtaaaaggtctgtcttctgaaccctctactcctgcactgtgcctcaccagctctatccaaggatacaactttcagagtggaatggctgttgcttaacttctgcctctcaaatatcaggctaatttctcatgctataaccctagtccagaaccgtacagagaaagtaagtctggaaaacttaattccaaattggcctggttgacatggtgccaaaccaccaaataattataattttatttaactctttgtcttcttttctttctttccttccctccctccctcctttcctccctnnnnnnnnnnnnnnnnnnnntccctccctccctccctccctcccttccttccttccttccttccttccttccttccttccttccttccttccctctttccttattttctttcttctttaccacgctggctaggaccaccagtataacattgaacattggtagcaatagatgtcatccttgtcttgttccacatctcaaagttaaagtttaaaacatttcaccattaagctggtgtttactgtaggcttttggtagataaccatttttgaaataaggaaattatcttatatattcttcattgctaaaaaatttatgtctttgaatcatgttgaagtttatcaaacactttagttacatatattgatgtaatcatatctgtttctctttttctgttaatgcaacaaattgttttgagtacatttttgaaaggcaaatgattttaaatttcaattttacattcttaaaataaatcaactcagtcataatatttaatcatttttatatatggcaaatatgcttttatgatatattttagatgtttctattaaaatataattcatgtatcataaaagttacctttttaaattatacaatttagtggtgtttagtatattcacaaagttgtgtgttatggtctgaacgtttgagtccaccccaaatccatatgttgaaatccttacccctaaagtgatgacattaggaagtgaggcctttgaaagatgattagggcatgagagcagagccatcacgaatgggattagcgtcctaataaaagaggcccggaagagctcctttggccctcccaccatgggaggagatgctgaatctgccagtgttggtcttgaactccccagcctccaaaactacaagaaataaatttctgttgtgtacaagctaaccagtttatagtattttgttatagcagcccaaatagactaagacattgggcaaccagcaccgccaattaattctagaacactttcatcatcccattcctaacatattttagagataagactataattttctttcttgtaatgtccttaataagattttgatatcaaagctatgacagtcttataaagccagctggtagtgtttcatatatttgtttccttgtaagggtttatataagattggcattatttcttctttaaaaataattcaccagaaaaggtatgtggcctggagtttacgttcttgggaagtttttttttttccaaccattttcctgtaccatgtagacttttggctgaagtataacatatatatatayayayacacacacacacacacacacacacacacacayatatacatatatacttatatgtatatatgtatatatacgtatatacgtatgcatacgtgtatgtatatgtgtatatatgtacgtatatatacatacgtacgtatatatacgtgtayacgtatatatacatatacatatataggtatatacatatatatacgtatatatacatatacatatataggtatatacatatatatacgtatatatacatatacatatataggtatatacgtatacrtatacatatataggtatatgtatrcatatatacacactatatatatatacacatatatatagtgtgtatatatgcacacatcttaatcatgcagttcaatggagttttacaaagtaaatgtatccatgtaaacgtcactcagattaagatatagaacattatcagcaccccagaagccttcccgatgccctttcccagttatcttcccaaagaaaccactattctgatttataacactaatagttttgttgcttcctaaattttatattaaaggaatcaaaaaatagatactcttttgtgtccagcttcatctcaatgttatatttggaagagtcatttttgtttttgcaggaaggattgttgggtcttctttattattatgttgtatttcattgatgatcttgagtaccttttcacgtttgtgaagtgctattccaaacttttgcctattatttattagtttgtctattgttttgtagaagttctttaaatattctcatgttttctaataaatgtaacacaaatattgtctttcaggctgtggcttttcttttttccttcttaatgatgtcttttgtttatgaaagttctacattttaataatattcaatttakgagtcttcttttttccagttactgctttttctattctacttaagcaattgggccaagtgaggtggctcatgtctataatcccagcattttggaaggccaaggcaggaggattgcttgaagccaggagttcaagaccagcctgggcagcagagtgagaccctgtctctacaaaaaaaataaatatataaaattagctgggctcagtggcacatgcctgtagtcccagctacttgggaggctgaggtgggaggatcccttgagcacagaggttcaagscttcagtgagttatgatggtgccactgcactccagcctaggtgacaaagccctgtttcttatggatgggcaatagatctaatatcatctattaaaaagactattccttgcatagtgcaatgcgacaccaccatgaccataagtcaggtgaccttatgagtggatctcattccagagaggttctgtttcactggtttatttgccatactataagcactacattaagattttaattactatagcattacattaagatttgatatctggtagcatatatctcctaactatgtgcatcttcaagatttacttggtgattcttggccctttgcattaccatataaaatttagaatcagcttgtcaatttccacataaagaatcctacttgaatttgtattaagtttctgttgactcagtagatcaatttgtggacaagtaacaaatttacagttttgaagtttaaatttatgaatatgatatatcctcccattttgaagtcttctttaatttcttttaataatatttgttaatgtacattatagaagtcatgtacctatttcattatctttattctgacatattatttttaaaatttcattctttaattatttacttcttagatatgcacctgtttcatctcagctccagcaaatttgttaaatttacttataaattgaatagtttatctgtagattcttttgaatttgctgtgtaattatgtcatctatgaatctgacaaagtttttacatcttttcctttcttatgtcttttgtttatttctcttgctttattgcattggctagaacctccagtacaatattgaatagaagacatgatacaaggcttttaatagtcctcataaatcatgatgtatgctgtagatttttgcatgatatcctttattagattaaggaaactcccctttctttctaattactaaaagatttatgaatgttctttctaattgatcactgcatgtattgagattatcatgtttctttttcactctgttaatgtaatatattacattgattgatgtttaaaagacaracgctgaattcctagaataaacctatgttgcttgtgatgtgttatagatgattatcctatgtatgggggatatgcgtgtgtgtgtgtgcaggattgctcatatttttattgtaacattgtaacattgatttaatatttaaaatcagtcaaggtaaacctcactttgatcattgtatcatcctttggaaatattgctggattcagtttcataatattttgttcagaaaatttgcatttatattctcaagagatcttgggttataatttgcttttattttaatgtccttatcaggtttgggcatcaagattatgttggcctsataaaatgtgttaaaaattatttattttttctagtgtctggaacaatttgtgtaacattatttttccttatatgtttggaagaattcagcagtgaagcaatctggacctgagggtttgttgttgttgttgtcaggatttaatatctttaatagctgtaaaactattattttatatcttattgaattagtttgggtaagttatatttttcaaggaatttactcattttatttagatttcctaggttatcagcataatgctgtttattatagtctcatattagcctttggatgcctgtaagttctgtagtgatacccttacactcattaatttctgatattggtaatttcttttgcttctttttccttgattagttttaccggggctttatcaattttactaagcttttcagaaaaacaacttttaactttcttgttttttctttagtttatgactattttctcttttattgatttctgctttaagctttgtgtattcctccagtcctaaattcttgatactaattaatttgtttccaacctttatttttctaatatgtacatttaacctatcaatttttctctaaaactgttttatttatttccaacaatctttatatttttattatcattgtacataaaagctttctaatttcacttttaatatctcctctgacccataggctgtttagaagggcattgcttaatttctaaatatttagagatcttctagttatcattctttcattaatttaatcatttgagacatggtttattgcccagaatatggacgattttggtaaaatgttacatatgcacttgaatgtacagttattttgcttcattttctagaaatgtcatttaggaaaatgtggtttagaacagtctttttttccccctccacttgttctctcagttatggagaagcatgtgtaaaatatctgtattagtttcccagggctgctgtaacaaattaccacaaacttagtggcttcaaagaagagaaatttactctcttaacagtttggaggccagaaatccagttaagatgtcaataggattggttccatctgcaagctgttctgtgcctctctccaggcttccttccagtggctgctggcaatcgttgatgttccttggcttgtagatgcatcatttccttctctgtctccatcttctcrtcgccttctcctctgtgtgtgtcctttgctcttctgtctcctataaagacactggacatggatttagaggccaccctggcaatccagaatggtcacagctcgagatcattaacgtgattgtatctacaaagactctccaaactgggtcatattcacaggtttcagagatcaggacacagatattttttaaggaggacagtggttattcaacccattacaatccccaactacaactatgaatttgtctgtctttcctctttgttctagcaatttttactttatgtattttaaacatgttattaaatgcatgaaatttttggtttattctttctgctgaattgactattttatcataatgaaatgtctctctttacctctcataatacttcttaccttaaaatctactttgcatattaatacagctatataagctttctttattgtttttatattatatgtgttttaaatcttttactttcagcccttctttgtcttatatttaaagcttgtctcttataaacatcatatagtaaggttttgttgttttattcagtcttagttgttcattggtgtgtttggaacattaaaatttaataataaaaattaaaaataaataaatttaatatagttactgatataaagtctaagtcttggtatttgtttcatgtgtttgttcctttattcctcatttctcacattttttaattcatcaagtatttttattattctatttccccagtagcttttaagttatattccattttttattcttaaatgactactctagagatagacatccttgatttactatagtctgctaaaattgtacttttaccactctccaaacaacgcaagtaccgaaactattaatagttaattccatttatgtcctccccctctttttgtattgttgccatacgttttgcaaaaagaaaagcttcagctgaattaaatttaaaagagtttaattgagcaatgaacgattcgcaaatcaggcagcctcccgagccaaagtaagcgcagagactccagcccagctgcaatgggggaagaggatttaccgacagaaaaaggaaactgacgtacagaaaacagaagtgaggtacagaaacagccgattggttatagctcagcgtttgccttatttgaaaacagttcaaacagttggccacatttgattggccaaaactcggtgattggcgtaagagtagtctgcggtctgtttacatcttcacttgttatagtttgcagtttacagagaaacctttaggctgagcttaaactacgtaaggctttaggctaaacttgatttaacgatttacatatattctatatttcaaagacactgttgtctttataaaaacagtatttatttatatttacaccttagtgaattcttagaatttttatgttgcctcagcatccatttagaatatgtttagctttctcatgccagaagcagggcttagtcacccttaatgccctttctagttctgtacctcctcccaattttkcaacgtggtcgagccagatatctgccttatacaactgcctcctggtgaccacctctctatgggacagctagataaaacctacttgactagcgtccctgacctctgtgccctgcatggacttcgcagatatgctgccgtgaccacctctcagtcgcagcacgactgcctggaacatgtgcctgctttctttaaactcaccaattagaactccccatgggagataccttggcttgtagatgcaagatgctgggtcatactctggtccccaataaaggcattggctgatgggtccccttctctctstctgtctcctcgcgctgaccaacctctgtgtgatcttcaggcgtgccatacccccagcccgtaataaaatctttactgccatcttgtgtttcttgtaatgactgaagaggttttctctatcataaagatcctaaatgaaaacatacccgcatatgagctctttctggtgtgtttccttcttattgcaattctgtcaattctatatgaaactattttccttcagcctgaaaaagtctctttggcatttttgtattgtagagcttctgacaacaaattctttaaacatttttctaagtgtggttcctctgaaggttattgtccatgtttcctggctgcttttaaaatggattacactttaaaacagattttttacaatattattgtgttgtgtctaggtaagaatttctttgtattgcttgggtttgcacatttttttttttttggttgttttttttttttttttttttttttgacagaatttcactcttaycacctgggctggagtgcagtggtgggatatctcggctcactgcaacctccgcctccggggttcaagttatcctcccacttcagccttccaagtagctgcaattacaggcctgtgcctccatgcctggctaatttttacccttttagtaragatgggttttcaccatgttgaccaggctggtctcaaactcctgacaagaggtgatctgcccacctcggcctcccaaactgctgggattacaggcatgagccaccgtgccaggcctgtatagccttttgaacctgtaatttaatgatgtcttgcatcagtcttggaaaattctcagttattaattcttcaaatgttgtttatgctcagttctctctctcttctcatcgagggacttcagttaaacatgctaggctttattcttctatgtatttagtctgtattttttaatctttttatatattggtgcttggttttgagtattttcttctgtcctagcttccggttcattgattttctttcagagtctaacctgctattaatctcacacaaattcttaatttcagcaatcatattttacttttacaattctagactttttattttccaaatctgccctcttccytttttttttttttttttttttttttgagacagggtctcactttgttgcccaggttggagcacagtagcataatcatagctcactgcagcctcaaccttcacaggstcaagcaattctcccacctcagccacctgagtagctgggaatgcaggtgtgcaccaccacacctacacatctggataatatatatatatatatatgtatatatacttttttttttttgtcgagacagggtttcsccatgttgcccaggctggtctcaaactcctgagctcaaacgatccactctcctcagcctcccatagcgttagaattacaggcgtgagccaccacatcccaccctgttctttttaatagtttctagttcttacaagtttcaattatacccttgaacaggtctgtagttctaatgggtcagtttctgtcatcagtaattgtgtgtgttattttatctctccaaatatctggttatctttgattgtgtatcaggaattctatttgaaaactgtgtctgtagaaataatttcaaggccttagataacccatcttcttccagatggaatttttgtcattgtttctgcaggcatctggggacattagcaatctaggaccactctaattcagtctcaggaactgtgattttccagggccacccacagtaccagtacttgaagtactagttccagtctctgagacagcaaatttattttcagttaaccctgattaccagggcctagttcttgtggcctcagaacacatcagaaggtattaccaggccttccatttggggcaggccctggacttccattgttgtcccttaacttcatgagaaaatcaaaagtctgttcagcctctcagttgccccgtcctgattcagctgcccattcccaaacaataagcagcccagktgccaagcccaaatacccagctctcaactggattctcatcwtctcctagatcatggcccaggaatgcttcactagtttgttagctttctgatgctttaacagataaatatttttaattctccagtatttctagcctttcttgagggtggatggttggagcaatattttatttgaactgttgagattactattagtagaagcagagcctgaaaaatttttatttttaattttaattcattcatttctaaatttatccaattaaattcactcagttttaatttcaagtgttttgggatttgggttgaagaaattttgttctagtttatagcaacacagtatactatgtactactgctatactttaaaatgtatttaggggtttttgtggactaatatatgatcacttttacacagatatcatcttatgatatcaaacttagatttgatgaaatgagttggtaagcttcatrtcttttatatgttgtgaaaccttgaaattacatttggaagtatatttttgaatgaattttggtaatttgtatttccatttatatcatttagattttcaaaatatttaaccccctgtagtctacagttttataaatattctcatatacataaaaatatgyttaaattctttttcctactgtgtatatttgtgttttctctcatcccttatactttatcttttagcaaatgtttttgtattttatttttctaaaaaagctaaccttggttaataacaaaaatggaaattaagaaagcaaacggaaaagagtaggagaaaactgtrtaaatactataacactatgatcaaagagctatttaaaatgaaaaraatgtggattgagttaatacatgcatgcaaatactataggaaatcatatcagtaagaaaggcaggacacatcatattatgcccattgaagctacaactttataaaaatgtacctatgtgttagcaaagattaaaagcaaataatgaatgtaaaaatagctatagtttagtgactcatgagatttctgtcattcatwatttaaactgactgttatttatcctgctcttcctttttccaggaattccttgtgggctaccccccaccatcaccaatggagatttcattagcaccaacagagagaattttcactatggatcagtggtgacctaccgctgcaatcctggaagcggagggagaaaggtgtttgagcttgtgggtgagccctccatatactgcaccagcaatgacratcaagtgggcatctggagcggccccgcccctcagtgcattatacctaacaaatgcacgcctccaaatgtggaaaatggaatattggtatctgacaacagaagcttattttccttaaatgaagttgtggagtttaggtgtcagcctggctttgtcatgaaaggaccccgccgtgtgaagtgccaggccctgaacaaatgggagccggagctaccaagctgctccaggggtgagtctgactgaggcctagaagggccctgccagtgacatgcgttgctgttggatcaggagattagtatttgttcagggggagggatgtgtgctgagcagggtcgaggagcaaattttctaggtagtgaacatgaaattcagaaggtgtgtgtacatgcacatgtgctgaaattgcgaagcaaagctcaacctgggcaagggatatgatgtttctttggggttcttataaacagatctatcaattacctttgagtataataatggttgatacaaaatgagtgattcctctggccgggcactataatacaggctacatgtgaattttaatccttaaaacaaagttattaggtagttaccagttgttctatgtttgtctgtattgttttgcttgagatactgtcttgatctgtcactcacgttgaactgctgtggtgccatcatgacttacttcaacctccgcctctctggctcaagcaagtctcctgcctgagcctcccaagtagctgggaatataggtgcatgccaccatgcctggataagttttttatatattttttgtagggatagagtctcaccatgttgcccaggctggtctcgaactcctcagctcaagcaattcacccaccttggcctcccaaagtgctgggattataggcatgagccaccgtgcccggcctctatgttttayagagaatatgtgccttagacacatcagataacattctgagacagtaacttgcagacaaaactggattgcaagtccacctcactccagagccttggctttgctcatcagcattcagtcatgaaatcaaaacttactctagatactttcaaggagggagggatttcatgcaggttgtattagtctgttctcacattcctataaaaaactacttgagcctgggtaatttataaagaaaagatgcttacttgactcagagttctgtaggctgtacaggaggcatggctagggacccctcaggaaagttacaatcatggtggaaggtaaagaggaagcacgcatatcttcatatgcttggcaggagagagagagagagcaaggcagaggtgctacacactttggaacaagcagatctcgagagaactctatcacaagacagcactagggtgatggtgctcaaccatwagaaaccacctccatgatccagtcacttcccaccaggctccttctccaacactgggaattaccatttgacatgagatttgggaggggacatagagccaaaccatatcgcagctaataggtcacaaaaatgttagaagggcaggaaaagcaataggacaaaggcaaagttacgagagatcagggagctgctgtggctcccagtctacagcacaggagcctggagtgatggtgaaatggccagcccctcccactgagcaggcagctccctgtaagctgctagtgctgcaggagccaccactgctgccagaatgcagctgatattgctggagccaaagtcattggcatcgttacaattgaagctgtagctactcactgaagccatctatactgccactgcctgagccacttctagaagtagaacagattctgccatcatcctgctttttaatttggtatatatgcctccaattggcagaacctaaccagagcccagctatcaaggaagatgaacaattgtagttttaaggcttcctttgctagctgtcaaaagacagtgcagaagtgtgaggctgggggccaacagaaatttaaccagcacagcacctcaatattacatcaccaggcattgattagtccagggaaacactgggtgatgagccctgaaaatggacattacagcatcagagtatttacaaactccytaaagaagtcatttttctattccaatcccccatttgatgcttgagaaagctgaagtccagaaaagggaactgatctgctcaaagacaaaccgaaattattttttccattttataacagttttatgtaatttagttgagatccaaatgtgttctgatttcctgagttccaatcaactatattaagagagagccagcgctgcccttacaatatgttgcgtaaatatacactctcatcatggtgacagtaggtctttcagattttgttcgacagtttcccaccttctcactgaagtgaaatgaatgactaggcagcaccttgctacatagcatgaggagaggagacccatagttctttaccatcctatgtcaggtggccgctgagagaagacttgaaaggagatgagcatagatgtatggacgctctttgttgcaccagtgtgataggtgatggagggacctattagatgrgacatgggcaggggcactcctttattgcttaaaatgcaagactaaattggtgatgcctttctagaaaggaagtatgaagatacraaaatccatcattcctcccaattttgtactgggtgaacagtaattggaagcattctagaaggaactgtccattgtgaaatcttagttgcatactttagatgaaaaacaatgaattggagatacctctgttttagtcacagttgtgccacgtgtcagttctatgactgatggcaagacatcttccttgccctgtgtatttagtttatcaatgtaataaggctgttattctaactttattattatatatagattcgtaattattattcccttggccagtttaacagtgagaaaaaagttgttttcacacaattagctgtactttgtttctctctccccagtatgtcagccacctccagatgtcctgcatgctgagcgtacccaaagggacaaggacaacttttcaccygggcaggaagtgttctacagctgtgagcccggctacgacctcagaggggctgcgtctatgcgctgcacaccccagggagactggagccctgcagcccccacatgtgaaggtgactagactcttatctggcttgatatttttagcttgcgtctttattctccacatgccagtgatttctgttcatttttctttatctccagtgaaatcctgtgatgacttcatgggccaacttcttaatggccgtgtgctatttccagtaaatctccagcttggagcaaaagtggattttgtttgtgatgaagggtgagtatgagcttgcctgacctgctggacattgaaattggggttgggaatcagtctaaaaaggggagatttggtgtggcacacacacacacaccttcagagagatgaactttcgaaagtatacctaggaagaaaggaaagaaacatatagaactaataacatgagatatgaagaggaaactggaacatatattaactggcaagttcaaaggcaagtataactactggttatgaatatataagtaacacattaagcaaaaaatatcagccagaaacggtggctcacccctgtaatcctagcacctttgggaggttgaggcgggcagatcacctgaggtcaggagttggagaccagcctggacaacatgatgaaaccctgtctctactaaaaatacaaaagttagctgggtgtggtggcatgtgcctgtaatcccagctattccggaggctgaggcaccagaatcacttgaacctgggagatggagtttgcagtgagccgagatggcaccattgcactccagcgtggacaataagagtgaaactccatctcaggaaaaaaaatcatattttacaagcaaaaaggaatatgagtaatttagagagtcccaggaaaaaactggaagtaacaaaagcttattataaaaagctaggatcatttgtgaatcatttcagtaaattctttaaatcgtcaacagtgaaatttgtaataggactgaaaatgtaaaaatcagcattttttaaaaaaatccagccatatatcrtctggttaatcatgggctctgggctctgagctggggtcctgatggctgctgttaatatttccrgcaagctcattaccttgtttatgtccacctagtgctcttcgcagggtgcacatctctacacgggagctgaccggcatgggcaacaaagcacctgatcccaaaatgtaacacagaatcttggcagcctccaaatgccagcacccagtaagagttaggagggcatcggggtccagcagacattgagaattttcgacaattgcatgcaraaaataagtcctctcttctttcctttttcccctagaatattcatgcttactcttcagcagcccaaattgcccttttgagccttcttcacgccatcacagatgtggagatgaaaggacagtctgttctctcgccagctatttcccacttttccactccaaactgggagctgttttacttgctgttccagggtcagagttaggaaggcattacattagaagactgggtttctaataacaacaatgagtgatttatcaggttatcatggagtaatcagtgaaactccaagcctgggtcctgggtcaaggggatggcgcctatgtcatgaccacctttttcagttcaagcaggactatcatgtgaccaagctactgcattttgccattctatattgttcccttctggaggctgtgatttttccagaataaggtagcctgtgcaactctgccacctgctggcctaaggtcctaataatcctgaaattggggctgggccttagattgtgaactaagggttctcttggctgaaacagctcacactattcactcctattttcttctttagatttcaattaaaaggcagctctgctagttactgtgtcttggctggaatggaaagcctttggaatagcagtgttccagtgtgtgaacgtgagtagcaggagtaacatttcaggccagtctctcccttcatctgttcagtatttgacccatgacctcccctaatgtggttcttcaattttctagtttgaattattgatttgaaaattgcttattttaataatgtttggttgtgaatcaaatgtatacatcacctgtctttggaaccatctgatctgtctctgtccttctgtattctgtgttctagtgcgataaatcctatggtagcatgattctaggtcaggagagattagataatgtgaagccttaacaatttgctttctttctctctttcttttgtttcttttttctcttccttcctttcttcagttctttcttcccttctctttctctcccctttcttccttccttcctccttctttcttttccattttgttcttccatcaggtgcagtctacaatttttgtatatatttgataatacacaaatattaaacatgcctttatttaatcaatatttattgatcacatactttgtgcctgatgttcatctagccacaggagttatatcagtgaacaagatgaatgaattccctgtccccatgttgtttccactcagttggggaaagggacaagaaaaaaaataaatacgatgctatgaagatagtagagcaaagcatttaggcatgagggaaaagtgaggagcaacattagacaaggcgagcagtttgagactccttaaattctcaaaacatgtacytaaataatttatgctgagagattcataaataatgtcatttttaaaaatttattatacttttaagttctagggtacatgtgcacaacgtgcaggtttgttacatatgtatacatgtgccatgttggtgtgctgcacccattaactcgtcatttacattaggtatatctcctaatgctatccctccccgcttcccccaccccacaacaggccccggtgtgtgatgttcccctttttgtgtccaagtgttctcactgttcaattcccacctatgagtgagaacatgtggtgtttggttttttgtccttgtgatagtttgctgagaatgatggtttccagcttcatccatgtccctaaaaaggacatgaactcatcaatttttatggctgcatagtattccatggtgtatatgtgccacattttcttaatccagtctatcattgatggacatttgggttggttccaagtctttgctattgtgaataatgcagcaataaacatatgtgtgcatgtgtctttatagcagcatgatttrtaatcctttgggtatatacccagtaatgggatcgctgggtcaaatggtatttctagttctagatctttgaggaatcaccacactgtcttccacaatggttgaactaggttacagtcccaccaacagtgtaaaaatgttcctatttctccacatcttctccagcacctgttgtttcctgactttttaatgatagccattctaactggtgtgagatggtatctcattgtggttttgatttgcatttctctgatggccagtgatgatgagcattttttcatgtgtctgttagctgcataaatgtcttcttttgagaagtgtctgttcatatccttcacccactttttgatggggttgtttttttcttttaaatttgtttgagttcattgtagattctggatattagccctttgtcagatgagtagattgcaaaaatgttctcccattctgtaggttgtctgttcactctgatggtagtttcttttgctgtgcagaagctctttagtttaattatatcccctttgtcaattttggcttttgttgccattgcttttggtgttttagacatgaagtccttgcccatgcctgtgtcctgaatggtattgcctatgttttcttctaggatttttatggttttaggtctaacatttatgtctttaatccatcttgaattaatttttgtatacagtgtaaggaagggatccagtttcagctttctacatatggctagccagttttcccagtaccatttattaaatagggaatcctttccccatttcttgtttttgtcaggtttgtcaaagatcagatggttgtagatgtgtagtattatttctgagggctctgttctgttgcattggtctatatctctgttttggtaccagtaccatgctgttttggttactgtagccttgtagtatagtttgaagtcaggtagtttgatgcctccagtttgttcttttggcttaggatagacttggcaatgcaggctttttaaataatgtcatttttaaaaaatgagccccatatgttcaataatgagtagactactgatttctcctagtctccccatttataatttccccaatagaagatagaactttgcttcatttcttgattctaatgattgggaaatgtgtttctttagaaaaccatgaaattttactaaaatgtttatgttgttagaaatggacatcttacagtgctttttagagtaaaattttggaagaacataacttatatagagattcttgctgtctaagaaattcagtgctccttgaagcagcatgacaaatttctgttctaccatcatgaatgaaagctcattgattggactactcaagctttctcttatttttcataactgttgctagttaaagtagcttcttccaaattccagttctaatgaaaaatgccaattagaaatgaggaagaaactgttctaaacaaatcagcagatgctagaaaggagaaacaacttgaaacctgacccagaaagttaaaagagaaaataaatcatcaacagacctagacattttcaaaagcaaagccatctgaatccatttggagttgttttttatcatggccttactatgttttaattcactgtgacagggctattgttatcactgagattgatgatcaatatcaagaagtaatcagcgaaaggtttcacctatttaagatgattagcacacatatgtacatttgagaaatatttcctaagaatgcaggctccttcctcagcactctgtccccaggatcctgatgagtggctgacacaggacaagtgcttaattaatatatattgactaaatgaatgagcaacccttcaaaatggctatttttctttttcaaatgttttgctacttcattaaagttgtaaagtttccattgtccaggaaccgttactatcyggaagattcaggatagacaagtctcttttgtactttgcaatacactttcattgatatctcatttaatccaactcttcaaagtcctaatgtctactgtcatctccttagcatattttcagcaacaccaatcatagcaccctgtaattgcagaatacctctggtgaaactcctgaatgaaacttagagctttyrtrtkttttctagaaatcttttgtccaagtcctccagttattcctaatgggagacacacaggaaaacctctggaagtctttccctttggraaarcagtaaattacacatgcgacccccacccrgacagagggacgagcttcgacctcattggagagagcaccatccgctgcacaagtgaccctcaagggaatggggtttggagcagccctgcccctcgctgtggaattctgggttagtgctcatttccccacatcccaaatgggttcagaatatctaacccaggccctccatatttccgtaattacaatgtggtatttatttgtgcatttgccacaatggaatgccaaaccaatgatagatggttctaaggtaggtcaacacataagatcctkatgacctttgcagatggagggactgatraaaaaagagggaggcggtgagtggtgggaaagtccttcattagaatcatatgaattaaaaacagatgcctgtgaatctccttattgaaatgtttggtttagaaatctgacctagaaaatcggtggctccttctgccaggaaacgtcttgagttcccgcccatgcttgacagcctctcattggagttttgatgacttgaagtacaaggaaaccagacaggaaaggtggaacctgggcagaaaaactctttctggcttcctaaaaatgtgaaaaattaaatgggagctatctttacattaaattatatgagcattagctgagcgtggtggcaattgcctgtggtcccagctannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccaggagaaattagagcagaaatatctctttcaatagtgagagaataggaaaaagaagtagaaaagctgggaacaataggtaaagtttaggctaggccttagacttctcctgcattgtaatccctctggtttgccacatatgcatgctgtcaggaagttgatgaggtatgtacagcacaatttattttccattttttgcctttaggcaccgactcattggtcactcatctgctgaatgtatcctctcgggcaatgctgcccattggagcacgaagccgccaatttgtcaacgtgagttgaaatctctttccccattcaccccaccgtttaatcctagagttgtcctcctagaattacaaagaatggatctcatccctcttggaaatggtatccttctcatatttgaagaatccagtcatatccttaaaatggctcacagcattccaaacttccaccttcagctagaaatgcttttttattttttcttatctcaaggtctaattttttttaaactagtctttagctcacttaaacagtcccccaatttcatcctctgttgggtgaacacctcccagtttaaagagcattttatttagtgaagtcaacaaatacaaagtcagtgaaagaaaccccatatcctctctgcaagctcttagtatcacatcagatattcaagccatgcagctctttcttccttcttattctttgtctaaacaggatcatgccatcttccctgtgagttgtttggaagatgagctttctacattttggggagcaaagacgaatgagcaattgcaagctaacaaggaatataaaatgtgtataatcctgggtttagtgatggtgtgaggaaatcagcaatttcaaacccagttggtgggaggataagtgggaacaaactttgtagaaggccaataaactggctgggcactgccctacggtagagtaggacacagtattcagttcttccaagatcagacgagattgggcgcatttagggtggtatggttgtagatcagtatccagttctttttattatttctgaatctgtaagtatcatgtttattatatgtaatattrtatatttgtactttgtctttgttagttcttccagagcttttgttcttattatttaataaagatgttatactgagccacatgtggtgactcaaacgtgtaatcccagcactttgggaggcctaggtgagcagatggcttgagtccaggagtttgagaccagcctgtacaacatactgaaacgctgtctctacaaaaatacaaaaactatacgggcatggtggcacatgcctgtagtcccaactactcaggagactgagaggtgggaggattgcttgagccagagaggtcgaggctgcaatgagccatgatcgtgccactgcactccagtctgggcagcagagcaagaccttgtctcaaaaaaaatgctatgctgtatgctttattatattaatatccaatagaataaagacacatgccttctatatagagagaactaaattaataatggtgagataacagttaaattctcatttagcaggagaaataaaaacatagactataggctaggcacagtggctcatacctgtaatcccagcacattaggaggctgaggtgggcagatcacttgaggtcagtagtttgagaccaccctggccaacataatgaaaccccgcctctactaaaaatacaaaagttagccgagtttggtggcrcatgcctgaaatcccagctactcaggaggctgaggcaggaaaatcgcttgaacctgggaggcaagggctgcagtgagccaagatcacgccactgcactccagcctggggaacagagtgaggatctgttaaaaaaaaaaaaaaaaagtggactctaataatacatggacacatttagtgaaataaacttaactgagtagagcagaacttataatattttaaaactgtaagaacatgtctgtacmttagcaaatagtagatgagaatagtattttcaatatttacttctggtaatttggaattaaaaaaaaaacttttgggaaaatttacaataaagtatgattttaacaaaccagkctaggcgtggtggctcaygcttataatcccagcactttgaaaagcagaggcatgcagattgcttgaggccaggagttcaagactagcctgcccaacatggccaaaccccatctctactaaaaatacaaaaataaaccagacatggtagtgcatgcctgtgatcccagctactcgggaagttgaggtaggaggattgcttgacctgggaagtggaggttgcagtgagccatgatcgtgccactacactccagcctgggtgacagagcaagactctgtcccaaggttttgtyttggttaacttgctgtccctttttccaggaattccttgtgggctaccccccaccatcgccaatggagatttcattagcaccaacagagagaattttcactatggatcagtggtgacctaccgctgcaatcctggaagcggagggagaaaggtgtttgagcttgtgggtgagccctccatatactgcaccagcaatgacgatcaagtgggcatctggagcggcccggcccctcagtgcattayacctaacaaatgcacgcctccaaatgtggaaaatggaatattggtatctgacaacagaagcttattttccttaaatgaagttgtggagtttaggtgtcagcctggctttgtcatgaaaggaccccgccgtgtgaagtgccaggccctgaacaaatgggagccggagctaccaagctgctccaggggtgagtctgactgaggcctagtagggccctgcaagtgacatgcgttgctgttggatcaggagattagtatttgttcacggggagggatgtgtgctgagcagggtcgaggagcaaattttctaagtagtgaacatgaaattcaggtgtgtagacatgcacatgtgctgaaattgcgaagcaaagctcaacctgggcaagggatatgatgtttctttggggttcttataaacagatctatcaattacctttgagtataataatgkttgatacaaaatgagtgattcctctgcccaggcactataatacaggctacatgtgaattttaatcctkaaaacaaagttattaggtagttcccagttgttctatgtttgtctgttttgttttgcttgagatactgtcttgatctgtcactcaggttggactgcagtggtgccatcatggcatacttcaccctccacctccctgactcaagcaagtctcctgcctgagcctcccaagtagctgggaatgtaggtgcatgccaccatgcctggctaagttttttatattttttttgtagggacagagtctcaccatgctgcccaggctggtctcaaactcctcagctcaagcacccacccaccttgggctcccaaagtgctgggattataggcatgagccactgtgcccggcctctatgttttacagagaatatgtgccttagacacatcagataacattctgagacagtaacttgcagacaaaactggattgcaagtccacctcactccagagccttggctttgctcatcagcattcagtcatgaaatcaaaacttactctagatactttcaaggagggagggatttcatgcaggttgtattagtctgttctcacattcctataaaaaactacttgagcctgggtaatttataaagaaaagatgtttaattgactcagagttctgtaggctgtacaggaggcatggctgggaaagttacaatcatggtggaaggcaaagaggaagcacgcatatcttcatatgcttggcaggagagagagagagagcaaggcagaggtgttacagactttgaaacaagcagatcttgacagaactctatcacaagacagcactagggtgatggtgctcaaccattagaaaccacctccatgatccagtcacctcccaccaggctccttctccaacactgggaattaccatttgacatgagatttgggaggggacatagagccaaaccatatcgcagctaataggtcacaaaaatgttagaagggcaggaaaagcaataggacaaaggcaaagttacgagagatcagggagctgctgtggctcccagtctacagcacaggagcctggagtgatggtgaaatggccagcccctcccactgagcaggcagctccctgtaagctgctaatactgcaggagccaccattgctgccagaatgcagctgatattgctggagccaaagtcattggcatcgttacaattgaagctgtagctactcactgaagccatctatactgccactgcctgagccacttctagaagtagaacagattctgccatcatcctgctttttaatttggtatatatgcctccaattggcagaacctaaccagagccyagctatcaaggaagatgaacratttakttttaaggcytccwttgytagctgtcaaaagacagtgcagaagtgtgaggctgggggccaacagaaatttaaccagcacagcacctcaatattacatcaccaggcattgattagtccagggaaacactgggtgatgagccctgaaaatggacattacagcatcagagtatttacaaactccytaaagaagtcatttttctattccaatcccccatttgatgcttgagaaagctgaagtccagaaaagggaactgatctgctcaaagacaaactgaaattactttttccattttataacagttttatgtaatttatttgagatccaaatgtgttytgatttccyaagatcagatcaactayattaagagagagcctgmgmtgccgttacaatatgttgtgtgaaattacactctcatyatggtgacagtaggtctttcagattttgttcgacagtttcccaccttctcactgaagtgaaatgaatgactaggcagcaccttgctacatagcatgaagagaggagacccatagttctttaccaccctatgtcaggtggccgctgagagaagacttgaaaggagatgagcatagatgtatggacgctctttgttgcaccagtgtgataggtgatggagggacctattagatgggacatgggcaggggcactcctttattgcttaaaatgcaagactaaattggtgatgcctttctagaaaggaagtatgaagatacaaaaatccatcattcctcccaattttgtactgggtgaacagtaattggaagcattctagaaggaactgtccattgtgaaatcttagttgcatactttagatgaaaaacaatgaattggagatacctctgttttagtcacagttgtgccatgtgtcagttctatgactgatggcaagacatcttccttgccccgtgtatttagtttatcaatgtaataaggctgttattctaactttattattatatatagattcgtaattattattcccttggccagtttaacagtgagaaaaaagttgttttcacacaattagctgtactttgtttctctctccccagtatgtcagccacctccagatgtcctgcatgctgagcgtacccaaagggacaaggacaacttttcacccgggcaggaagtgttctacagctgtgagcccggctacgacctcagaggggctgcgtctatgcgctgcacaccccagggagactggagccctgcagcccccacatgtgaaggtgactagactcttatctggcttgatatttttagcttgcgtctttattctccacatgccagtgatttctgttcatttttctttatctccagtgaaatcctgtgatgacttcatgggccaacttcttaatggccgtgtgctatttccagtaaatctccagcttggagcaaaagtggattttgtttgtgatgaagggtgagtatgagcttgcctgacctgctggacattgaaattggggttgggaatcagtctaaaaaggggagatttggtgtggcacacacacacacaccttcagagagatgaactttcgaaagtatacctaggaagaaaggaaagaaacatatagaactaataacatgagatatgaagaggaaactggaacatatattaactggcaagttcaaaggcaagtataactagtggttatgaatatataggtaacacattaagcaaaaaatatcagccagamacggtggctcacgtgtgtaatcccagcacctttgggaggttgaggcaggcagatcacctgaggtcaggagttggagaccagcctggacaacatggtgaaamcctgtctctactaaaaatacaaaagttagctgggtttggtggcatgtgcctgtaatcccagctactccggaggctgaggcaccagaatcacttgaacctgggaggyggagtttgcagtgagccgagatggcaccattgcactccagcgtgaacaatgagtgaaactccatctcaggaaaaaaatcatattttacaagcaaaagggaatatgagtaatttagagagtcccaggaaaaattgcaagtaatgaaaagcttattattaaaagctaggatcctttaagaatcatttcagtaaattctttaaaccatcaacagtgaaatttgtaataggactgaaaatgtaaaaatcagcatttttttaaaaattcagtcatatatcttctggctagtcatgggctctgggctctgagctggggtcgtgatggctgctgttaatattcccagcaaggtcattaccttgtttatgtccatctagtgctcttcacagcgtgcacatctctacacaggagctgaccggcatgggcaacaaagcacctgatcccataatgtaacacagaatcttggcagcctccaaatgccagcacccagtaagagttaggagggcatcagggtccaaaagactgagaattttcgacaattgcatacaaaaatcatgtcctctcttctttcctttttcccctagaatattcatgcttactcttcagcagcccaaactgcccttttgagccttcttcacgccatcacagatgtggagatgaaaggacaatctctgttctctcgccagctatttcccacttttccactccaaactgggagctgttttacttgctgttccagggtcagagttaggaaggcattacattagaagactgggtttctaataacaacaatgagtgatttatcaggttatcatggagtaatcagtgaaactccaagcctgggtcctgggtcaaggggatggcgcctatgtcatgaccacctttttcaattcaagcaggactatcatgtgaccaagctactacattttgccattctatattgttcccttctggaggctgtgatttttccagaataaggtagcctgtgcaactctgccatctgctggcctcagatcctcaaaatcctgaaattggggctgggccttagattgtgarctaagtgtcctcttggctgaaacagctcactattcactcctattttcttctttagatttcaattaaaaggcagctctgctagttattgtgtcttggctggaatggaaagcctttggaatagcagtgttccagtgtgtgaacgtgagtaataggagcaacatttcaggccaatctctccccttcatctgttcactatttgtcctatggcctccctcaatgtgattcttcaatattctagtcttaattatcgatttaaaaatagtttattttaataatgtttggttgtgaatcaatatgtacatcacctgtctttgcaaccatctgatctgtctctgtccttctgcattctctgttctagtgcgataaatcctttggtcttgtgctcctaggtcaggagagattagatratgtgaagctttaacaattttctttctttctctagttttttctttcttttttctcttccttccatccttcagttctttcttcccttcttctctccttctcccctttcttctttccttcctcccttctttctttttcattttgttctcccatcaaagtgcagtcagtctacaatttatatatatatgataatacacaaatattgaacatggctttatttaatcaatatttattgatcacatactttgtgcctgatgttcatctagccactggagttatatcaatgaacaagatggatgaattccctgtccccatgttgtttctacttaggtggggagagggacaagaaaaaaaataaattcaatgctatgagacaatagagcaaagcactgaggaatgaggcaaaaatggggagcaacattagacagggtgagcagtttgagactccttaaattctcaaaacatgtacctaaataatttatgctgagagattcataaataataagtcatttttttwaaatgagcctcatatgttcaataatcagtagactactgatttctcctagtctacccatgtataatttccccaatggaagatagaactttgcttcaattcttgattctaatgattggaaaacgtgtttctttagaaaatcatgaaattttactaaaatgtttatgttgttagaaatatacttggacatcttacagtgatttttagagtaaaattttggaagaacataacttatatagagattcttgctgtctaagaaatccagtgctccttgaagcagtatgacaagtgtctgttctactatcatgaatgaaagctcattaactggactactcaagctttctcttatttttcataactcttgctagttaaaatagtttcttccaaatgccagttctaatgaaaaatgccaattagaaatgaggaagagactgttctaaacaaatcattagatgctagaaaggagtaacaacttgaaacctgacccagagagtaaaaagagaaaataaatcatcaacagacctagacattttcaaaagcaaagccatctgaatccatttggagttttttttttttttttatcatggcctgaytatgtttcaattcactgtgacagggctattgttatcactgagattgatgatcaatatcaataagtaatcagtgaaaggtttcacctatttaagatgattagcacacatatatacatttgagaaatatttcctaagaatgtaggctccttcctcagcgctgtgtccccaggatcctgatgaagggctgacacaggataagtgctcaattaatatatattgactaaatgawtaaataacccttcaaaatggttatttttcttcttcaaatgttttgctacttcattaaagttgtaaagtttctactgtccaggaactgttactatccggaagattcaggatagacaaatctcttttgtactttgcaatacattttcattgacatctcatttaatccaactcttcaaagtcctaatgtctactgtcatctccttagcatattttcagcaacaccaatcatagcaccctgtaattgcagaatacctctggtgaaactcctgaatgaaacttagagcttttgtatgttttctagaaatcttttgtccaagtcctccagttattcctaatgggagacacacaggaaaacctctggaagtctttccctttggaaaagcagtaaattacacatgcgacccccacccagacagagggacgagcttcgacctcattggagagagcaccatccgctgcacaagtgaccctcaagggaatggggtttggagcagccctgcccctcgctgtggaattctgggttagtgctcatttccccacatccctaatgggttcagaatatctaacccagccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcatttgttgtgatatgtgttttattgtggtggtctggaactgaacctgcaatatatttgaggaatgtctgtaacacgaagtgggcggcttaatacaacagaagtttttggagttccattctagagactggaaatccaaaatcaaggttttgggagggccacrctccctctgaatcctgtagggaaggatccttcattgcatcttccagcttctggagccacaggccttccttggcatgtggcagcagaactccaatttctgtctctgtcctcatatggccatcttccctctgggtctgtgtcctcatatgctgttctctctgtgcatgtctgtytccaaagttttcccttttaataaggacaccagtcacactggattagggcctacyttcatgacctcaccttaacttgattgcgtctgcaaagatygtatttccaaataagrtcacatccacagggactggaggttaagacttcagcatacttggggggagacacaattcaacctataacagagcccctttgaaaatgtcaggcatcaggtgctcacagcacacggtccagctgttggtgctcacccttgctcagcacacggtggaggctctgcctcaatctcattcttcatgggaacagctaagccaggtagcgaatacgggttaygtttgtgtcaccacaacagacactgaaaggaagtttgtggtgtccagcacayttgccagcataggcctcacagaccacarcacctagaatctgacaaaaattagaataaatccgatgtctccttttctctctttttttwaagcatttttaaatrcaattggtaaatttcctgactgtaccctmctcatcttgcattgctgaataagtgaggaacctctctatggcatgaagcagaaaaccmttgagcttatgagaagaaacaggaaatacatgtaaaagagaccagtctgaaaaatcaggagaaattttacaaaagagatttactgccaagaaaccagggaaactttcagaacactctccttttcatatttgtaacaagwttcaattgtacaaatacttctgtgaaactagccatgaagtgtgtacatgaatgaatatatgtattcagtgtgtttatatatttcatttcatacatgtgatctatatcatatatatatatcacaatgaatattgcagaaaattaaagcaaagagtaagaagagttaaccaaatgttccctgaatgcagtgagaaaagatgaaaaggagaagacaggcaagcacagtggctcacatatgtaatcccaacacactgagaggctgaggcaagagtatcacttgagcccaggagctcaagaccagcctagacaacatgrcaaaaacccatctctacaaaaaagtataaaaattagctgggcatggcagcatawgcctgtagtcacagctaggcaggagactaaagtgggaggatcacctgagcccaggaggctgaggcttcagtgagccttgatggcaacctgcactccagcctggatgacagaatgagaccctgtctcaaaaaaggaaaaagagaagacatatgtaacacagtgtcaggattcaaaatacatgtagcaaaaattccagaagggtaagcaaataagcccatacctagccatcactagggaaacttctgtgtttcagggatagagaaaaaaactctgattccagaaataaaatgtgaaaatataatacccgcaaaagaaataagtttattgacaccacattgattctatacaacactaaattgtagaagatagcatttytcttgagccaagctaatatkcacacctagaggctccagatacacattaaaggataagaaagacacaaaaattgtaccatttaagtatgtttcccaggtaattcataagcaaatttttaaaaaggagaatgatgaattccaaaggaaatctcaatgagataggatattggtaaaaagaaaaaacaacaataaaaaaatacacacaaaaactcggcaatgtaatcataatttactaataatctctctaaactcatagaacrtatcaataaaactagaaaatgtgagacagcaagaaaaggtaggctaaacttacattacagaaaagatgagtagactgactatatagagtttgactctaaaattgagaaaataggtttaaatakctgttgtgtgcatatccatgtgtgtaatatacatgyacatatataaaatgaaattcctcattagaaaaaataataagtttaatttccaaattattagaataactaaaacagctgaatctatctcttccatatagcaagtgagagggaaagaaaaggaaagacaaggaatgcatttgtctcttccaccagaaataagccccctcatttttgggtcaggtcattttattcattgctttctccacatcctcatcattgggcatcatgaaatcaatgaaaaaggcagtgaaagaatgatgatgaaagcaaatcaaatgtatcatttatctcaatacatttggtttaatcctcttgttgaaaaacaaagtctcttagacaagatcaaaagcaacaaatcttgtatttataaaaaacatgtctcaagtaaaatgacatagtattatacacacacacacacacacacacacacacacmcaaattaagtgaaaatgcaaacaaaaaaaggcaaaaataatatttagagaaagatagaatttaagaaaaaaattgtcaaactggtctacaaaataattgttttattttcgtgccagttgcagtccacagtgaagccaagatattaagaagcaatgtgggccaggagaagttagagcagaaatatctctttcaataatgaaagaataagaaaaagaartagaagagctggaaacaataggtaaagtttaggctaggccttagacttctcctgcattgtaatccttctggtttgccacatatgcatgctgtcaggaagttgatgaggtatgtacaggacaatgattttccattttttgcctttaggcaccgactcattggtcactcatctgctgaatgtatcctctcaggcaatactgcccattggagcacgaagccgccaatttgtcaacgtgagttgaaatctctttccccattcaccccaccattgaatcctagagttgtcctcctagaattacaaagaatggatctcatccctcttggaaatggtatccttctsatatttgaagaatctagtcatatccttaaaatggctcacagcattccaaacttccrccttcacctagaaatgcttttttttttcttatctcagtctaatgtattttaaactagtctttagctcatttaaccagcccccaatgtcctcttctgttggttgagcacctcgcagtttgaagagcattttgtttagtgaagtcaacaaatacaaagtcagtgaaagaaaccccatatcctctctgcaagctcttagtatcacatcagatattcaagccatgcagctctttcttccttcttattctttgtctaaacaggatcatgccatcttccctgtgagttgtttggaagatgagctttctacattttggggagcaaagacgaatgagcaattgcaagctaacagggaatataaaatgtgtataatcctgggtttagtgatggtgtgaggaaatcagcaatttcaaacccagttggtggcaggataagtgggaacaaactttgtagaaggccaataaactggctgggcactgccctacagtagagtaggacacagtattcagttcttccaagatcagacgagattgggcgcattcagggtggtatggctgtaaatcagtatccagttctttttattacttctgaatctgtaagtatcatgtttattatatgtaatattrtatatttgtgctttgtctttattagttcttccagagcttttgtycttattatttaataaagatgttatactgagccacgtgtggtgactcaaacttgtaatcccagcactttgggaggcctaggtgagcagatggctttagcccaggagtttgagaccagcctgtacaacatggtgaaatcaygtctctacaaaaaatacaaaaactaaacaggcacggtggcacatgcctgtagtcccaactactcgggagactgagaggtgggaggattgcttgagccagagaggtygaggctgcaatgagccatgatcgtgccactgcactccagcccgggcagcagagccagaccttgtctcaaaaaaaaatgctatgctgtatgctttattatattaatatccaataccataaaggcaaatgccttctatatagagagaactagattaataatggtgagataacatagttaaattctcgtttagcaggagaaataaaaacataractataggctaggcacagtggctcatgcctgtactcccagcacattrggaggctgaggtgggcagatcacttgaggtcaggagttcgagaccagcctggccaacatggtgaaaccccatctctactaaaaatacaaaagttagccgagtttggtggcgcatgcctgtaatcccagctactcaggaggctgaggcaggaaaatcgcttgaacctgggaggcgggggttgcagtgagctgagatcacgccactgcactccagygtggggaacagagtgaggatctgttaaaacaaacaaacaaacaaamaaaaaacacatggactctaataatacatggatacatttagtgaaataaggttaactgagtagagcagcactcataacattttaaaactataagaacatgtctgtacattagcaaatattagatgagaataatattgtcaatatttacttctggtaatttgaaattaaaaaacaaaactgttagcaaaatttacaataaagtataattattagaaaccaggctgggcacggtggctcacgcttataatcccagcactttgaaaggccgaggcaggcggattgtttgaggccaggagttcaagactagcctgcccaacatggccaaaccccatctctactaaaaatacaaaaataaaccagacatggtrgtgcatgcctgtgatcccagctactcgggaggttgaggtgggaggattgcttgacctgggaagtagaggttgcagttagccatgattgtgccactgcactccagcctgggtgacagcaagactctgtcccaaggttttgttttggttaacttgctgtctcttttccaggaattccttgtgggctacccccaaccatcgccaatggagatttcattagcaccaacagagagaattttcactatggatcagtggtgacctaccgctgcaatcttggaagcagagggagaaaggtgtttgagcttgtgggtgagccctccatatactgcaccagcaatgacgatcaagtgggcatctggagcggccccgcccctcagtgcattatacctaacaaatgcacgcctccaaatgtggaaaatggaatattggtatctgacaacagaagcttattttccttaaatgaagttgtggagtttaggtgtcagcctggctttgtcatgaaaggaccccgccgtgtgaagtgccaggccctgaacaaatgggagccagagttaccaagctgctccaggggtgagtctgactgatgcctagaagggccctgccagtgacatgtgttgctgttggatcaggagatgagtatttgttaagggggaggtatgtatggtgaggagggtgggaaagtaagttttgggggaagaagcatgaaattaagaattgggggtgtgcatgcacccatgcatatgtgtcttcatttggaaagcaagaccttaattagccaagaaaaaagctattttggactcacctattatttgattctcagggcaaagtaccagctgcaatctctctcaagtatattgaaaaattatatggactttctctatgatcagctatgtgctaagcactttatatgcattttctcattcattatttacaacaacactttgaaattgtgctattgtattatccatttaatagtgacatcagcttgatctttcagaggttaaataaattagctaagtcacatgttctaagcgagacacccaggattttaaaatgcaagtgtatcagaccccagagtctgaatgttttggctcttgccatactttcatcagtatccattgctgaaagaaagagactggcttacaaagacagaaatcatagcctcagaatagacaaagaccttagagtttgtctataatggtctgcctcctacattttattttgattttattttatttaaaaactatttattagagttgaygtcccactctgttgcccaggctgaagtacagtgatacaatcatggctcactgcagcctcagattcctaggctcaagccatccacgtcctacattttatccctaggagtctaagtcaagagtgaaagtaacttgttcaaagtcagttaaatatttctaaattcatgtttaatgaggtatagattaggttgatgttaaaatgggttctgatgccctaagcatgaacgaacaggactataaataaaggcagatgttgagtcaaatactctccaaataatatgccctctcgtgacaaaggactgtcttatttaakggcttgtgtttttgatggctcatcttgtctactgatgccacaatagctggcttagcagctgtgtaggaggtgttatggttgatacatagggacagagaaggagcttacgattcttctaccaacccatgttagccttgtgcaaccactgagctgggaagatgaacagataaagggatataaagacggatgtactgaggcaggagatgggcagggcttgtgttctggtcacaatcctgctgaccaaaacaggctctggcccagacaggatgaagtgaaaaaacagcaggaaccagcagatggcgatgaaagcaattgctagctgccctcatagtcccatcagcaccatgacagtttacaaatgccatggcaacgacctagaagttaccgcccctttcctggaaagttctaaataactcgcccctcaatctgcattgatccaytccttaatttacatgtaacygaaatgggtttacagcagtataaacacagttgcctgccaggaacccttatgttgctgactctgggtgtgctgcctgtgagttagccctgctctgcaagaagcagtgcctttcactaacagattgctgtctagcaccactggctcatccttgaattctgtcctggatgaggcaagaacccttccagagtaagccccaatttaggggcatgcctgtcccgaaacagtatgactgtactttagtcattggtgtgcaatcagagaaatygggggaaatctgtaaaacagatttggtctcaggtgacagtctcattacctgaataacaatggtacaaatygggattaccttcctaggaaatatgtagatggagaatccaccaatactgataacttcacattggatagccagagctaggagaaaatacctcatgccctgtagatttacaagtgaatttggggccttgtgctagggagaattgggttctatttctctacctctgactagctatgaggtcttcaggaagcataggaaattcccccataactaacaagtactctggaactgtcctttccacagtgtgtcagccgcctccagaaatcctgcatggtgagcrtaccccaagccatcaggacaacttttcacctgggcaggaagtgttctacagctgtgagcctggctatgacctcagaggggctgcgtctctgcactgcacaccccagggagactggagccctgaagccccgagatgtgcaggtgcctcaactctctggcttccagatttctctctttaccccacacatggaggtcttactcctattttttcttttttttttttttcttcttctagtgaaatcctgtgatgacttcttgggtcaactccctcatggccgtgtgctatttccacttaatctccagcttggggcaaaggtgtcctttgtctgtgatgaagggtaagtgtgacccagaattcagatcagggactcagcactgcagagtgactcttgagcttaaggatcaatccaaaaagagggctgacctaggagaagaagaatccagggagattaacctctggaagtgtagctttaaaataaaggtagggactaagtggcactactatcaggagataaagagataaagaaaaaatggcgcatataactgagtgtcaagtacaaacagaaatacagtcaccagtccagaaaaggggaccaacctggtggaaaagaagtactagaggagactaatatctgaaacaatgattggaaagtgtggtatgaaccagctggatccatgaacagaagtttaaaaagcaaaaagctcaactcatttgatttctcacttatagaggctcagaagtaaaatcattttggaaaacgtgcagcttccagtaaggcacaaaggaaaaacaatggccgaaatacaaaagatcttgaaaaaaaaagtgtgtatatatatgtatacatacgtatacatatggacacgtatatgtatacgtatacatgtacatgtgtatacatatgtgtatacatggacacgtatatgtakacgtatacatatggacacgtatatgtakacgtatacatatggacacgtatatgtakacgtatacatatggacacgtatatgtatacgtatacatatggacacgtatatgtatacgtatacatgtacatgtgtatatgtatacgtatacrtgtccatatgtatacgtatatgtatacatatgtatatatacatatgtatatacatatatatggaacatatgtatatatacatatgtatatacatatatacatggaacattagatgtatgaataaataataatttgcagacatgaagagataaataaatattctaggggttgttaagaaaagtttgatatataagagaaagttgtatataagataaaataacatgcaaagattatttcacaaaacttttaatcaaataaatagtggaatttggaataggaacgaaagagtaagtagaaatattctaaattccaattacatgtgattgacagctctgccagctattattgctttgtcctcactgaaagctacactttttccaaaatgatttggcttctgagcccgtcaatgagaaactaagtgagttgagtgttttcacctgtgctttagcttgagcagtaaaatgttaattaacttaggaattctcagggaggaggttgagatctgtcacgaagggaagagagaaatggtgcattcatccagccactactgctttgttctttaggtttcgcttaaagggcagttccgttagtcattgtgtcttggttggaatgagaagcctttggaataacagtgttcctgtgtgtgaacgtgagtagatggaatacttgttcagtctggatctttctgtttttttcttaatatagtttgccccatgggattatctattgtttgtcccgctgtttgtgcccgcttttgatagaaattgttctttgttggaatagatacaagcaatgttttgggraaaaataaacatgagaatcatgtgttttgggtaccatcctataaatatttatgaggagagtctgtgctataaatagagagaaatgcttcatagaaataaatgtatggcaagatgctaggctaaatttttctcttctttcctgtcaaaagtaatagtcatacttcaacttttcagttcttccctcaatcatccatttagtcatatactcattctttcaacagaaaattatttgagcacctactatgtgccaagcaatcttctgggaactggggatatacctataaacaagacagataagtccatgtttaagtttttgtgcaaggataaagacaaaaatcaaagacatgaatagaaatgttcaaatgatactaagtgttattaagaaaatgctcttaattgagtcagtgctgtcaattgagaatgtagctgaggacccaaaaggcaagtgtagcccagcaaacctctgggtgtagctgagggttcaaaatgggaggctgttgcagcaatctaatcagagatgttggcccaggatagcaattgggaaaggtgatgatgagaagtgatcaaattctggatatattttgaaggtgcagatgacaggatttggtgatggttagcttagatagagggtgtgaaagaaagagaagaaacatagccagtttccaggtttttggccagagcaaccgccagggtagaatttcccttagctgaaatgcaggggactgcatgaagtttgggaatgggggaaatcaaaagttaagcttgggacataactttagtgttcctcttagatatccagatggatatgttggagagtcccaggctgcccatagatakgtagaagccatcattgtatctgctatgcttgaaatcaggactgaaagagatcttcacctagggagtgagtgctgctagagaacagatgcatggactgagcctggatgtccaggattaagagttgcaaaggtgagaaggaatcagcaaaggggattatgatgaagcagccactgcagtaagagaaaacacaggagggtgaggtgccctggaagccaagtatggaaattattttaagggattagactaatcaactgtgtcaaattctatagagaggtcaaattaggtgagaacagaaaattgatctttgggtttagcaacttggaggtaacaagtggaagtttcagtggagtgctggcaaacactgattggaatgaattctagggagaatgaatgggaggaactgtaacagatcatagacaatattttagaggagttttcatgtaaagagagtagaaataggactatagctgaagagggaaatgacagcaagaggtttgcttttgatttttaagagggcagaaaatagtgtgttaaaaacagaaacactactatgtcccatctatccatttacttcttcactaaatcaatcagggtattgcttccccttctgatcatagctattaaaaatacatgtttacaatagaattttgctcatatgaatactttgccttaaatcatttcaatgtcttgtattgatttatatgatgaaaatgataatttcatcttacattgttggaagtcagctatttgacaatcttaacttccctggaatagttaagaagtatgaaagaaaagaaaaagaaaataccctcatgaacccaacatatacctgaaatcgcttactagagtgtaaacattggttaagctattttaacctttgattagtttatctatarttcttttaagctgtaatatcctcttcccaaattcaaagcaaattagaaaagggaaggagtgtccccaaatagaggcattccaaggaataaatgtgtttctttaatgaaaaaaataaataaataaacccttaaaaaccaatgagtatctcaaaaaaccgtaacattcttgagccttttgaaacacatacaggagtacatagcatttttttttcattgtgacagcattactgcaatctttcatctgtattttgaaaatcatagcctggcatcatcaagaaarattaaatcactgatatacaaataataaatgtataatatattttagaaagatgtctctaggatgaagactcttgatgtcaaagatcatatttatcctgtgctttaaacagtacttgacatacagcagatattcaaaaacatgcttgttgaattaatggatgattcccctttaatgtgactgtgaagatttttatttactttaaaggaatatactctttattattcagaaatattaactatctgaaaaatttaggatgcttaatttgggaaaggcttttgtaataaacattgatttagttgtcatttcatttagctccatcttagcagaggcctaatacatttattttgcagtttctactttccttaagaagaaaagtacgcttaattggcaacacagtcacagtatgacaactgtagaatcrccttggattatactttaaaattttttatggaattgagagctcttgttttctttctagatatcttttgtccaaatcctccagctatccttaatgggagacacacaggaactccctctggagatattccctatggaaaagaaatatcttacacatgtgacccccacccagacagagggatgaccttcaacctcattggggagagcaccatccgctgcacaagtgaccctcatgggaatggggtttggagcagccctgcccctcgctgtgaactttctgttcgtgctggtcagtatccrcttccacatatcctaaatgggttcagaatatgtggacccaatccctcatgtttctgtaataagactatggtatttgtttgtgagcttaactttgtcataagtgtaaatgtcaaaattacataccatagctaaaacagatgggtttcagcagcgccaaggtatgtttgaatctataagatgaaaactcttcttgctggtggagtggaagagggtgggaaaaagggactgagggaggggtggagggaaggcagtaaggcacagttatgtaaatcaggaagaaaaatgtattcactggagacgacatgaaaacawctgcctctgaacactaaccagtatctgtataattgacagtctccataagttcatgaggggtacatgggcatgcaaagttcaaaattggaaatgtggatattatttagctaaggttttaaactagtgttctgctgcatgggctaagtaaccaaaaagactctctttgtcttgacttaaagtttgtccacttgtcatcttgcctccaggctgtcttaatctttgtacttgaactgttccactcagggggtaagaagcaaggaaagagtagcscaaagaaaagagtaggaaaaggaagaggctatttcttcctaaggaggggaagaagttgcctggtccttcagggcaaacattaggccttttccagagcagaaactggagtagattagggatgtggcaccagccttggaatattccattatccacagggaagccctgagagacaagagccagccaaggtgaaaagactaaacctgatgaaaggcatttaacctttctttgacctttactctccaactgagtggtacccatcagaatgcagtaaatttttttaatgtaaatgcctagaccccagtgcaggcttaatgaacagatggaggaagccttctccaaaaaggaggtaatggagttcagactctatttgaaaatatgcagcacatggctgggcacagtagctcacacctataatcccagcactttggaggccgaggtgagaggattgtttgaggccaggagttcaagaccaacctggccaacacagcaagctcctaactctacaaaaaataagactgaaaaattgtaaaaactgtaaaacaaaaaaagtaaaaatatgcagcacacaatatactctctcagaaagaagacatagcttcttacagaaggctgatggcttagtctgttttgttctggttctttttttgttttgttttgtgtgtgtgtgtgtgtgtgtgtgctttttttgagagagagggtcttactcttttgcccaggtggagtagagtggtgcaatcatagtttactgcagccttgacctccctggctcaagcaagcctcccatctcagcctgccaagtaggtgggaccacaggtgcatgccaccacacccagctaattcttgtattttatgtagaccggttttcatcatgttgcccaggctggtcttgaactcctgggctaaagcaatccacctgccttggcctcccaaagtgctgggactacaaggcgtgagccaccatgcccagcctattttgttctatctttaaatgcctggtttagcatcagaagaaaaacactgtattagtttcctagggctgctgtaacaaattaccacaaactaggtggcttaaaacaaaagaaacttattatttcacagttttgtaggctgaaattgagatgttggcagaggtattttcccatcttctaaggctctggaaaataaccaattctttacttcttccatctgctgctggttcctgggattccttggcattccttggtttgtggatgcatcattcaaatccctgcctccatcatagccttttcccctgtgtctctatatgtcaaatccctccactttttccctgatagggacaccagtcattggatttagggcccactctaaataaaagatgatctaatctcaagaacctaatcttaattctatctgaaaaaccattattccaaataagtttctattctgaggttttaggtagagatatcttttgggagaacatcattcaactcactacaaggggtacctgctatgaaaggccagagaggcagcttatgatgggcaccctgagaatggagtatggagagagatgataaaatatgtcttgctactcakgagtgaattagcacaaacacatgaagatttgagtggttaactgaggatataggcactccgataggaggtcagaatgtgaaactacaagctgaagttcttgctttggtgaaataagggaagaaagatcagaaagctgagtggtcttccaaatagtaaaaaaaatcctgctgagtagatgcattgaagagcttcatcccaaggtaacatcaaggagaagaaaatcttttgctattcttgtaagtctctttgtttctgtgatccacctatcagcttaattgaagagaaagaggmggtagggtggaagtctctctgctaactttgatattcctgtggtttttctctccaggtcactgtaaaaccccagagcagtttccatttgccagtcctwygatcccaattaatgactttgagtttccagtygggacatctttgaattatgaatgccgtcctgggtattttgggaaaatgttctctatctcctgcctagaaaacttggtctggtcaagtgttgaagacaactgyagacgtgagtaacccctccctgggaactacttcatgtctgttaaagcataggtgggaccgggcttggtggctcacgcctgtaatcccatcactttgggaggccaaggctggcagatagcttgaactcaggagttcgcaaccagcctgggcaacatggccaaaccccacgtctacaaacaacaacaacaaaaacaacgtaggtgggatttgattcaatttgctcaaattttggaagcaagatgtctatatttgcccaagatattttgataaaggaaaggatggtcttgtayatcaccccttcttcttgcttgtagttcctgaaccttgactagatgctcatttcatgagaatggctctcacaaaagaattagagagaaaatttacattcactgtagatcatccttgatggctgacaccattaaatgaatgaaacaggggtacaaaagaaatttatgtgagttgcagtgaactgtgcttggctaactaaaaataggggagacatcccaaattttgaggcctttgattttggctggcggaatgagagtacaacactttagccataaatgacttgttttgtttttgttttgtttctgctgttgctgttgtgttttttgtttgtttgtttgtttgtttctgagatggagccttactctgtcacccaggccggagtgtagtggcgcgatcttggctgcaacctcctgggttcgagcaagtctccctgcctcagcctctcgagtaactgggattacaggcacccactcccatgcccagctaatttttgtattttttagtagagatggggttttgccacgttggccaggctggtcttgaactcctgacctcaggtgatctgccggcctcggcctcccaaagtgctaggattacaggcgagagcccatacataacctttattaggaggtgcaagatagtctttttcaaagttgtgttcgtagctacatgattctgaagttgtctgccaagtttcctcaaagcagtcaattccatgaaacaattggaactgtatatgctgtttagtatgccacactccagtctgaaccttacaaaggtaagttgaactctatatttaatcccaaattctgcttcttcccctaggaaaatcatgtggacctccaccagaacccttcaatggaatggtgcatataaacacagatacacagtttggatcaacagttaattattcttgtaatgaagggtgagttgagaataccatctcttgaatatgagttccagaacagcagagccaacttctgacccagtctcagatagacaaactaaactattgctccctttactttaaaagcaagcaataggacttatagatggagatgatacgttggacatagccatatgatcaaaggaatacaaaaaagaaggtacaatatgtattgtattgtaaaccagaggagggcaacatgttcctgtcaaaggtgrtacatgtgaaacctggtcaggcattcattggatgaaaaggagcagcttacaaataaggaaaaggaaaaaaggtagttgaaccatgtaaacctccttaactgagatcagtaggtaatacagttgagttggaggaccctgaagcagagtttgggagggtaaacattaattgtaacagcagctctggaagagtatgcatcaaagtgcacacagagaggagacattatggggttcttgctcttgacttctccttgggacaagtagccacaccaaaagccattgcctcaactgagaaggggcttttaaaaactctggagtrgacctccatcaaactccagcagacctgcagcagaggggcctgactgttagaagataaactaacaaacataaaggaatagcrtcaacattaacaaaaaggacgtccacatgaaaaccccatccaaaggtcaccaacatcaaagaccaatgatagataaatccacgaagatgaggaaaaaccagcacaaaaaggctgaaaattcccgaaaccagaatgcctcttctcctccaaaggatcacaactccttgccagcaagagaacaaaactgggtggagaatgagtgagttggacagattgacagaagtaggcttcagaaggtgggtaataacaaactcctctgagctaaaggagcatgttctaacccaatgcaaggaagcgaagaaccttgaaaaacaggttagaggaattactaactagaataaccagtttagaaaagaacataaatgacctgatggagctgaaaaacacagcacaagaacttcatgaagcatacamaagtatcaatagccgaatcgatcaagtgaaacaaaggwtatcagagattgaagatcaacttaatgaaataaagcwtgaagacaaaaaaagaatgaaaaggaatgaacaaagcctccaagaaatatgggactatgtgaaaagaccaaacctacgtttgattggtgtacctgaaagtgacggggagaatrgaaccaagttggaaaacactcttcaagatattatccaggagaactgccccaacctagcaagacagtccagcattcaaattcaggaaatacagagaacrccacaaagatactccttgagaagagcaaccccaagacacgtaattgtcagattcaccaaggttgaaatgaaggaaaaaaatgttaagggcagccagagagaaaggtcgggttacctacaaagggaagcccatcagactaacagtgaatctctctgcagaaaccctacaagccagaagagagtgggggccaatattcaacattcttaaagaaaagaattttcaacccagaatttcatatctagccaaactaagcttcataagtgaaggagaaataaaatcctttacagacaagcaaatgctgagggattttgtcaccaccagacttgccttacaagggctcctgaaggaagcactaaacatggaaaggaataactggtaccagccactgcaaaaacataccaaattgtraagaccatcaacaatatgaagaaaccacatcaactaatgggcaaaataacaaatcagcatcataatgacaggatcaaatttacacataacaattctaacattaaatgtaaattggctaaatgcccccagttaaaagacactgactggcaaattggataaagagtcaagacccattggtgtgctgtattcaggagacccatctcatgtgcaaagacacacataggcgcaaaataaagggatggaggaatatttwccaagcaaatggaaagcaaataaaagcaggggttacagtcctagtctctgataaaacatactttaaaccaacgaagatcaaaagaracaagagcattacataatggcaaaggatgcaacaagaagagctaactatcctaaatatatatgcacccaatacaggagcacccagattcataaagcaagttctgaaagatctataaagagacttagattcccacacaataatagtgggagactttaacaccccactgtcagtattagacaggtcaacgagacagaaaattaacaaggatattcaggacctgaactcagctctggaccaagcagacctaatagacatctatagaactctccaccccaaatcagcagaatatacattcttctcagcaccacatagcaattattctaaaattgaccacataattggaagtaaagcactcctcaaaatgcaaaagaatggaaatcataacaaacagtctctcagaccacagtacaatcaaattagaactcaggattaagaaactctctcaaaactgcacaactacatggaaactgaacagcctgctctgaatgactactgggtaaataacgaaatgaaagcagaaataagtaagttctttgaaaccgatgaaaacaaagacacaatgtaccagaatctctgggacacagccaaagagtgtttagagcactaaatttatagcactaaatgcccacaggagaaagcagaaaagatctaaaatcgacgccctgacatcgcaattaaagaactagagaagcaagagcaaacaaattcaaaagctagcagaagagaagaaataactaagawcagagcagaactgaaggagatagagaaacaaaaaacccttcaaaaaatcaatgaatccaggagctggttttttgaaaagattaacaaaatagaccactagccagactaataaagaaaaagagagaagaatcaaatagacacaataaaaaatgataaaggggatatcaccactgatcccacagaaatacaaactaccatcagagaatactataaacacctctacgcaaataaactagaaaatctagaagaaatggataaattcctggatacatacaacctcccaagactaaaacaggaagaagtcgaatccctgaataggccaaaaacaagttctgaaattgaggaagtaattaatagcctaccaaccaaaaaaagcccaggaacagatggattcatagctgaatcctaccagaggtacaaagaggakctggtaccattccttctaaactattccaaacaatagaaaaagagggactcctccctaactcattttatgaggccagcatcatcctgataccaaaacctggcagagacacaataaaaaaggaaaatttcaggccaatatccctgatgaacattgatgcaaaaatcctcaataaaatactggcaaacraaattcagcagcacatcaaaaagcttatccacaacgatcaagctggcttcatccctgagatacaaggctggttcaacatacgcaaatcaataaacgtaatccatcacattaacagaaccaatgataaaaaccacatgattatctcaatagatgcagacaagggcttcgataaaattcaacagcccttcatgctaaaaactctcaataaactaggtattgatggaatatgtcccaaaataataggagctatttataacaaacccaccactaatatcatactgaatgggcaaawgctggaagcatgcgctttgaaaaccagcacaagacaaggatgccctctctcaccactcctattcaacatagtattggaagctctggccagggcaatcaggcaagaraaaggaataaagggtattcaaataggaagagaggaagtcaaattgtctctgtttgcatatgacatgactgtatatttagaaaaccccattatctcagcttaaaatatccgtaatctgataagcaacttcagcaaagtctcaggatacaaaatcaatgcaaaaatcacaagcattcctatacaccartaatagacaaacagmgagccaaatcatgagtgaactcccattctaaattcctgcaaagtgaataaactaccttggaatacaacttacaagggaagtgaaggacatcttcaaggagaactacaaaccactgctcaaggaagtaagcgaggacacaaacaaatgaaaaaaacatttcacgattgtggataggaagaatcaatatcatgaaaatggccatactgcccaaggtaatttatacagtcaatgctatccccatcaaattaccaatggctttcttcacagaattacmaaaaaaaaaaaaaaaaaaactactttaaacttcatatggaaccaaaaaatagcccatatagccaagacaatcctaagcaaaaagaacaaagctggaggcaccacgctacatgacttcaaactatactataaggctacagtaagcaaaacagcatcgtactggtaccaaaacagatatatagaccaatggaacagaacagaggcctcagaaataatgccacacatctacaaccatctgatctttgatgaacctgacaaaaacaagcaatggggaaaggaktccctatttaataaatggtgttgggaaaactggctagccagatgcagaaaactgaagctggaccccttcctttacaycttatacaaaaactaactcaagatgtattaaagacttaaatgtaagacctaaaactataaaaaccctagaagaaaacctaggcaataccattcaggacataggcatgggcaaagacttcattactaaaacaccaaaagcaatggtaacaaaaaccaaaattgacaaatgggatctaatgaaactaaagagcttctgcacagcaagagaaactatcatcagagtgaacagacaacctacagaatgggagaaaatttttgcaatccatccatatgacaaaggactaatatccagaatctacaaggaacttaaacaaatttacaagaaaaaacaaccctatcgaaaagagggcaaaggatatgaacagacatttctcaaaagaagacatttatgcagccaacaaacatgaaaaaaagctcatcatcactggtcattagagaaatgcaaatcaaaaccacattgagataccatcttgggccagttagaatggcaatcactaaaaagtcaggaaacaacagatgctggagaggatgtggagaaatagaaatgcttttacactgttggtgggagtgtaaattcgttcaaccattgtggatgacagtgtggtgattcctcaaggatctagaaccagaaataccatttgacccagcaatcccattactgagyatatacccaaaggattataaatcatccttctataaagacacatgcacacgtatgtttattgcagcactgttcacaatagcaaagacttggaaccaacccaaatgcccatcaatgatagactggataaagaaaatgtggcacatatacaccatggaatactatgcagccataaaaaaggatgagttcatgtcctttgcagggacatttatgaagctagaaacyatcattctcagcaaactaacacaagaacagaaaaccaaccaccgcatgttctcattcctaagtgggagttgaacaatgagaacacatggacacaccgaggggaacatcacacagtggggcccgtcagagggtaggagtccaggggagggatagcattaggagaaatagccaatgtagatgatgggttgatggtgcagcaaaccaccatgacatgtgtatacctatgtaacaaacctgcacgtcctgcacatgtatcccagaatttaaagtatgataataaaaaaaagactgtgtactcatttttggttgccatgataaattcagagaggaaaaacatgatatatattaaattttactgcaacaactaactgccccttgtcatcagcctattctgtcactagagtgagtcagtattcctcttttctgactgtctgagcctggacgatttaaactgcttttcacacaacctcttgcccaaccttttctcacctcccattgtgaatgaacatagatttccctatggtaaacaaaacaaaatatcaccaaatctaaggcaagataaagaaattgaagataaaagaaaccaacccaagagatcagagaaatattcatctgcacaacagcttcctccaataaacaggggacaatctttaaaaatctctcatatgtgtttgtaacatagaatcgatggaactatatgaggcatttataagatttaatgatctgatatcagaaaagttgagatttgaatgaaacacatgggagtcggaaaaggagtgatgactggtagattggagcctgcccccaacccccggaaaaaaaaaaaaaaaacaccaaagggataatgaagacaagattgaattctccagaattcatcaaggaccagacttgaaatgacacatatatacacacaaacacactacrcacaaacacacagggatataatatagaaattccagaaaaaataaaagaaagcagaatgaatagaagcattaattagcacataatggaagacaatttctcaggctataaagaaaaatactaagttgatccttgaaggcttactagacaaatcaagattaacaacaatgggccccggccctacatggaagaaaattatgccatccaaatataaaaaaatactgccactctccagaaataacaaaaaagaagaaattcatcttagcaccaagcttccgttctgtaacactaagtagtagaagttagtgtttgagaggaaatattgtacaataaaatttctgtactcggccaagctgccattcatctgcaaggcacagatgcatcgtcttaaataagaaggaaccccaaacatacaccagttagatatactgcctacaaaaagaaaaactcccacaaagctgtgggagtttttctttttgaagaagaaatcaaaattccaaatggtgttgtatcaaagaaatattaatgaggcacaaaactagttaaatggggtcactaaaactgttttatttaatatrgaaataaaatatcaaagcaggactaattcttgaaagataattcatgtaatatgaaaagaagaagaaacttgatataaaaaatagattttatcacttcagctaggaagttagagatgaagtaagaaaaaccatcataaacttatcatatgtaggggacacatattcttgacataaaaaataaggagaaaatggtacttcacaccagtataaaatctatatatctatatctatatatatctatatctatatctatatatatatatawaatcaaattttaaaagataatcagaagggcgaaaccacttggtccataaaacaaaagaggggtgagagaaacaagagctagcaagctttctgtctctcttttgggaaactagcattattacgttaaagtgaattaatacatgtattttaatgcctcagtttttctttctaatataataaatattaacagatataaactccattggtaaaatcactttgaggtccttaatacttcttaaagtggccgggcgctgtggctcatgcctgtaatcccagcactttgggaggctgaggcgggcagaacacctgaggtcgggagttcaagaccagcctggccaacatggagaaaccctgtctctactaaaaaatacaaaattagccaggtgtggtggcgcatgcctgtaatcccagctactcgggaggctgaggcaggagaatcacttgaaccygggaggcggaggttgcagtgagccgagatggtgccactgcaccccagcctgggcaacaagagcraaactctgtctcaaaaaataataataataataataacaataacaataacaaaaatgtttaagagtgaaaagaattcttgagaccaaaaaagtttaagaactagggcttgatgatgttcaagcaaagataggaaaaggctattgcaagtacggtacaaagcacagggggaaggtttcataagtatatatataatatatatataatataacataaaattcatatatattataaaaataataaatatgatataaatttgatatraaatattatataaatctgatttttaacatattttgattttatactggtgtaaagtactattttctctttattttttacatcaagaatatgtatcccctacatagtataagtttatcatagtttttcttacttcattcctaacttcctagttgtagtgataaaatctattattttatatcaataaaaatattgatataaattttatttacatgatatacartatttaaatataacatattttatattacaaaatatactactatgtattacaaaaaaaaaaacaaactccatttagcagagcaagaatggagtttgttttgtacagtgctgagttccaacccatagaattgttaaataaataaaaaggraagaacactataagatcaaactcatcagttataatagtaaatgygaatgattccaatccccccttttgaaagacaaaggcttctaaatatggtcagaatcctatttacagtarcaycaaaaagaataaaatacttaggaatcaatttaatcaaggaggcacaagacctgtgcactraaaactcagtaactgaaaatgagcaaatgatgtgatagacatgtctccaagggaaatatacaaatgcccaataaacacatcaaaagatgttcaacatcaytagtcattagggaagtgcaagtcaacctgactttgtactaggatgttttgtattaggatggttataatatttttaaaaaataggaaataaaaggtgttggcgaggatgtggagaaattagaacgcttatacattgctggtggaaatgtaaaatggtgtagcactgtggaaaacagtttgatgattcctgaaaaagttaaacatagaattaccatataaccagcaattctgctcctaggcatatacctaaagaaattgaaaacaaggactgaagcagatgctcaaataccaatgtccgtagcagctttgttcaaaatagccaaaaggtagaaacaacccaagtatctacgagcagatgaatggataaatgaaatggagcttatccattccatggaatattcttcagctatacaaaggaatagagttctgatacatgctacaagatgcataaactttaaaaacattatgctaagtgaaatgagccagacacaaaaggataaatactgtattccacttttatgaggtgccaaaaataagaaaatttattggactaaaaatagattagagataaccagtggaaggagagaatagggagttacaactcaatacatccagtttctcattgggatggtgaaaatttttggaactaagcagtgataatggttgtataatgttgtgaatgtcattgatgccactgaattatacccttaaaatggttttaatggcaaattttatgttgtatctcttttaaaacaataagaaagaaaaaaatttttaaatatatcatgtgatattaggaaagaaaaaaacagataacagtataagaaaaataagaatttaaaacatatcaaataagatttaaaaattttgtttaagatattgatacttggtccagtgcacaataaagacaagaactttttttttttttcttttgagatggagtctcgctctgtcaccaggctggagtgcagtggcactatctcggttcactgcaacctccgcctccagggttcaagccattatcctgcctcagcctgccgagtagctgggactacaggcatgcgccaccacgctgagctcatttctgtatttatagtagagacagggtttcaccatgttgkccaggatggtcttgatctcttgacctcgtgatctgcctgcctcggcctcccaaagtgctgggattacaggtgggagccaccgcgcctggcctgaagacaagaacttttgaacaagagagcgctaactaacgtattgaaatacataaaacaaatactgatatatagaagagctcattcagctgyttcaaagacagagctctgtaacacatgtactcttacctaaagaactgtctcccaccactggaaaggaggtcttctctgaccaaatacacagcatcttggagttggccagcattaacttggatcatctggctggccaggaaaggagtgctcagggagaaagaggatggtcaccatcccaaccagattggccattagatctatgtatcaacagagtgacatacgggagaattaaaattctagtatgcaaaaatacrccgtatgttaacagaaaatagactgcagggaaatttgtattaggtaaaaccgagagaaagttaagagcatacaacagtagataagcaatagacaacccgatataaaaatgaggaaagaatatgcacaggcaattcacaaaaggaaacataaaaatggccttaaaaattgctaaaataaatatttaagcaaaaaagctcarcttcactatggtttggggaaatgcaaattaaagcaacaatatgtcatgttttcacagtcacattaataaaagtttaaaagacggaagtagaggtaaataggaatttgaggaaaaggagccctctcatagtggttcattggaatgtgaattgctgcagctttcaaaaaaaaatcttacactatccacaaacaatgaaagcatagatatcttcttagctactaatcccactcctaggaaaaggagtattaattacaataggttctttattgcagtattgtttatataagcaaaaagagcaaacaaccttgacatccttctattagcagtaggttgaataaatcataagacgtctactatgaactattttgcagcaatcaagaagacttaattagatctctgtttagtgatttgaatgggtgaccatgttgtgatgtcmacagaaaaaaataatttgcagaaaagcatatagagtttgttctcaatttggaaaaataatgacaaatttggaggagatatcctatacacatatgtgtgtttgattgggtttggaaaaatcaggaccacctgagatggaggtgggagtgacaaaatatacatggtatactaagtgaatatataggttatacaattacgttgttaaatttctgaaaacaagtgcaacttaagcatataactaaggagtagatgttaacctggacaaatgaaacatagattgttttgagcaagagacrgcaaaattttttgtcaagagccagatagcaaaattttcaattttgcagaccatgcaatctctattgcaattactcagttctgccattgcagtggaaaaatagccctagacaaatgaatgtgtgattgtattttgataaaacttcatttacaaatacgtgctatagaacaaatttggcctgtgagccatagggtgacaatctccggttagatgaagggattgagagcattatttttcttcaattcttgtcattatgcaaagtcagagaattttctaaaataaataaaaatacaaattggcaaaataataatagttgaaaacttcagattgggcaaataagtgaacaaataatcacatgttgaggaataaggctgctttgattcttgtgtgttcaactttgaaacctttatcacagttataaaaaccatttataaaagtgrtataactccacagagtatacctcaataaatttgcacatagaagaaatcaaaatgggtatattttctcatcgcaatacaccaaaaactaggaattaataagcaaatgatacattaaaaattcaaagttttagaaaacggagtaccttagatcttgatcaaagagaaatttaaaaacagccattgcagattacctggagaataacaatcgctaaygatcctcaagtgcatgtgcctcaagcattcttctaagtcctttacttgaattgatttacttagtctttaaaagaccctttgaaatggatatcatgcatatccctcattgtatagaagagaaaactgagacagacaggttaactaatttgtccaaattcatgtgacaggttgaggttagaattagaatatcgccagtcagcttcaacaacctgtaatggtaagccttacattatttatcttcttaattaggaatgctgaaacatatattactcataaaaatttctggggtgctgatgccaaaactgtcctcagagaaatttttcaatcctttttgttacttgacaggaaaaaattcaaataaatgaacaaaacatttcttaacaatttttaaattattaaaaacatatataaaaggctgctggagtaaggaattaataaagtaatgaacaaagaaaaaatcatagaaattataaagaaatctaaaagcagattctttaaagtgaccaattataaaacaaacagactgggtcaattgtcatttcacaaaataacaattctataaatatacaagaatgagaaagaagacataagcctgttgatattgaagagatttaatacttgataaaaatattatatcttctctattctaataaaattaaaactatccatgaaatgtaccatgtcagaagaaaaatacaatttaccaggtgtagtttaaaataggcagaattgctgataaacccatatctgtttgagtccatattttcaattcttttaggtatatacccagaagtggaattcctgggggatatggtaattctgtttaacttttcaaagaattgccagactattttccacagctgctgtaccattttacatccccatcagcartgcacaaatgttccaatttctctacatcctcaccaacacttgtcatttttctggtttaaaaaaaattattattataccaccctaaaaggggctgaagtcagtttgatttacattttcctaatgactaatgatgtggagcatcttttcttgtgtttattggccatttgtatgtcttttttggaaaaatgtctattctcatcctttgtccatttcgtaattgggttgtttgtttcattgttattgagttacaggagtcctttatatgttctaagtattaaatccttatcagatagggttttcacatattttctatcattctgtgggttgtctttttaatctcttggtggtatcttttgttcttgacttggactgcaggacacttcagttcctcactacatgggcttctccaaaggacagctggcctctcccagaatgagcatctcaaaaagagaagaaaacattgcagtgctttttgtggttagcctctgaagttgcacactatatcatttccactttattctaatcattagaatcaagtcacaaagcacagcccacattcaaaaagagaggaattgggctccatcacttgaagggacatgtataaaataatttgtggacatatttaaaaccaccacaaagaagcacctttaaaaaaagacaatggcccagttttgtaactcttttttaacttcaagaaatagataatccaagtattaatattatttaaactgttatggaacatagaaataaaattatagccataattaaagtttgccaaagattacaaatgaaaataaaataaaatatatctctggctcatttgctaatataaatactaaaaatcttaaattgactattaaataaaaccaatattaaaagaattatgcaaggggaacaagtaaggttattccagaaatggttccaaattaggaaacccacaaacttacaatattaaagagtacaacttttcttaaatgtcatataaatatactctctaatgccaaaaaacacaatgaatggttaaaatctaaaagcatgcttgaatataattaaagttcaaaggaaaagaacactcggcatccttcctattattcaaagtagttgtggaaattcaaaccagtaaaatgacagccccctgtatttagagagatatacatatagatatagatagagagagagagaaggcaaatttattattaactgatggttgtttacctgaaaacccgaaggaattatttgaaaggttattagaataggaaatggtagtgagatatcgagtaaaaaataaatacttataaattaattactttctttatgtaggtaacaaccaaatagaatataaggaggaaaaataccattcacaacagaaacaaaatcatctagaaagaaatttaacaggaaatatataggacttataagcagaagatttaaaagagggggacatagaaaaatacttcaagaaatggaagatataatattttatttaaaagatttaatgttgtggtgatgttaattatccctgaattagtatgcaaatttaatgtaatcagtttcaatgacattcttttttttaatttgacaagatgtctgtaaatgtcatgagacccaccaacagaatattctgagataataacaagaagggtgtttgataccagatcagaggtgggtttgatacccacctctcagtgtctggtaaccacmtttctactctctacttctacgagttcaactattttagatttcacatgtaagaaagatcatgcggtattagttcttctgtccctagcttattttggaaggtattttaaggcacaaatatgttgtagtgtaattatgttgtaatttttcctgacctgatgtcccacgtctgtaaaattcttttattgaagcctaggctctttccctaggactccctgtctggaatcataaatatcttacttctgtacttaacagaattgttctgtctgcatatagtccccactttttctccaagtagtttctcaaacaaatgcacttcctttcctgaaaagatgagtaagattttaacagctttaaatctttatatatagatatattttaagccaaacgactacactgtacatggttttatagccctctttaatacttacgaactatattgtataattattctaattattatatattactctacaacaccatttttagtggttgcattttggttattacttggatagtccataacctacctaacaaagtccttaatgtctggaattaaagtggtttcgcatttcaactgttagcaaaaacactacaatgcacgatcctgcacacgtgaaaagaaatgagatgaggacttcactaacttcaaagacagcttaaggattcagatcttcacakgtacacaagagacaagatttgcagatttgagtgaaaggctatgcacgattttaagcctttcagtacatattgccaaagtgccctccactaaactttgaccatgacctacggagtgagtcacaacagtgactctttctttgagtttatattactgctaggttttgtcaatttgccaatctaatgggcaaaaacggcattttatttgcattttaaagtgtatttatcatgtttataaggaagctaaacttttcatatgttcatttgactatttccatttttcgtttgtaaattatttgttcataattctttaccatttttctacttgggtgtttgcctttttataattgatgtataagagttgtttttattatttttcctctgtggtttgtcttcaaatttgtatgtagaaaggtttatttgtaattattcagttttatcagttttgttcatagtagaatttttcctcaatgtatgtctatagaagcctcaaatcagaaacacgtttgcctaaatcacctagttcttttatggttttatttttgacatttaatctttgatacacacggattttgctttgatgaatgtcatgaggcagagatctagcttagcttttcagatatttgccctatcaatgaataattcagttttccgtgtcttgaaatgccatctttatcactgccaatttcttacaaaaacttgtatctatttcttgggctttcccccattttgctctagggatctgtgtctctattcctgcatcatttcaattattttacattttaaatgcattttaacatcccttctgtttttgtgccttaaaataccttccaaaataagctaggcacagaaaaactaatgccacatgatcttacttccatgtgaaatctaaaacagttgaactcatagaagtagagagtagaaaggtggttaccaggcactgagaggtggggagctgagatttggtcaaagggcgcagggtttcagttagacaggaggagtaagtttcagagatctattccacagcatggtgactatagttaataataatgtgtatttcmaaattgctggccgggcacagtgtctcatgcctatagctctttgggaggctgaggcatacgaattgcttaagcctagaagttagaaactaggctgggcaaaatggcaaaaccctgtctctaccaataaatacaaaaattagccaggcatggcagcgcatacctgtagtcccagctactcgggaggctaaggtgggagaatggtttgaacctgggaggcagaggttgcagtaagccaagatcacatcactgcactccagcctgggtgatagatccagaccctgtcaaaaaaaaaaaaaagaaagaaagaaaagaaaaagaaagggaaaaaaaattgctagaagagtagattttaaatattctcaccacacacacacacacacacacacacacacacacaaaacaaatatgagaggtgacggacatgttaattagcttaatttaatcatttgcaacagaaacatatatcaaaacaccacattttaccctataaatatatacaattattgtttgttcataaaaataaaatcagattttaaaaaatattcactgtstttttttcagccatacataggctggaaccttcttcacattttggctccaacaatctagcttagtcacagcgagcacatctaaaacaacctctaggaggccaaaagtcagaggactcccatgatcctgtgctcttagacaacttttaaatgtatgataggagacaggcagaggaaaacacaggtaataatgggattatccttttctttcctttctccagtggttctcaacttgtttaattgcagcaatttttaagattttttttcttggcacacttgaaaagattgtataccatagcctaaacaggctagcaataagtaaaattcaatcagtacctaaaacgtaaaagagactcactgtgtctacaaaaacattgacggtcattgccatagtcacacagttccctttagctttctgtcactgtttcgggaagagctggtatatcagttaggatttccagctgtaaaagacagaagaaataaaataacaggatctcaaacatagatagtagtttacttctgtctcaggttaaaaatcacgaaagtaggcagtccagggtttatacgatgactccataatccacagaaacctgggttccttccactttgctactctgacctcttcaaaatgagagcccatcttatctcatggtctaaactccagccagtatagaggacacagggaagaagggaaggccaattcctttaaagacactttccagaagttgcacaagacactccacttacatcctctggccagaagttagtaacatggctatgcccggctgtaaggaaaggtgagaagtgaaacctttattgcaggtggccaatggcccagttaaaaatagagggttccattactaatgaaggagaggaaagtggatactagggatggcaccagtagtctttgctacaaatggttactgccctgatcacatttcttacataatcaagaggaaaagttcttaactgttgcagttactgcctcatcattatatggcattccattttaccctttaatttttacttggtcaagtttaggcctgctgtacaccagaacacatgaatagctttgctcagcattctttgtgacgttgctcacagtaacattatggatacctaataaattttttaaaagacaaaatgttctacgttttgtggcctactctggatggctttawggtaaagtgggtgagtatccctaccctttacatttcaagtgtaggggtgtttagctgtctcttctggctctcatttactgactcttctgggtaaatccattgttctttcttttatacaagagactatctgagcacccaaaacttgaaagtctctaagctaggtgctatagtgttaaatatttcagtaagatattttccctgcttaatccaggagcttgtcatttccttgctggaagtacacatggataaaataactgcaaggtttctgaaagacttaagtacaaaaatgtcctgcaaagaaaaagggaaatatctcattcagttgtgagggattaggaataaaaatgaattggagaggtcaaaatgtaagcttgtcctcaaaaagaaaggactaatttgcagatggagatggggtttcttccttccgaggtctgccatggtgtaatctgtcctgtaatgtctaatgtctacctgctattattttctaaatggtgagttaaatgggaaatatgtgtagcgtataaccattttctatcmtttgctttaggtttcgactcattggttccccatctactacttgtctcgtctcaggcaataatgtcacatgggataagaaggcacctatttgtgagagtaagttgaaatacttttctccacaaattcctctgtgtgatcctgacttgcccctggagtacaaagaataaattgaatccttcttgcacaaagtagtctctcagatatttgaaaataggagtcagatgcttcatggtcttcctggcttttctttatcttaaaaggtgatttatctgaaactgtgggcttgaacctaggcaaaataccctactttcccattataatagtaaatatttccagtatagagagtgttgtccttaatgagtacattttaaaggcgttagacaaaattagatctgtctttgccaactcttactatctatcaggttacaattccacaaagtaggctactcactttcttgttattctaatccaaataataraaagaactcttcttccagttcttagcaattttcctaagcctctgatcattttgagttctaatcctccttcaattcttttaggcccatgtcttcagttgtatttgttctcgattagctgaccctccatttttcccataagatatttttcaatgaatctccaaaactttaaaaccatggaagaatgattgcaaattggcaaagtgttatagctgtgaagaagtcgtcatcgcacacagagttgatggcagcaaaagtaggcacagacttccagaaagctaatgaccaatataaacaaaagtaaagtaaataccctctgactgacaattccatttcccagaatttagcccaagaaaataatcatgaaatagtcccatgattttggtccagagatactcaatgcaataatatttgtgatagtggaaaatgttaaacaacctaaatgttcagcatggtttgaaaatagctagtagaagaaataaggcatattttaatggctatcagtttttcggaaaggtaaaaaagtgcaccaggaggaattaaaggttgagatgcctcatccaagtggaaaaagtacatctatgtagctacatgactgattattattcagccaccaaatatggtagtatagaaaatatatccatccatacatatgcatgtatccacatatgtatctaagaggatataattaaattgttacaaatagttatctttgaaccattttcactttcttctttctctttgtccatattttataaatttcctacaatgaatgtgttcattgtagtcactaatattcttcccccccaaattaacattgacttttaaacattaaatgaatgagaatgtatacaaggtgcctcccatatctgccaagaacttgaaattctatgaaataattcaaattatcaaagaattatcagtttactatacraagttttcaaggcatggcaccttttgtagggggttatcttttataaaaaaatttccacttctacatttataggtcagtgatcatttaattgagtcaatactggttatgtgtgtatatgtgtgtagtcacttagccaatatgtgaatattattatcttaygatagaacacagtattcatttatcattttattgcccttaaatctgccattatttcatttctcatgccttatcttttgtgtttccttttctctctttttcttcataaataatgccagaagtggtatatttaaactgcaaagaggttattttaataacctataggaaaaaatagtccagcaatagataagtaccttaacaatctgtgataaaatcacatgtattatccacttaaaattataaatatataaacccaaaaaaacatggattttttttgtgaaatatgagcagaacccatatcatacacacctaaatttcaactaggtaaaaatgtctgattattagcaaatattttaagaaaataacagtattgtaattccatttagaaaatcattggattatttgcatttggtatttaaattcatagtaaaataattcattattaaaaaataagctgttttaccatactcttccttctctcagtcatatcttgtgagccacctccaaccatatccaatggagacttctacagcaacaatagaacatcttttcacartggaacggtggtaacttaccagtgccacactggaccagatggagaacagctgtttgagcttrtgggagaacggtcaatatattgcaccagcaaagatgatcaagttggtgtttggagcagccctccccctcggtgtatttctactaatraatgcacagctccagaagttgaaaatgcaattrgagtaccaggaaacaggagtttctttwccctcactgagatcrtcagatttagatgtcagcccgggtttgtcatggtagggtcccacactgtgcagtgccagaccaatggcagatgggggcccaagctgccacactgctccaggggtgagtgtgacccatcaagactttgctgggtgtgagggtacrtatagatgataggagttgttgaaattaaggaagaagtgtataaggactatgaaattggcataaacataatagtagcttcactgtctgttatctctgttaataattgtctcaaagtaatggcttattctctcatctatagtagacatattttagatgcatttttgaatttaacatttacagcaaatatatgaagtagctactattggtatccccattttactttgagaraactgagtcttagtgatattaaagaacttttccaaggctctgactccagagcctaatcataatgtacagtggaatgtatcatgaacaataatgtgtaatagtgatgatcgtatctctatccctggagtggggcagtaggcaagtgagccatgaggaccaaaatgagagcatcaaatcaaaaaggccttggacttcaacttcaaytttttctcattataattgaaaagactgaagctcagaaaaagtgttttgctcaaatccaaacaaatatatatatatgtatatacacacacacacatatatacttgatatataattatatattgttcagattgaggctcaaattcattctttgaggttttttgattgtttgtttgtttgtatgtttgtttgagagaaggtctcgctctgttgcccaggctggagtacagttgtacaatcatagttcactgaagcctctaactcctgggctcaagtaagacctctgcctcagtctcacaggtagctggaactccaggtgctcactaccacacctggctaatttttatttatttttagagacagagtcttgctatgttgcccaggctgatcttgagctcccgtcctcaagcaatcctcctgcctcagcctcccaaagtactgggatttcaggcctgagccaccatgcctagtttcaaatgcattctgatgccctgagaacacaccaattgtcctgtggatggaggcagccaacatttcggttaaaatacggtctaagcaatatgttctatcactaaaaagtctgtagcttttttttctttgagggggggttgttctttttgtttatttttaatttattaatctttaatttttgtgggtacatagtaggtgtatatatttatgggtatatgaaatgttttgatacaggcatgcaatgtaaaataatcatggagaatgaggtatccatgcccttaagcatttatcctttgtgttacaaataatccaattacactctttcatttttaaatgtacaattaagttattactaactatagtcaccctgtcatgctatcaaatactacatcttattcattctttctttttttttttgtacccattaactgtccccacctcccctccctaccctcaccccctatccccacgattttgttcttgatgcctcctcttttcttagctgaaatgactggcttaaaacatggagtgggaagaattaggactggtcacagggacagaaaggaagctaacagttcagccctgtgctgactgaaagagggtcagggagtgtggaaaatgaagaatacgtgaaggtgtctgttagatgagaccttggcaacagtactccttgctgttgccttacgcatgagcttgagggactgcctctgtaggaagtggaagagtggccaaaccacccgcactcacgactctgtgctccataaccagtagttgaaagcaagaggaatatgctgccttatagtctttggaacatgtttcagtagaaaaaacacagacaaggtgttggagagactttgattctagtcacagttctgcttggtttccttagcttccttgttagtgagatgtggctactgaactaccaatcttctcttttaatagctgcactctgcaatgacgatttttaagccctctggtaagcataagatatarcaaaggaaattgccccatatctaacaagtgctctggaactgtcctttccacagtgtgtcagccgcctccagaaatcctgcatggtgagcataccctaagccatcaggacaacttttcacctgggcaggaagtgttctacagctgtgagcccagctatgacctcagaggggctgcgtctctgcactgcacgccccagggagactggagccctgaagcccctagatgtacaggtgccttgactctctggcttccagattgctctgttttccccttcacatggaggacttactcctgttgttttattttttcttctagtgaaatcctgtgatgacttcctgggccaactccctcatggccgtgtgctacttccacttaatctccagcttggggcaaaggtgtcctttgtttgcgatgaagggtgagtgtgacccakcgttgagaccaaggactcagtgtggagaatcactctcttgagatcaggggttaatccaattaaggagctgacctagtagataagaagtacccagagagattaatttatggaagggtagttttgaaataagrgtagggactaagtggcaccactttcagaaggcaatgagaaaatggcacatacagctcaatgtcaggtacaaacctaaatacagtcactgatcttgagtacacagttggaacttgaaatgaatgggtacgtatttatttggaggcaaaagaacataattttataagaggtatgctagaaaataaatgatgaataagacaaaaattgtttgccccataagaagtaaggtagaggttgtcttaagaaacttaaaaccaatcaatagtggaatctgtaatagtgcatggataagtgtgttttaacccaataatatatcttcaggtcaggaatggccagtgtaattcttttaatgcaggatttttctcagccactttgccagccagtgacttctggacagcaatgcccctgcccaggccttgcttgggcccaggctcaccgcaggaaacaccccagatacttagcccactgggcggcgtctggctggtgctctgactgggaccctggggccaccatgactgcacactcagcccctggtgggaggggatgtgtgagtgagtgagtgtggggtccagctggccactccaagcacctgcacaggaatgggctctgagcagtgctggcrgctggaccaggcatgtcrcactgaagggaacgtggtggtgcccaaacaggggtgcccatgaccccaaagcmcagaggaggtgttacagcacactaatggctcttagcatttgataatgcctgcagcccaacagatgrcagtgtgcttaacagctctgtcaatcctgtcgccccacatctcctgtcgcccagctctggcttgatccgctgctgcttcctttcgcgtggtacagctgccctcccacagcagagggcggagggccacagtgttacaggcttctttgtacctgcgtttggtgggtcctgagttgttgtcccgcatccaagaagaacaaggttatactgacaatagaagggtgaggagggtggagaagagttttattgagtgacraaacagcttctcagcggagacgagacacgagggtggaccccagatgaagtcagggggtcattctctctctcagcgtggctggttctggggcttttatggacacagaatggggagcctgtgctgattggtttgtgactatgcaaaaaagactaaaacaaagacaccactcaaaggtgggcacaacagtgtaaaaaaccaattagggaagctcaggtatatgtaaactaaatgaacagtgaggatcaatcagaggaaagcacaccaaatgggaagagaggttctcaarccagtccatggatttacctggaacttgtagctaggctttaaactgtcttcagcttgaaggtcgggtttcaccgggatctgccccatctgcctaggatttgwctgcctcctgcttctatcagtttcaagtggtattattagttgtttatgtgtatccattactcttggtggtgtgcactatgagtctggagggataactagattgggcaattaagcagttatttttaatgatttccaaagaatcttcggcatttacaaagtccaccacctaataatgatttccaatttcagaatgatttcagatttcagaaggcaagcaggattcaataagttgggcattttggggtgcaaagactcttcccccctcccttctttttttcttagagcacgtggttcagcatgcttctgtgagcctcctctggcctgttacagttgtagtagcaagaagaacagtgcccgttctctttctagatgttcctggctttgcttaccaaatcgagagctgttctgcctcatgacccactaatgagaataagtgggatgtcagagagccatcagtgaaagatgacacctgaaggttatggctcttgtgcccatggagaagtatggttctgtgttcatgccttctgtaggtgatgctgggctatgaagtttatatggcaattatgcacatcagctctaattgctttgccagtcacagggtaccatggttctttagaataaattggcctttgagtttctgtcagctactgaagaattcagatccctaatgaactaagacttttagctgggcctgaacctaagacctaaatgatagtcgaggaggaaatggtagtgaggaagctgagcatctattagcgaagaaatcaagggagagatgggaattgctcacacatttgctaccactttttttttctttaggttccgattaaaaggcaggtctgctagtcattgtgtcttggctggaatgaaagccctttggaatagcagtgttccagtgtgtgaacgtgagtagaaagaactatgtagtttggatagctctccttattttcgttttccagcatgtttttccgcatggcatcacctgttgtctagatctttacttaactaaattatggataaaaatacttctttgttggaagaatttcaagaagggtcttgtaggtcttctctgacatgtgtttttgttactaatctgcaaatcacttagtttaatgactgtttaattttgtggggaatgtgtggcaagaaactagatgacataaaggtgcagcacgttttagtcagtcatttatttttagttttcttatcaaggaggaatctttcttaaatttttatttttatttttattttctgagacactgtcacccaggacagagtggagtggtgcaatcacagctcactgcagcctcaacctcctgggctcaaatgaccctcgcacctcagcctcccagtagttgggactacaggtgcatgccaccayacctggctaatttttgtactttttgtagagatagaatctcgccatattgccccagctggtctcaaactcctgggctcaagctatcctcccaccttggcctccaaaagtgttaggattacaagtgcgagccaccatgcccagccaaatttttatgttcttttatcccctcgcatatcataaacaatttagtcagcttgttttttagcctgcagtatttaatgacatagggcttcccatgtgccaggactktccatgtgtagaaaaagcratgaatagtgaatgaatagtgaagacacctccctactttcctgggatgtattttcttgttgggaagcagactatgaacaaggaaataaataagtaaacaaaattctaaaaattataacatataaaatggtagttaaatagggatgttatggagaaaataaaacagagttatatgataaattagtacgatggaaggagctgggatgatgaatcagtgtctgaaatgatgaggtgtcctaagtttccaaaccatccgcttaaataaaatatgccaaaattcagaaaaaattcagaaactcttagataaaagtacatgtttgacataccaagacattactgattgattctattctgtctactaaagcaaggcaagaattttttaaaccttgttttcctgattattagaaaatgtttattttaatttgtattgtgttaaaataacttatagaaatcaatttggataccttatggtgagtattatggtgaagaacattcaatacctgaggaaactcaagtattcaacaaactcaaccttacagagacacatagagctgaaaataaatatataaataaacttaggaaaacacaaacaggtaaaattcaagcatgagaagtcaatcattgtttgatgtactaggtcttttatatacacataattctgataaatttgggtatctcttcctaaattcatrtcaaactagaagcatcaattgcttttagggaaggaactgttctaagcagactaaaaggaggaagaaatggtggctaataattggaagaaatcaaaaaaggctctttggcaccatttaatctgagtaaaaacagccttactggtgtctgatgacaccactggaaatttggtattggtcctgatggtaatggtcttgaatcacyaagaaacatttacattgctaaagatgatagytcatgtttattaaagttcatagatttccttgaaacttatggtctctgatgaccaaaactttgtctgtcttgaacctcattgtcaactcaggaatcttactatgcctgagttaaagtagacaaccaaatgggtgtttttaaaaaaaataaaaacaattactttccaaattcattgtgaacataggtacctgagtggtccaggaacactgtctttgggcttttgcaataaactgtaatttaggtctcacttcagttagttgcctctcaacaaaagccttacagatttaaattccgtctaccttagttatattctttctaaaagttatattctttttaagcgcacagtcacaggtcactattgtttcagtcatcttaagtgaaattctaatagaacttaaagctcttgttttctttctagaaatcttttgtccaaatcctccagctatccttaatgggagacacacaggaactccctttggagatattccctatggaaaagaaatatcttacgcatgcgacacccacccagacagagggatgaccttcaacctcattggggagagctccatccgctgcacaagtgaccstcaagggaatggggtttggagcagccctgcccctcgctgtgaactttctgttcctgctggttagtacctgcttccacatatcctaaatgggttcagaatatctaggtaagaacctccatatttctatagtgacagtcatttttgcttgtgaaaatggctttgctgtaactgtcagagacagaactacctcccaagtgaatgacaaaygggttatagataggcacgctgtctcaattgttggtattctgatggtccttcctatggggtgaagagtgtgggatggtaaggagagaagggggtggacagtgaagagaattgatgaggtccagatttagtagggaatgttttcaaagtactgaaaacaaatgctaaagaaaatactcttttattccacctctactactacgagttatctttatcctggagagatggatgtgctgtgcaaaaagtacacattgatgatgtaatttacttcagaactgataacgctataaaagtaatttgagaaactcagatgtagggatttatactttttatgttgtttccaagggtttgttcaagccactgactatgtttgtttgatccttcacctcaacattaacaaagggaactcaggaggccctggagaagcagagtttaaaattgtactcttagcctaatgggtgcagcaaaccaatatggcacatgtatacctatgtatcaaacctgcacattgtgcatatgtaccctagaacttaaagtatatatatatatatatatatatatgtrtgtgtgtgtgtgtgtgtgtgtgtgtgtgtatgtgtgtatatatatatgtgtatatatatgtgtgtgtgtrtatatatatatatatatatatagagagakagagagagagagagagagagagagagagagagagattgtactcttagcctccatagctcattcctttgatatattagtctggctttaaacgacagtacctgacaactgtaggcacatgtgtggctgtgactgcccacaccagttccatcttccagtaaggacagaacagcactgaatcggtagcttgtcgatccctgtggtactcccccatctgatctagtttgaagttagagactgtagaggatagtgtttaaatgtcaagaggtctaggtttagagaacccgtctttcactgatcaaataggagggagtggcttatgacctggctggttgaggtcttcatgtacctctaatagccagagatattggatgtgttcatgtattcatatgtctatgtttaactgagtgtcttttcttgtgtttgtgtgggaacttgttcttagcctgcccacatccacccargatccaaaacgggcattacattggaggacacgtatctctatatcttcctgggatgacaatcagctacatttgtgaccccggctacctgttagtgggaaagrgcttcattttctgtacagaccagggaatctggagccaattggatcattattgcaaaggtgacttatttcttggtattccttattcttgctgggttgtatggaatgcatgaggcttgtaaggctgagagacattgaaatgagcttaatgaaagggataatatttttttcttctcggcaactgctttcttttcatttacataaaattatttcatcttattaactgtcctctttgcatggtcgatagcagtgcttctccatccagagcattaacaaaatcaccttgttaaaaagattctcaaactccattccatggcctcygattctgttttaaagtggggtcaaaagtctatttttaacaaactcatcagaatgctctgatgcaggaagaccacagaccacacttcaagaaataccactttgccttcttggtttgtatctaggaaaaaaatattgtaggcttaattttgagactattacaactgaaaagaagtctgtgcttgaagatgaaggatgtactgatggctgggcagaaaaagaaagtaaaacaaaggataagttaaacaaaataaagtagtctgggtgcggtggctcacacctgtaatcccagcactttgggaggctgaggcgggaagatcatgtcaagagatcgagaccatcctggccaacatggtgaaaccccgtttytactaaaaatacaaaaattagctgggtggtggtgcgcgcctatagtcccagctactcgtgaggctgaggcatgagaatcacttgaacccagaggcagaggttgcagtgagctgagatcacgccactgcactccagcctggcaacagagcaagactccgtctcaaaaaaaaaaaaaaaagaaaaagaaaagaaaagaaagtaaattaattagaaagatgtattaaattcaggctgggcacggtggctcaggcctgtaatcccagcactttgggaggccaaggtgggcagatcacctcaggtcaggagttcgagaccagcctggccaacatggtgaaaccccgtctctaccaaaaatacaaaaattaatcaggcatggtggtacatgcctgtcgtcccacctacccgggaggctgaagcaggagaattgcttgaacccaggaggtagaggttgctgtgagcccagatcgcgccactgcactcctgcctgggtgacacagtgagactcaaaaaaaaaaaaaaaaagaaaaagaaaaagaaagaaagataaattttaaattcacaatcatgatttactaacttctttgttctatgtgcagaaattggccagaattatgcatttaataaagagcagagtgccagtatttgttgtgaagccagacagaattaacatggtactcctgttccctcacagmgtgaccccagtggctccagggytagatcaccgttagcctaattcctaatctttccacagctttccagttgcagagctgttaatcaacagtgaatgcacagtacattccatattctattactttacattaagaaatgggagtcaggaaatgttaaatcataaggtttttggaggaggaagattagtaacatgtttaaaaacatgcttcctcttagccaagggcaaaataggttttggctattttctcctattctcgcagttaaaacggacaatcaacaataaaatatcaatttmtttctgattkgtctaatttcagaagtaaattgtagcttcccactgtttatgaatggaatctcgaaggagttagaaatgaaaaaagtatatcactatggagattatgtgactttgaagtgtgaagatgggtatactctggaaggcagtccctggagccagtgccaggcggatgacagatgggaccctcctctggccaaatgtacctctcgtaagtgcaagtgcaaggaatgtgggatcttcccggtcatggttattgctcattcattcatccatattggcatcaagtgtagtgtgatgtttatggcatatgctatgagctatagagtacaatatgagcatccacctattccaaaactcccatagtragagtaaggccagacttcctcttctcatacttctcactgcagctctgcaccttttttgtctatatcactttgtggttgcatgagccacacagtaatgatttatttacagcctacgagccttacaagaaatgttttcagcatgagttagggagcaccttccaagctgcagagagcagccggcctgtctccctcactactggaggggacaggattttaagctagcacagctggatagagcagatttagaaattacgtatcattgagctctgtagaagagtagccctctgctggcaactggaaggtactgtaagatagaaaactacccacatcatggagcagatgagcaaagttaataatgaacagcctttcttaatccaagttagtgctacactttccyttctccccatctcttatgactcttctaatacatggttctacaccaagattgttcaagatccagttttacaattaatcctgtaaatatgctaatatgactcgcagataatatttctaaattatcagcttgacactcccttaatatcaaattatatttgcttttttggcaaaaatctcactggataacttactaaatgcttttagagtattctgaagatctggctgggactgacagaaaattcaggtcattggagaaccaaccgtatcaaatattagaacaaaatataaagcaataatacaaaagtcactttgcaccaggataagaagagacatacaaataagtggaacaaaattgatattaataaaataaaggggccaggtatggtggctcatgcctgtaatcccagcactttgggaggccgaggcggatggatcacctgaggtcaggagtttaagaccagcctggccaacatggtgaaaccccatctgtactaaaaaataaaaaaattagctggtcgtggtggcagatgcctgtaatcccagctactcaggaggctgaggcaggagagtcgcttgaacacgggaggtggaggttacagtgagccgagatcgctccattgcactctggtctcggtgacaagagcaaaacattttttaaaaattgtccattaaattaacaataaaaaggttgttaggtgaacacccaatacaaagcaaggatgtgatgaaactgatattgttgtgtgttgaaggtactattgtaaatttgcaaaaactcttatgaaaaacaattatgaaatgtatgtggaaaataatacaactattcctgccagttagccctcctagaaatttaatctaaggaaataatgtaaaatattaaaatattctatgcattttattaagggtttcatgagacagaaacctagaaacaagctaaatgcacaatagaagtcattgaatacactatgatgcatctactagattatgttagtttgcctttgttgtaacttatatttctagtatataattatgtgaaaacacacatataaggaaatgtaccagaacagaatgtatcaaaacattttttgggtatgaggattggggtgacttttttctttagttctgtattataaattttcttctgtaattgtattaataataatttttaaaagtcttctctgagtgcagaaggtaaaatgagagtatgtgaatgaaaccaatggctttttgcattagaaaaaatattagactgagtcctgaagaaaaatcaggatgacttgtcactggctgagaggtcctgttcaatcatgttgcatgccagagtgatgttttgtgacttttgtcttccttttaggtrcacatgatgctctcatagttggtaagttttatgaaagttttgctgaggaattctggcatctataacagtaagtacctacctataatgaatgaaatgtaaaaagagagatcaaaatgtcttgaggtgtaaagagatcaaaatatcttcagttgtaagttcaactagaaagaaaataatgataagttaggccacaatatggtgaaactggcatcgtcatatgcatactaaataaccttcatcaaaggctctttactatctttgaaccattacaaatgaataatcattcatcagtgtcaaaaattctttatttgaatgtggtgggagaatgcaacttcttctttcagttgtaacctggagtatgcttccagatggtgatcctgctcatttgcacaaatagaaagccataagaccagtcttctgagcccatatctgtgatttgcctaaataagaatagttttgtaataaagtttgcttccaagggaatactgtggcatattactcttacatccctttttacgcatctggacactgagacacagagagttaacgtaacttgtccaagaccacagaatggggtagcctggrtctacttatctgtggagactgtgcactttaacaatcaataaatggacaaaatgacctaaatatgtaattcaacaagagagagaattccagtattttcacaatgaaatgcctgtgtgttaagtcttaggcaagagacatgggcagggccatggagagctggtggccagctgccccatcacggttctcacttacttttggaaaagctgacattggactaaacgttacaaaacggctcagctcacaccttaactttaataaccctgtgggagtgagactaatgctatagaaacccagagtaaagcagaatgtatagttacatctttaaaaaaaaaaaagcattggcaatctgtagtgggactggatactaagatagaatttaaaacctgtaagttatattttccatgcatttaattaccttgttttactgcctaggcactttatctggtacgatcttctttattttactcatcattttcctctcttggataattctaaagcacagaaaagggtaagtatagccatattatcccaagaaatgtaaactgtacttaccccctcttggaagtcaaaagaaagtaaaagacaaacaaacccattgctacataaacagatgtggtaattcttataaagaaagtccttgacacacagtatagacaaagaggtattcacactaaaggaagtatataggatactaagaacaattaaaaaataataataataacaaaaaaaagaccatttggccaggtatggtgactcatgcctgtaatttcagcactttgggaggccaaggtgggcagatcactagaggccaggggttcgagaccaacttgggcaacatggtaaaaccctgtctctactaaacatacacaaaattagctgggcgaggtgggacacacaactgtaataccagctactcgggaggttgaagcatragaattgcttgaacccaggaggcagaggttgtagtgagccaagactgtgccattgcacwccagcctgggtgacagagtgagactacatctcaaaacacacacacaaacacacacacacacacacacacacacacacacacagcattttaagaaggaattgagttttacagaaagagaaagtaggcagaaggggtttttaaatagttgttcatgaggctgtttgatatcctagttttgctaagacattgcagacactgacctctaagcccagatcctatcatagcactagaagttagattgggtcacttatggcacacatatcatatggcacacataggctgccagtggggaagaattgaaactttccattgggtattttaatatataaacaaatattttgtaaacaccattaactttttttttttttttttttttttttttaagaccgagtcttgctctgtcacccaggctggagtgcagtggcacgatcttggctcactgcaacctctgcctcccagattcaagcgattctcatgcctcagcctcctgagtagctgggactacagccatacgccactacaccaggctattttttgtatttttagtacagaaagggttttgccatcttggccaggctggtcttgaattcctgacctcaagtgatccacccgcctcagcctcccaaagtgctgggattacaggtgtgagccactgggcccagccatcattaattttttaaatttgaaagaaaaaaaacttgcaaagactaagatctgaataaagaaacgtctttgacagggaagagaacctacacagcttttgtactggttgattgaattataacaacctcaatgaggccagaatcaataatatcaatgttatatggttgatgagcaagttctatacccatagaaaaactgaatttgtaacttttaagtgaacggttttctatagcaaatattctaaacaagtacagtttcctacaacaagctttacagaaactgaagttttgatatttcacaaagatgccaatatactttttaaaaagtagtytgtcatagtagatcttgctgtaaagaacctagacaggaactcaatttcatggaaaaatactgaattggtagatatttaaatttaaatatccatccttcctaactaatgttctctatattttacggcttgacatatattctttgctcttttccattayaaaaagaaaaggtaagtagctgggcactttaccttaacaaagtacttgtgtcaatacatttttcctcttaaagtttctcattaagtaccatataattagtgagttaattttttaaaaaattactactacgtctgaattaaaggagttggggcttctaattttctgtatctatatcagtctstagttaaaaccacacaggggaaatgattatcccttcttcttggaagtattcaagatactttaatatcttgaagatatttgattatctccacccttctaactatgtcattcttcattacttatggtccattccttgttaatcaactagagggtcacactcccaagcctaactattgatttgtttcacctacataatttaagatcatttcctcatattaatcaccttcaggcataaacatgactcaataaccatttcataaaattatttctttggaaatgattgtcttgtaaagtctaagcaacctgagaccatataccatttcttcatgttttccatctcgtaaaacctgcctcctatttttttcatattctttaaagtgtaatgtccatggcacaaccattctctctctgaccagtggctaccagaaatgtggcagaaagaaagatcatgatccttgttagacttaaaggtcagggaggtaaacctcccaaacatctatgtaacccacactaaaacctattctatatgtgtaatccaggaaagtttttaaacattttctaaacttttacttttgacctgtttcacttcttgggattgtaactgcctgatgtgttcttcctgcctgtcatacagacaaaaccagttccctgagataatggcatattgcagtaaagaaagagatgaattaatacaaggccagtcacgtggaagaactggagttatcactcaactcagtctccccaagaacacaggggctagggtttttatagatcatttggtaggaagggagctagggaatgggtactactgattggttggggatgggggtgtgggaaatgttcctcatgtgctgtgtccacctctggttgggggccacaggaccagttgagtcatgagtcacargtccaggtagagtcagtcagttgccaaatgcaaaaacctgaaaaacatctcagaagaccaatcttatattctacatagtgatgttatctataggagcaattagggaagtcacaaatctctgagcagtaatggattataaaacctatgcctatattttagcagagttcaggtccctctcctaatcctaatctcttggcctttcattaggtttcaggtcctgagcaaggagagagctagttttaggaagagactgttattatccttgctccaaagttacattataaactaaattcctttcatggttagcttggcctacacccaggaatgagcaaagccggcccacctgtgaggctagaagcaagatgaagtcagccatgttagatttctttcactctcagaatctttgcaaaggtggtttcagcatagtgagtgcatttatctaacaaaacaccactgattttcatgttagaaataacacatagctaaaactgggaaaaagaagtaataaacttaaataatcagaaggcagaggtcccttctttcggaaggagttgggctgattaatcatgcagtcatacctccttgagtgggtgtggccaataagctaagtcattgtggctatgtgaggagggctgattattccttatctggagctcaagctttcctcacagaaagacaagggcataaagggcctcatggcaaagaagaaggaagccatgtgggaaacacagactatgagtggagagtatcgtagtggtcaccaagtcagaagagccatttatcctggagctaaaaaagactgacagatatagaatagtgtagaacaagatggcctgctctatgggagagccacagtcacaccaggcctagagaggtgcaggctgacttctacctcaaacactggagacaattcagaagctgcataagcagtctgaagacttactaagaaactaaaatgaggctgggtgcgatggctcaggcctgtaatccctgcactttgggaggctgaggcrggtgggtcacctgaggtcaggagttggagatcagcctggccaagatggcaaaaccctgtctctactaaaaatacaaaaattagcctggtgtagtggcacatgcctgtagtcccagctactcaggaggctgaggcaggagaattgcttgaacccaggaggtggaggttgcagtgagttgagattgtgccactgcactccagcctgggcaacaaaggcaaaactccatctgaaaaamataaataaataaattaaatwaaataaaacaagaaaagaaactaaagtgatagagaaatagaaggaatacacacacagaaatgatctcaccttctttaaaatgctcctcaaggaggtctactttaactatcctagtaaagatgacatgaccccacccccacattccyagtctctcttatcctgctttatttttttcatagccttattctcttttattataattaattaaataattacattccatgtttattctctctctccctccatgaagtcggggatttttgtcctatcttcaccaatggatacacaacaaatctaaactgtccctgggacaaagagagtctcaataaatatttatcaaatgaatgagtgagctacacaccactaacagtgttaccacaaggggaaatttctgccgtaattctctaccaagttgaacagtgcgtctttaacttgtcctaaacttactccaggtttcaaggctgctccttgttctaatataccaactgtctcagtctgttggtatatatacttgggcagttataacagaaactccatagactgggtggattcaataagcatttaagctgggtgcagtggtacctgcctatagtcccagctatctgggaggctgaggcaggagtactgcttgagccaatgagtttaaggccagcctgggcaatatggtaagaccatgtccctaaaaaacattatgtcatttctaaaaaccaagcatttttttctcatagttctagtgggtagagagtccaaggtcaaggcaactgcaaattcagtgtctggtggggatcgctttctagttaatagacttcaatcttttctccgtgttctcaaatcagagaaaaggagtaaaggagctctcctggtctcttttctaagggcactagtcccattcacaagggctctgctctcatgatctaattacttctcaaaggtctcacctttgagatcctatagtaattagatcctataaattttcaacatataaatttggaaagatacaaacattcagtccattgtaccaacactgcatttggtaagcacatatgcttaaacgatatcacacttgatttcatgtgccttctcaatcctcagctttccctgattaagaatacctaattactctgcccatttcctcygcaccctccaccttggcctttccactcactattactactatctcctgccttcttggtctctactattctcctcaccatccctgctccctggactatgatcccctgtgagcagggaccacctatatccacccaaagcaatttttatttaatgattttttaatctctacttgtacagcagtcaaaattaataataagagtagaaatggttaatgtatctacaaaaagagttaacatgtttatttataggtttatttaccatttattatcttctttggtcctcaaagcaactctgtgaggtaggtaggcccaatcatattgttatcccaaagcataaaacactctaggttcaaagaaattcagtggcttgtttaaagccagtaggaagttgttaggaattaggcctttagtccagattatttaactggaaatcttgaactctttgtgctagtattttgacaatgttagttgccatttctgaatctgactctatattactgaaattcagtatccagaactgtacatagtacaaacctaaagtattttccttttttctttcaatattctttttctccctatattttactgagtttgttttagctactttggtatattgaaccagtatctttctagagaaccgtatgcaatctctactttttttactctttattctgagtcattaggctataaaaaattaaggtatttctttaagggcatctttccatattgagatttcctggcgtttcacacagacttggcaagttcttcctgtgatttaatctcactgccttgttatttcactagttaaaaatatgcgcctgcacgttttgatatttcactgtgtatttacaacaataatttgtgataatgttaaataagataggtcataagataggtcatgcactcatcagtgaggaataatactggttagacttcttcattcagagcccattattgcctcttgttactgcctcgtacccactcccatttctacacaaaacagccttgtmcacagtcaaaatttcaaagtttccattgttgtgatgtttagaatgataaaatacttaaggccatcctctgtgaagtctccctgaattttcctatgttcacattaaccaccagtaactaaccaaatagctcttcattcaacatatactcaccgagatcatattctccaaaaccccatgtaccactcatcacccaagaccaccttcagaacactactcatcttaccacttaaccaccactccttggaaggtcataccacctggctatataccactccactcttcctcatccatggatctcaagtgtgccttccctgtcctgtgaaaactctgccccctgaagcagtctgcctctttttctcaaatgatgctgtcattctaatttccataagatggtaaagaataactgagtgatgaggaaacagtggtacatgttgaagtgagttaactcttcaagcttccattctaaaayccctaataccaactcatacataaaatctccaggtactggtactgttttatcatttcattgataaaagatgaagtgtttattaacccccaaagaggcagtgtaccataccaagtgagggtgagggctttgcaaccgctaaggcctgtgttcacrgtcactcactctctatgagaccctgagcaagatacttatcctcagtaaatttcattttccttgcctgtgaaatggagataataatagttmctaccttacttaamatagtgcctcatttatgatgcatgtcagaaaatgttagctattatttacacatgattgttattactgatattaaaaagtgagtaaatatttctttttactgttagttcttaaataccttcatgacagctactgctgctcccctaaccgtggatattgcttgtacagaaaacagaacacatatcttcactataggagaaaaaggaagcctcgtgtaacactgcagtgcaaagtcattcatgttgtgcagcttaagtgtcaaaatctcgatgtaaatcctatttactaatcaaaattatgtcagaaatagtgaaatgtrttaaggcatggacatctgcctataaacaatttagagtactctgacagaaaatataggatgattttagtattattttctaatctaagtttttgcttagtattaaaagatgagatttggttatgattttcctttcagacgtcttgcaaagatatcaggaacttaaggcaaataataccttaaatttcaaaatgcaaattactaatttctttcaaaacagatacttaaatgattaagacagtttttctatttttttctctgccaattagcaataatgcacatgaaaaccctaaagaagtggctatccatttacattctcaaggaggcagcagcgttcatccccgaactctgcaaacaaatgaagaaaatagcaggtacctatatacatactgaattcaaaatgttttcaacaactcaaatatcaaaaatggaaacaggacttgaatatgatattgcactaggtaggtcattgataccaaagaatttagaaagtacttcaggagttggaaacttcttttttttttattggattattattgtcatttccamtgttttggggtgatgactctataagttagtacagtcacagtcactactttttcaaagcattcctataatttcctgtatttatgctatgaaactttgmgaagtagtatgcttttttcttgtggaacccaagaatttgctgcctgcttgtacctccaagtcttccagcttcccttaaatgcacagagtcactttaatgtcctctagagactttcactttacctccccagccaccaacccccttgatttctgacttccactgmattctctacttcatttggcctctttgactgctccttcttttggtcctcattcccttgggcttattaaatacctaacctttcattctacctattcaaagcaggcttacygcaagctgttgtgcagtacacattgctaaagatttggggtgaaaagggaaattataccattatcaaaagtggtatgtatcaatattagaaatcactgaactgaaaagtaactagtacaccagggacctgaaaactaccacctgtgagccaaatccagctggccacttgtttttgtgaataaagttttactggggcacagccacacccaatcgtttgtctactgtctctggctcccttttatactacaacagcagagctgagtagttgcaacagagaccccaaaagccaaaagtatttactatctggccctttagtggaagactttgctaacccctgaactatatcatactatgagaaatttctcactggctagttccccttttaacctgggctttccatcctcttcccaggcctctctctctcattggatactcctctcttttgttcaaatctttactgcattctcagggtatgcagtaaatacaggcattcagactctcgggcttcttgcaaattcaaaactccatttttctttaaaattcagagcaatttatttggctctggcttactttggctatgcccaagaatcctaaaatgtcctacccataggtgtttggaacattttcaggaataagatcaccatatgccctagaacagaattaggccagtcctgtagaaagcagaagcaaaagcaccacaatcattactgaatttcctttctttatgtcctacctctttctcatatacctgtgcattaatctaaatttggcatgttacacctacatacatcagaaatcctaaattcaacagaggacagtggaaggggccccaggaaaagtaaaggaagtggaaaaggtattttatagttaaccaaaacataagtagaagcaattcaaacttttctaaacaaaaaattacagattatgtcctattttctcctataatagaaatgaatttgcaatgccctgtttattatctgtcttcctagttgctttgcttctagcttatttgtcattactgtttatgaaaacaaatgaaatatgcattgcttttttaaaattcagaattgatattttactttttgaagctttaatgtttatctggcctgatccttctcaaatgggcatatgtatacactgggggatacatggctaatgctaatataccaaggggatataaaaatcataagatgaaaatggcatggtttcctagagaatatatttttctaatattactccaatagttcaaataaaaattgtattatttcaacatgaacmcaaacacatttataagggaggaaaagacaaataaataatgcaggaagtttaagataaaataagacggctgggcgctgtggctcacgcctgtaatcccagcactttgggcggccgaggcgagtggatcatgagtcaggagatcgaggccattctggctaacacggtgaaaycccttctctactaaatacacacacacacacacaaaatttagccaggcgtggtggtgggcgcctgtagtcccagctactcgggaggctgaggcaggagaatggcgtgagcccgggaggcggagcttgcagtgagccgagatcgcgccactgtactccagcctgggtgacagagcaagactccgtctcaaaaaaaaaaaaaaaaaaaaaaaaaaaagataaaataagacagaaaatattgtgctttcagggatgctttagactatgtctccaaagttcttgcgtgaggcattcattttcctttactatcagagtgctatgggggaaaagtcaggcagaactgattcagggccagctgtgtggccactcatttacaaacagacgaaataacagcagactggaagaacaacaaccatttttacaagagttcattttaaaaatattccacaatgataaattatttgatttagcctcattcctgtcagattacctgcctaaaacacttttccgcctttctttctatctaaattccctgaacccagctccagctctgaattcaatcaaccaagatgctctcccaaacaactctagtccaaaatgatatctctctttgaaactcacatttcctgactacaccatttaaaaaataaactaatttattttaacagtaatatctcatcattgttaaaaacaagaaataggggaaaatataaaaaatataaaaattacctgcaataatctctatctagtagtattcttaagcttctttgcatattrttagacatttgcatatacaccttgagattatattgattgcacaatattgaatcctgctttttttaccaaatgacaaacatttctcccatcattataacagtacataacctatagtaattgacatttcctgtgttgttttttgcctgttaactctattgcattcatgtagttgcttatttattcttcaaacattcttagccacttacaatgtgccatacattgtgcttatgtgtgttttcttttccatgctaaattaacytctgatgaatagagacaattttttaaagatctccycaatctctgagtataatcaaatgwgaaatgttcagtaatcaactgagcacgttaatcaattgagaaatttttcatgcacgtccctrtgaagagatcaccaaacaggctttgtgtgagcaacatggctgtttatttcacctgggtgcaggcgggctgagtctgaaaagagtcagcgaagggagataggggtggggccgttttataagatttgggcaggtaaaggaaaattacagtcaacggggctttgttctctggcgggcagaagtgggggtcgcaaggtgctcagtgggggagctttttgagccaggatgagccaggaaaaggactttcacaaggtaatgtcatcacttaaggcaaggaccggccatttacatttcttttgtggtggaatgtcatcagtaaaggcggggcagggcattttcacttcttttgtgattcttcagttacttcaggccatctgggtgtatacgtgcaagtcacaggggatgcgatggcttggcttgggttcagaggcctgacaaaattaatttatgaaaatttcatttatcctcaactttttggaaatactcttacatcaaagtacacctcaaattgtgtacactgactactgatcacttttcggtaggtataaagtccttaaaaattttgtttcaactttcccttttaagattagaattttgaccacagtgttccatgggaacaaagtgaatcatctgtggcaaaatatgctagtcaagaagtgagttagaatctgtgccaagcgttaagaccttgtgcacccaggttctggggcggagtraagaggcaggctccaaagacatagctgtgtgttggacatgagagtatttggaggaatacaggtaacaggtgatgctgggaagtcytgtgaaatggaasgagaacraagatgaggaatctggtggcmgtaataaccggggaacagatgagctggaggcctcatcaggaggggtgtcccttggtggaaggacaccattccyggccttaaaaggagasgctycagcacggctggggaagcacgtggataccttgtactaaatccactactgcagctcattcttaactgtaagtagaagaggaggacatgctttctgaarctgacccctccaagatgaccagttcctatttctgtcccctgctaccaccatggtgtagaacaacagaatcaaaaaaacattttttctgttatgggtgacctgtacgttttctagaatggaaggaggctgtttagtagctcaactctragaacactttttctttggacaaaattaaaaaaggaaaaggtcaagttaatcattaatctctctgttttctactaatgtctccattttcgccatactttstatgtcctacatagcagccatcacagagggcaataaacacttctaatgaccgtgtaatttatatggaatgctgaaggggtgggttggccctccacacctgtggatgtttctcattaggtggaactagagacttggaaaagaaaragacacagagacaaagtatagagaaagaaaaaagggggcccaggggaccggtgttcagcatacggaggatccaccggcctctgagttcccttagtatttattgatcattaatgggtgtttctcggagagggggatgtggcagggtcataggataatagtggagagaagttcagcaggtaaacacgtgaacaaaggtctcggcatcataaacaaggtaaagaattaactgctgtgctttagatatgtatacacataaatatctcaatgccttaaagagcagtattgctgcctgcatgtcccacctccagccctaaggcggttttcccctaactcagtagatggaatatacaatcgggttttacaccgagacattccattgcccagggatgagcaggagacagatgccttcctcttgtctcaacagcaacgaggcgttccttcctcttttactaatcttcctcagcgcagaccctttacgggtgtcaggctgggggaaggtcaggtctttcccttcccatgaggccatatctcaggctatcacatggggaaaaaccttggacaatacctggatttcctagacagaggtccctgctgccttctgcagtgttttgtgtccctgggtacttgagattagggagtggtgatgactcttaacaagcatgctgccttcaagcatttgtttaacaaagcacatctgcacagcccttaatccatttaaccctgagttgacacagcacatgtttcaggaagcacagggttgggggtagggttacagatcaacagcatctcaaggcagaagaatttttcttagtacagaacaaaatggagtctcctatgtctacttctttctacacagacacagtaacaatctgatctttcttttccccacatttcccccttttcgacaaaaccgccatcatcatcatggctgtttctcgatggttgctgtctctttggagctgttgggtacacctgcagactaacaacagacaaaacaggcacacaaggattaatatgaaatttataatcgtagtacttccgatggtcttaacccaagtgacagggttaagatttgcgaggccatcagcaactcctgcgattgcctcagttcctggcaccaaatttaaatgggcttttgatgtttcaaaaatttgttcctttaatttggaaatgtctaaagtgagattatcttctgttccctgtagatggcatctraccatgtcccagtgatgctcagactcattataaacttggggtgtaatacaaaaatctgagatattccagtcacactgtaactggaaacgatggtctaagttcataagcctgtctcccatccaaatgacagtttgtctaagatcattaatttggtttgccaatttttgatcaataccagattgtgaattccacaatcttgtagaatttttttgccaatcattaacaaagtttactgactgaacagaagagtgcaatgcaactcctgccatagcagccgtagctgtgactgcaattaatcccataatcactgtaattaaagtaaaaatgaatcttttggatctatttaaaatggcttttaatacttcagtcaaaatatggacggatggcaaggcctcccacggttggtccatggacatagaaatccacacggcttctcttgccctcaccagcagaatacactgttgccaattaaaagttgaataaatgcaagtaaacaatctgcaattttcacagcttatagtttgagagtctggtttaataactatatttcctacaactagcatataagggggctttacacaggtttggaaaggaactgttagactggaatttaggttgatagtataaaatagcttacgatctcgtttctaaagtttgatttctagaccaaattctaatgcagtatgaggccacagtaagcctccataattctggatgttcaggaccagaaacaggacttattatttttggtcttggggtagagattcctttttctccctattcccaagggtagaaagactgtaattttttagcttatgtttgtctaaactttctgttaagtcgctatcaacagctrgactcacttgtgcactgggacacgactgagtttgtcctgtgcaattgtggtagaattgacctcgaggtgcccaatctataatagttccgaattcactgttttgtaatatcaccgcactattggccacacattcttcccaaactaaaacttctgtattttttgatcctttgggaatttccttggggcaaggtttccctttaggtctaaattttaatgatctttgataagaaaagtcttgtaaataatttacccgtggcctgagtgacatcccgcttaccatgtgataagtgaatctactgatgggactgacagtaggtacttctaccaaccaattttggactgcaggcattaaacatcctggtgctctccctaggcagataggaggataatgatacccaatggaaatatttatcatcatcccttcttcctcaggtttggcagggcaatgatcatctgtggggccaggtacccatacactatcattaacatatacttcaataggattatccatccatgtgactggtgtttccatctccgcggtggcgcttttctttgcatctccgatgggttcatcgtagatcttcaaatgtctagtgggtatccaaacaggaagctgattttctcctggtgaaacacaagcaaaacctctcccccacgtcaccaccttccctatttcccatgtcttatttttattatctttccaccaaatcagttttccttcatgtgggctgttctttttaccagtaaaatgttgttctgcagaagtagtagtctgatttctataaatgtttaaaaaatttaaagtatagagtgctagattaagttgcatctgaggagtggtacattccttactgtctcccccttctttttgcttaactgagttttgagtgttctattagttctttcaactatggcctgtctgtgggaattatagggaattcctgttgtatgtgaaactttccactgatgtaagaatttttggaaagctttactacagtatcctggtccattgtcagttttgatctttttctggaactcccattacagcaaaacaagataataaatgttttttaacatgggaagtactgtctcgattatctggccctaaacaatgtaaaatcacagtactttgatacacttctgaggctgtgcctacgctgacaagccctgtaacagcctttastttaggccaatttttggccactgatttaaagcaatgatagagacatctgctccagtgtctactaacccttcaaactgttttccttgaataatggccttacacgcaggtctgttctctgagacccgacttgcccaatatgcagcctttcctgttggatcagtgcttccaaaccctcctgttctttttatctcactatttccaaccttaatataaggcaggagtaataattgcgcaatcctgtctcctggactggcactccaaggaattgaagagctaataaccaattgaatttcgccattatagtctgaatcaaccacatcagtacgaatttgaactcccttcagacttagacttgatctacctaagattagtcctacagtcccctcaggcagtgggccatatacccctgtggagattttttgtgggggctcccctggaagcagagagactgcctttatagtacataaatccacagctgcactgccgcttgtggcgggggacaattgttgtactgtggtaactggctcattccctgaggcacttgggacagtgggggttgttgtccctgaaaaccctgaggaacaaagggctgaattgggaatgccccagtttgttgcggggcctgaggctggcccctttgctcattttcccgacaatggttgcccatttctatcaaatttagaatgacattgactagcccagtgttttccttgtttacatcttggacataagtcaggtggctcttttttatttgagactgggcaattcttttttagatgaccaatttgatcacaattataacatttccctccaaatgttctaacttgtcctcctaaagcaactcctgttattgtggaataaagtttagaaaatatccaaagcttatcagcctgtaaattctgggtagttcagttgtctaccatgctgttaattaaatgaaaacatcctgttatttcagggtccttccttgacaaagtactatacagctgaagaacatctcgaatacaattttggtgggaaaggagccaattgatttcaacagaatcagatctgagcttcataaagtctttgaagtgacttcacagagacgcagacatgtgcacttgaagatgctgccccttccctggtacctagcaaagctcctgcctctttgtgtgcgtcactgtgaaacccccacccttctgcctcgtgctaaacgcacacagtatctagtcaggggaaaagactgcatttaggagatagaaaatagtttggattacttaaaggaataaggtgttgcctggaatttctggtttgtaaggtggtcactgttcttttttaaaatatttgtaatatggaatgggctcagtaagaagagcttggaaaatgcagaaagttatgaaaaataagtcacttataattatgctacctactgataaccactcctaatattttgattcattttctgcctatcttctttcacatatgtgtttttttacatacgtacttttcccccttagtttgtttccttttattttatagagcagaaccctagtcttttaaacagtttagagtgaaatatatgctatatcagtttttactttctctagggagaaaaattaatttactagaaaggcatgaaatgatcatgggaagagtggttaagactactgaagagaaatatttggaaaataagatttcgatatcttctttttttttgagatggagtctggctctgtctcccaggctggagtgcagtggcgtaatctcggctcactgcaagctccgcctcccgggttgacaccattttcctgcctcagcctcctgagtagttgggaytaccagtagatgggactacaggcacctgccaacackcccggctaatttttttgtatttttagtagagacggggtttcaccatgttagccaggatggtctggatctcctgacctcgtgatccaccygcctcggcctcccaaagtgctgcgattacaggcatgagccaccgcgcctggccgctttcgatattttctaaactttaattcaaaagcactttgtgctgtgttctatataaaaaacataataaaaattgaaatgaaagaataattgttattataaaagtactagcttacttttgtatggattcagaatatactaaattaactttttaaaacacaacttttaaaaaatgtatcaaaataataaacgtgttctgatatttttaaaataagtgaccttgtgttctttaaccagtccacatctttagagaacaaaaatgtgttatgatattatgggccatgctaatgacctctagaaaacatcagaatatttctggatatttaataatagctttatatatgactaatgctcatttctatgtaattctgtttaatagttgctttaaaggtgaattttgccacatttactttgacagcagtataaggagtgagatagacatgaacctgaatttcaatttaaaatcatggaagagagggaaaaaaaaccagcttaagaaaaatcaactgataaactgcaagaaaaaaatgcaacttacatcacaaaagctaattgctttattatttagagagtacttaaaaattaaagaccaaacttctctccacccaacaaaaatgggcaaaggacatacagctaggtcaccaagaaagaagggcaaataggtggtgagtayatgtaaagatacttgataggacttttgcttagttgaatctttagcaaatctcttttatttcttgggattttgaagaagtaatttttaaaggaggactagaaactaagtgattgggaattggcctttttagaattaaaatttcccattacaagaaaaaaaaatcctgtgttcttttttttttccagaatggagtaggtcagtgagcaatgtgattaataaatatttcaatgtctgtgacttttgatttattttggagacagggtcttgctctgttacccaggctggagtgcagtggtgctatctaggcttactgcaacctcacctgtcactttttaattgcaagaaagctgaaaggtttttttctattatatcagttataatgakaaatactgtatatactaactatgagtaaaatactatattgcctaacttgtattattaagcaattctgctaacctgtgaccttacattttcatctgaaaagcaggggctggacaccaattgccctatgaagctattgctagtcctaacattctttgttttgtttgcttttttggcacacttaagtgtgtactatgaagtttatgatgctttaatgaaattttctgtctctaccattgtaatgagaaaggaataaaatactttattttgcaaatctacttatggaatatagttctgtacctgattgttttcataatccctgtgttgatgtgtaatgccacagacatgctcttgatrgtaacaggaaagaaaatcagacacagctaaacataaaggtcagttggctggcaggtgcttagcaggtgtaaatagaggcccattcatgctgctccacttgctcctgaaaagcataatgtaaatacagtatactaattaggaggcaaagaaccatctaacatggttcttttttttttttttttttttttttgagataaagtcttgctctgtcaccaggctggagtgcagtggcgcratcttgactcactgcaacctccgcctcccaggttcaagcaattcccctgcctcagcctcctgagtagctgggactacaggtgtgcgccaccacgcccagctaattttttgtattttagtacagacggggtttcaccatgttggccaggatggtctaratctcctgacctcgtgatctgcccacctcggcctcccaaagtgctgggattacaggcatgagccaccgcgcccagccctaacatcaaattttaaaagagttggccacagtttaatgacatccctgcacaccagcctccacccatactgcccttcataagccccttaaaggagatcccatagttctaaaccgggtccacaaacacasatatcctcattctctccttttcttctctttggcagtttgacaaaatctttagggggaattggaggaaacattaatytcctaaatcaacttcattcaaagctttggcttcaagttctacccgttaaggcctcaggaagttcattgtcgacattgaactcagtcactaaaatgacctcaaggctaagggatagaccacagctccacttcacaagtaagcttgcaacacctgatttaggaaagtttgctgtgcagacagttgtagctcatccattttacagaccgatctcgatttgtttcctagggtctaaaattatttaaatcaaaatctctcagaaatttctggacatttaataaattcatgctggaggagaactggcagagatatgttaaatgcacttgaccacaagaaccatttatttcatccaatatttaccagctattcattgtacacttactacagattttggcactggagatattataagaaagctctaaccctgacttatggaacttatcccaaaaaataggaaacaaggctcagaaccattcaaatgaagcttcagttaactcaaataaaaattagttttataaatttaatgtgaaagtcttcgagtatattaagaatggcttgattaaccccagggatggaaattttactgattgaaagaaagtttcaataaaataccgatcttygaatctaatctgacacctgaaactaggaaatcaaacactagccatattttttcttctattctttataataatttttctcatgagaaaaaggtatctttcttccaagcctgaaaataaatggagaatttttaatatctattgatgtggagaaaaataaatagactatctgctttcacaaataagtgctggcattgagccacagaacatgtctgtcatattgctctttcacaccatacattaacaggaataataatttctcctcattgagtttcctatttactatccccttaattatacctcctttaattactgtcatagagtgtctgaattttataatccaagatactaagatgtttatttgatataccaccagactcaatgtcttgtattctatgccaaaaatttgaaaatgtttgggaagaggaaattccgtggtttggtgaacccagaaagtcttcagtacatctcagttatagaactgtattaaatacatttaaactctataattccataagacccattttaggtttatacactaagcatcyaattcctcactatcctctcatacaaaccctgtgtaatacaagttctactcccataattctatgaacaaaacaacaattgatacatagatttgatttttaaaatacattttctttaccttattctaartgtaacatagggtcaacatagaaaaagaaaactgaaaagcacaaggaaagtgaaatatctataatcttaaccattgttaattttgttgtgttccaaattagtgtatgtatatatatatatatatatatatatwgcatttttgttttaataaaaggactgccaaaatgcacatgccaatttggactctgctttttccacttacaatgatatcatagtttctcacatttggtattcttttgcaatacttgctgcatagaattccatcacacaaaggtaactgccagaaattccttattacttttgctagacacttagggtttacattttttacaaaaattataaatctttgatcacagctctgatgatttctctgggaactgagagcctaacacaagtcatttccactttaagacttttaacattctgaaaagttatgttacaaacagagtgctggtccccctgcaacatgytcactcacattggctgacrttttaattctttgccaatctgaggggaagagatgtcaactttttttgtttgctcttttaatgccagtcatgttcccttttttttcccccttttaccagtcatactggcttactcagaaccctacaaatcaatcctgctcattcttaattttccaacattgttcctgagattgtttcaccagaaaagttctcccccttatccacttcgcctaacaatttctacccatcccaatcctcctgcatttattgcttccaggaatttggcacttaggacacccttgtccttacattgttcatgcatgtatatttcgtcttcaataaaacatttagttgctcaagggcaagggtcccatagagtctcaatatgctaacggcctggtgttgcttaataatttagattctgacgggtcctctccagggaggggagcaaagggcaaattatcttaggggctgggagtgcagaagccaaacctttgagactgtgaaaagaagacggcgccgagacgattcagtagcaggcattcaagcaagaaaaactcaaatattgttcccaataatgcctgactaatgccaaataccaagtaagggcccaggcagtcctgacagcctgcagtgccccaggataaaactaaccctgaggggtgctagcccacgataaccccctgccagggctctggacacgccctgtctcctcgaaggccaacgggctgcccctgcgcgccgaggccccgccccgcggcccgccgattggccccagccgccccggcgctaagactcaatttcacactacrcgcccaggccacgcccacctgtcatgcggccctggaaactgtgagtttggggattgttgtgtccactaaccggactcagaagggacttccctgctcggctggctttcggtttctctgctcacctccggataaatcacggggtctcccgcgccgctcatggcgcctcccgtccgtctcgagcgtccctttccttccyggcgctttcctgggttgcttctggcggccctggtgttgctgctgtcctccttctccggtaggaccccggggtggattcgcgcgtccgcggcgaggctagarctctgctcagtcagtcgggcaggaggcgcggggcgaagctcactgcacgtcgtgcctgcttgggatagagagcgaggccagggttctccgaggggtgccgtgctcagatcccgggggtatgtggcgggggatgcgggaaccacgcagaagcttgtttggtggcatcgtgtgcgcggscgacatttacgcaggatctggctgcgttcccaaaagaagcgtgaatcgtgttttcgggattgagcccagtcagcaaggggagggcttactgggcgccccaggtragggcttgctctggagtgcacaggtgcgtgggattgttgctagagcccgtgctgtgcccgtggtgagagtttgccctgtgttcccttggtgccttggtgagtagggtgttcattagggcttggacagtacccgcggtaagggttgcagtgcgtctgctktgccccatgggctgggctggcctgggctgggctgggcgagcaggggcctggccaggtgttgctgggagcgtgctgtgcgcaagtggcctgtgtgcggagttcactgtgggcaagacagctcactgtttgctttgagtggagcgagcgcggactctgcggctagggagggcatgttgagtgagagcaggctctcagtgcctggggttagagaggtggtaagggcgcaccatgcttttagtgcyttctgtgaacagtgtccgtgttgcctgagatcgtattggtcttgaattttaagtggctgcttttttggggggtgggtgggccatcgagtcatcttcctgttcccaaccaatatagacagtatctgattccattgcctagtggctttttgacattgttttccttcttttcattagtttgagtcatatttgagagatgtgaagcaacctaaaaaacactggtagccaaacctagtgagaaattagtatcctaacaaaggaaggcagataatgttaatcttgttttcccctacagctcataaactgaagcttaaggcctatcccactgttytgtatttcattgaatggaatcaatatttttaaaaatgcatgctaggccaggcccagttgctcacacctgtgatcccagcactttgggaggcccaagttgggtgattgcttaagcccaggagttcaagatcagcctggacaacatgtcaaaaccccatgtctacaaaaaataaaaaaattagatgggcatggtggtgtatgcccgtggtcccaactactccagaggctgaggtgggaggatcgcttga

SEQ ID NO: 13279 - DNA, 43975 bp, Homo sapiens
tttcctactgcagagggaggaggcaagacttctacccgtagccagatggggaggcatgggcacaggaacggctcttgggtgaagtggagggaggaagaggaggactgaaggcsaaggccacrtcaggagtgatgggakaccccacaaaggcctccctgagaagmgctagagacaaagatgagtgcctcctcatctggaagatgaaaagatgtctttgcctgcatgggctgcyrtcacaaagtcccaggggctagggggcttcaacaacagaaatttctttctttacaactctggaagctggaagtctgagattaaggcaccagcaggatwtgttccttccaaggcccctctccttggctcacaggtggctgccttctccctgtcttcacctggtcttccctctgtgcatgtctctatcctgatctcctctttttaatttttgtgtaaggacgtagtcatattgggttggggcccactctagtgacctcattctaactcagtcccctctttaaaagccctatctccagatatagtcacattctggggtattgaaggtaaggacttcagyatatgcattttgggggcacaattcagccagaacaggaggacrgtggggatgtccacatgaagaggttcaggcagaattcctttaggaggggaagatgtctctctgtgggacaagggtggcatggagcagcccctgggggaaggagaaggggacwgtttgcatactggtattctgcctaccccagggtggacactcactcagcgtttgctgaatgaacagggcaaggccagcagtgctgatggtsccaggcatgtagctggtctgagttcatagaaggaccacagcgccctgccatgtgccaaaccaggacaccagagtgaagrccagaagctcacatggaagcagcttagttccctggtaacctcgagatgctgatgagacagagcagagcagagggaaccctctccctccatatcccatcctccaaaatgtgtcccttgatgtggatgggtagacaggattcctgccctggcagccagacccctgccttgggtctgcacctcctctccctccttcctctccccgtcatccctraatcttgtcctcragccactgccaccctgtgtaaaccctcatgyccagtcttgsgggtgccatcccttctctttraagctgaatggaccaaacatacccattgagtgttgggtggggacatctctggaaagtcagcacctggaccagctccacccctctctgaggacaccttctttccctttcagaacaaagaacakccaccatgcagctcttcctcctcttgtgcctggtgcttctcagccctcagggggcctcccttcaccgccaccacccccgggagatgaagaagagagtcgaggacctccatgtaggtgccacggtggcccccagcrgcagaagggactttaccttygacctctacagggycttggcttccgctgcccccagccagaryatcttcttctcccctgtgagcatctccatgagcctggccatgctctccctgggggctgggtccagcacaaagatgcagatcctggaggkcctgggcctcaacctccagaaaagctcagagraggagctgcacagaggctttcagcagctccytcaggaactcaaccagsccagagatggcttccagctgagcctcggcaatgcccttttcaccgacctggtggtagacctgcaggacaccttcgtaagtgccatgaagacgctgtacctggcagacactttcccyaccaactttagggactctgcaggggccatgaagcagatcaatgattatgtggcaaagcaaacgaagggcaagattgtggacttgcttaagaacctmgatagcaatgcggtcgtgatcatggtgaattacatcttctttaaaggtaaggcccttgggcccaaacctgcactttctttggcttttctgctgcttttatctaaagaatacccaattccctcacatacataaaagacggggagtacgttaagttcttttgggtgcctgttgagaaaaattaagtaaacaagcagccagagaaggtaagatgaatgccttcttgctgtggatgggattagtgaggctgagatgctgtttcctccacggaggaagagctggttgctgtcttcgggcccctgrggacatctgaagccccagctttctacaggctctgaagtatgaacccattgtggccaccatggcaaagacaccaacaccttagccactcagggcaggacacagaccccagaagggcttaaagggcatttcccagtcccccgtatccctcagatcttggcccctctgccctcatagaggccaagactccctcagacaaatgcttgttcctctgaaatgcctcctcctgactyctcagcaagagctgacctctgcttatctccccgacactccttgtaagcattcctgctcgcctctgcagctcctgccagttgctgaccctggggaaagcaagagtggatagagaggagaagagaggagaggagagggtgggaagggttgcgaaggaaggtaaattgttaacacctccccttcctatggtcacagatcatgagtatctttggccatttgggtggctataacaaaataccataaactgggtggcttagcaacaacaaacatatatttctcatagttctggaggctgagaagtccakgatcaaggcactggcagatgcagtgcccattccttggttcatagagagtgccttcttagtatatccttgctggaaggaggaaggcagctctctgtggtctcttttgtaaggacaccgatcctgttcatgacagctccacccccatgacctaatcaactcccaaaggccccctgtcctaataccaccaccttgggggttaggtttcaacatatgaacaatgtggggacacaaacattgagaccacagcastgagtgtcgaacttggactctgagatttcctatcccctggtgcagggcagtccccattacaccagattgctgagggcagctgggaaataagctaaggacggtattgactggggtcttccttcgataacgattaagaagttggaaacaggccaggcatggtggctcacgcctataatcccaacattttaggaggccgagatgggcagatcacctgaggtcaggagttcgagatcagcctggccaacatagtgaaaccccgtctctactaaaaaatacagaaattagccaggcatggtggtgggcgcctgtaattccagctacttgggaggctgaggcaggagaatcacttgaacctgggaggtgggggctgtagtgagccaaaattgcgccactgcactccagcatgggtcacagagcgagactccatctcaaaaagaagaaaaaaagaaaaaaaagaaaaaaagaaataaaataaaataaaaagaagttggaaacaatcacttgtagcgttttgttcagaagttcccawaggaaggtcagagaagggtcattgaagacttcccaatgggaaaaaccattcatttccaggatccatactaacttctttctaaaatttaaatcaaaatattgsaatgaaagtgcaaacagagaagttcacccagatatcaggtagcattcacagccagccacatttttcaccctcttcacttggagatttggtcttgagtaaaacgttagagaatcagagaacaycagggrtccagggcctctgaagatgtgaaaaccaacctccttgttttgcaaatgtggaaggaaaagtcccacgaaaagtccaagaatgtgcccaatgttataaagagacttgccttcatattcaagaggttcaacagtcactgctctggggctgccrtaaagatggtctccgctggctatctttactgtcttcactccttttatttgcagctgagaatttctaattctgacacaaaattctttttcatttttcccttttttcatctttagctaagtgggagacaagcttcaaccacaaasgcacccaagagcaagacttctacgtgacctyggagactgtggtgcgggtacccatgatgagccgcgaggatcagtatcactacctcctggaccggaacctctcctgcagggtggtgggggtsccctaccaaggcaatgccacggctttgttcattctccccagtgagggaaagatgcagcaggtggagaatggactgagtgagaaaacgctgaggaagtggcttaagatgttcaaaaagaggtactttcagactaccccagggccagcctaaacccacacagccccagggagacacacacgccctaccagggccacacagcactggtgggaaggactcacccagccaaggagctgcctccaggcccagaggcatcctgtgacatccaagtcctgggggcctagcccagttggagggacaagagctggaaactgggttccttagggtggtgccagagtgggcagagacctctgggcagcccacrtccaagtccagagcaaggggaggctcatcctagaaaagaggccagaggagccataaccaccattgttccttgggttaaggagtccttttttaaaaccatcaaaactaagaatccagtgcattatgaatccaaggggtgaggctcagtgtgccaatgccccagaacagtctaagaaagctccttttccctttccaggcagctcgagctttaccttcccaaattctccattgagggctcctatcagctggagaaagtcctccccagtctggggatcagtaacgtcttcacctcccatgctgatctgtccsgcatcagcaaccactcaaatatccaggtgtctgaggtgggttcagaagctcctatgcatctgcttcccaagrkctattctgttctattctttctaktctactctaccccatttcattccattccattccactcaactccactccactccactccactccagttcactytattcaattccactccactccactccagttcactytattcaattccactccactccactccagttcactctattcagttccactccactccactccactccagttcactctattccattccactccattccactcctccactcctctcatccactccactctactcctccactccacatctccactccactcctccactccactcctccactccactcatccactccactcctccactccactcctccactccactcctccactccactccactcatccactccactcttccattccactccattccaytcctccactccactcttccactccactccattccactcctccactccactccactcyattctattctattccattccattctactctattctattccattccattgcagtcaactccactccactctctactattctattccactcctctcccctccactccattccattgcagtccactccactgcactccactcctttattctrttctrttctattctattctattctattctattctattctattctattctattctattctattctattctctccctctccctctcttttcccacaagtagtgaaagtttcactttgtgtcttatccttcatgtaatgggaagccatatccaccactgttccttgagttaaggagtcctgttttaaacaatcaaaactaagaaggcacttcctagctatgtgrtctccaaaaaayacttgactctctgagcttcctttctctcttctataaaattgaagaattacaccttgctcaaagatgccatgagaattcaatgacagacacatgcgaagtcaccccccagcacagtgcctggggcagagtagctgctccattgttccatttcctacttgctccatggctcagttgaacagatacttagaggttgatgcccataggcagaagctttgccatttgctatgatgacttcacctgcccctrgtggcctggtgatgcctggtgtctcccctgcagatggtgcacaaagctgtggtggaggtggacgagtcgggaaccagagcagcggcagccacggggacaatmttcactttcaggtcrgcccgcctgaactctcagaggctagtgttcaacaggccctttctgatgttcattgtggataacaacatcctcttccttggcaaagtgaaccgcccctgaggtggggcttctcctgaaatctacaggcctcagggtgrgagatgaagggggctawgctatggcccwtctgtatgctggtagctagtgatttacacaggtttagttgactaatgaggyattacaaataatattactctatgatgattgcttccacccacacractgcaacatacaggtgccttggggaaatgtggagaacattcaatcttgccgtcactattcatcartgaagattarcactgagatccagagaggctggatgacttgctcaagttcaccagcatggtagtggcaaagagaggtccagagtcctggcccttgatgcccagctcagtgccacaaagctcartaggagggatgttccagtggatgagggccaccaggaagcacaggtccaaggctggtcccacacttatcagcagcaacaactstcagttcatcctgcatgggaaaaatgttggaatgggagtctgaaatggggctactgtttcagtcctaaygtgctgtgtgacattgggacaacactttccctctctggacctcagtttccctctgtatacaaggatcagattcttgctgtgacccaagaactcctgaaatcatatagaaargctggggtgggccctgtcattcrtggttgatttcaatacactcaagtgccattcatcctttaagaaaaacatctggatatcaaggtggaaatggcccatttaatgattgattatatcattttgtggatatagttataatctgatgggcctggctgggagtggaagaagggaagccttttgcaaatagtagagtrtcagttgcaggtgccaatgrctaactttttgaattctatgttggcattaacaataaagcattttgcaaacactggttataactgtctttatggaggcagctctgggaatggtgacattgatagcttaccatgctccaggccgggtgcctggcccttcacctggatggtcgcatttgcccctcataagactcccatgaagaaaggcaccactrttatcccatctgttattcacagatgggaaaggcaaggcttgaagtggttaggtggcttacccagtcacatatcttctaagtggtgcagccagaatttggcggggggagtgcgaccaagaaccctacactcagtcctgtgctctgtgctrtggaggagagatgaccaggagcagaaacttcattcagggrcatctcaggcaccagctcccccatgagccagctaagttccctccctcccttcaccaagcaccatgtgtttcctcatgtgccraatgaagaggattagatactcaagaatggaatgagtgggtgagtgagtccttcgctgcacccaagtctgattttctgtgcgcctgctcaccccaccctgcatgttctaagcatgcttccataaggctgtgccccaccctctgattctagagtctggactgtatcagaggtgagtgcctactagaggtaacaaggtcaggaccccaaaccttgtccatcccccraagtactgagcccccaccatgcaccagcccatgccagatgctttgcacttgtgatatcacccatcccttgacaacccagcaagttctattattgttcccattttacaggcaataacataagtgctttcccagggtcccacgctggtgacagtgagggcccagggtctgagagcccagatcgcacatgtgcgggctggtggcaggggagatggcagcaaccagactcagacatttctctgcagttgtgctgtgggctcagggtggctctttaygaaggggccccttcrtggggtcatgcactcctgtgtgytttcccttgcatcatgccttgcctgtcttggcaaatatttctctggagtttacccagccagtccaaggtcacagggaagccctgtctgtgtctcacacagaaggtyaacgtccagcactgtccaaactttactcagcaaacagtcacaaagcagctcctgtgtggggggtcaggggtgggctcactgtggtctctgctgcatgtcacacattgaagcactgtgctgggrgtcatcrcaggctgtttaactcaattgtcacatgagcctgggtrcacaaaatggtagagcagctcagagagagatggacagacagcatgaacctctgaggagtcaggttttcttggatgaagggacactaagatggctttggagcgtgagaaggacytcacctagcaaatgtgggaaaggagtgagacctccaggcagagggactggctggagacgagcgtgatgtggtgagccatggagtgtatgggtccccacagaacttcagtctgggcctgcacagggcatgtggaggagacaaggaggagggaggtggccgtgccggcggttcagtgacagagatcctaaatgggaggccaatcctaaatgggatgatctctttcatccyaatttcagggtagtttggtcatccrcgccacattccaagtgtcccctgggccctttctctccctcacccycctgtctgcacatgagtagatgcctccaygcagccctcccaggacgctcacctctatccacagatgcttctccaaaacccaccaggccctcccatggaacgagctcacctacagggtaaaatcaggtcacggtcacatatagcctgactactcccctcaggaccctcattcacagccactgtattaatttgctggggctgccaaaacaaagtgtcctcatctgggaggctgcagtagatttgctgaaattgatttgctagcgttgctgaaattgattcaagcttgattctggagcttgaatcgaagatcaaggcaagtgcagggctggtttccctgaggcctctccccttggtttgcaggtggctctcctctccctatgtcttcacatggtcctcctctgcatgtgcctgagttctaacttcctctcctctcctcatctmcaccagtcttatagaattagggccccccartgacctcattctaacttaataacctctttaaagkctctatctccaaatacagtcacattttgaaatattgagggttaggacttcagtgtatgaattttgggaggaygcaactcagccaggctcactcttatcattacagctgcactagtgccatgcctggttcccagtggacaccccaggaacagccatccatccagagtgatattctgtgacatcccctacactccacagctcatcacatcacactcgtctccagtcggtctgtctgcctggaagtcccacacctgttcccacatccactgtctgggaggtccttttcatgcttcaaagccagctcagtgtcctcctttgtacaaaaaaatgtcctgacctctcagaacttcattctttctctctttctgtcratctttgtctgaactcctctatcattttgtgcacccaggaacgtgtgacaattgagttgaacaggctgcaaaaacgaaaaagaagaaagaaatgctgagttaaacaggctgcaatgacccccagcacggtgcttcaatgcatgaaacgcatcaatgacttgcagcagaggccacactcagcccccctctgccctttgagtttttgcagctcttgccaagatcattcttkttcttagaaagcccaccattattttcctytctagccatatggattctaaaagttcctcttgtgagctgtaatcagaatgcagagaagtaatacaaggttagggcccaggactcyttctcccacctctccctgcagagactcagatttttttaaaaaatgaccttggtcttcrggggaagaacttcccaccacagtgaacagccatgcccagcctacacttgactgtgcggcttacttagctcatccatccaaaggctattcctgggttgcctagtggaaatccaggcatggagctagtgcaagcacaatgataagagtgagcctggcagacactgaccccagcaataatcaggtaaacaaataaacagaactacaaactatgatgacaasaattcatccatccacagatattcactgaatggccactgtgtgcctggcactgttccaagtgctgaagaaaaatgaagaaaacaaaaatccctgcccttatagaggagacattataatgtgacaagataacataatgaaaaagaatgaagaataaaatagaaaagtaaaatggattgcatgtcacttgatgacaagtactgtggaatgaggcygtcatctaaayggagcacagaaagtggaacatggcgacatctcagccaaaagacccggcagacaccatcttggccaagggatcgaggttggcatcgccagctgtgagcagtgctgacatcttattatcttcgatatggcgtcatgagcaggctgcctcctcttggtgggatcttcccccaaacccagaacctcagtctaatcacaagaaaatgacagccaatcccaagttcagggacatttggcaaaatagcccaccactcctacttaaaagtgtcgaggtcttgaaaggcaagraaaccctgggaaatcgtctttggccrgaggaaactmagcagacatgacgactaaatgcaatgtagaatcctcggacagaaaaggacattagtrggacagctggtgaaacccaagtaagtccaggctgtaccaatgtccacttcccagttctgaggaacatgctgtggtctgtccacatttacattaggagaagcagggagagcgtatatgggacytctctgtattgtttttataacttttctgtaaatccaaaactgtcttaaaatagtttttttaaattatactttaagttmtggggtacaggtgcagaatatgcaggtttgttacataggtatacatgtaccatggtggtttgctgcaccccctttttttaagaaaatgtttcaaaaagaaaaacagccaagtaggggagggcacacgagtggggttgggaattgcaaaggcagaagcaggagaccagttaaggaagaaaacggggcactaagagagacaatcaggaggacctgctgcagccagggccctgaggggctccctgaggtggtgccattgaagcggagttctgagggacaatcaggtgtagacactgtgagtctcagaagtgggaaaaggggagtgctgtgcacaaaattgagagacggtgcctgtggcagcagctgaggagggaaagagaaggtggggtgggaggcccatcccttccttggccacaaggacactgagtagggtgctgagatgggagtaacagtaataataacaggcagcacttggaggctgcgtcccgtgtgtctggcactcgcctaagccctttgtgcacattggctgagttaatgcagaggtgaactgagaggcacctggggtaggggctgggggacaggaagcaggtgacatctccagtcctctccagcgtccttagagcaggtctacagtactgatccttctctgccacccttctccaagaccaccttggtgggagtaaggggctctaaggtgacaacacacacaggagccacagacacaagacacaagacacttttgactcccaggagaacctagtatgggcawccacacacccttcctgatggtgaytttttatgtagacatgcagagtgcagttaaccagctgttcctgcacacatctggattgctactcacacatctgtgcacacacacacacagcctcctggagcactgtggcttctgggtggctaacacagctaccacctctggttgtgctgagctgagcacccattgcctgctggggtggggagagggcaggcactttccctgcgcgaccccgtttaaccctctctgccccactgatgtggtccctgttgtccccgatgcacagaggaagaayctgtgtcaggacccccagagcggtgtctccactaagcagaagtctctgtttctctcctggcctctcccagaggggctgctctgaagcatgtggatttgatcaggataatcaaggtaaatgatccttatcttgatccatcacaaatgttaaggtacaaggctgtggagatggagagtgggtggagtctctgctgcccggtatcctaagctgggtgatcgcaagcagacacacacatgaccacctcttgggccatgcagggggaatgaatgtaatgaggccgatgttacagggttattgaaggctcaggggagaccaggccaaaaaaaaaaaaaaaaaaaaagctatgacctgagacctccctatagcagtgtttctcaaactctgattaacgttacttgaggagcttgttaaaaatacatactcctggccctgatcagataaatcagaatatttgacacagagtctttaagctccccctcgggattcaaatgcacacagatttttggtgctttgccgcctacagtacaagagagggcaggactgtcctgttcagtgcactgtgaccyggacgctcaggcccacggaactcccctactccccctgctccctgcggtgccacccacctagctttcrtgcctgagggtggtcctcagactcctcctagaacaggcccagaggctcttagctatgtaagtattcattcctccaatcactgcagagcactcaccaggtaacaagcacgcacacccaggcgagttccccatgctcgtccccacgttgatatctcagactctacaagtcttcagctgctgcctaggactctgtaagtccttgagcttgggacccctaccacacacaagcgctgggcgtgccccacaggcggggaagtgctggccatatacacccagtgaagtgggaattccagataatgagtaactttttagcaaagtacccatgccctttgaattgtgaggtgtttttgtttgctaaatctgacaattctacctgtagggaacagggatgattgagaagcagctgctccgatggccagaagccaacagccttccctgcagagatgcgggaagtcccagggacagcaggaaagtccaggcactgcactggcagtgggattggggcttgggtcagaagagggtcagggccacaaggaaggaccctgggaggcttcctgctacataatatgagggccgggagcataacaaaggattgccttatccatgattgcatcatcaaactgaagcctgagacagaacattctgtgaggtggccttgttcactgcagaggagctgactcacacagttttgtctgggaagttgcaacctgtgccaggagtagccagcctgggagtaacaaagaggcttttctactgcaggttttcctagagctcctctccctccctcccctggccaaaggtgagctctgcagggagggtccggctctaggggactttgctcctgggcatcctagctgcagagattggtggggcttgtccagaaaggggggtcttctggacctsgggatgatgcagttgggcctcagggtactgggaggccagtaggggtgcttcaaactggccagtaacctgaaggactcatattcttaaggatatcctggtggccacgtagaaaacagtcaggtggggtgagggtggaagtaagraccagctcagaggtcactgagggtgcagccagacaggctgggacccacgtgggcagcagaggtggrgagtagggatgtggagggggagacccagccccacgctgggggccctgaggggaggtggaggctgagccaggagaagaggcaccacccactcacttcctgcttgctgaatgactgtgaggagcaggagaaggagcaaaagagcaagtgaggaagtcaagggggttatttgggggcaatgctccatgtgagggtagctaaggacaggtgccaaggaggcccctgtgtcaaaatcccaggtcaaaatgttagttaccagagacctctgataaagacagagccacaggtaaaacgcagcggcacaacccctcgaccctaaaatcagaagcctatctgtgtcctggcraggagagaagcacgagtgatcatccacacygccaggacgcaagcccgttatttctgatgcaaaacccaggctccctccagggctggcacagaggactgccagaggagtcaggrggcctccaccttccccagctgcgcaacctcagagggtgtctccttatctctggggtcactgtgtcttcatggccaggctgggcacaggtcagctgggagtggagctgtgtttgcagggaaggaacgagggtggacgtcgaagccaacctgcctggttcagaatcctggctcagcttggcacttaccagcagtggtggtgaggccttgggaatgagctccgcctccctgtacttccgtttcctcatatctaaaattgagggagtaatgggacccgcctcagtgggtgttcatgtggattccatgtgctcttaagcataaagaacagagcagctatgatgaccatcatctatgtcactgggcctccggaagtgagggaaggagaggcagatttgcttaagtagaaggaaggcggaggaaggtagtaaggcgtcagccatgtggcacagattgtattatgagatttactggttttcttacttcgtcctcaaatttccctccttacccacttcccatgattcctgagagtcaagaggacgggagctgtggaatgtgttagtcatctactgctgcagagtaaatagcccatgattatctcacrgagytcctgagggtcaggaatccaggattgctgttggccagggcaatcccagaaggctcacttgtggggctgttggtagaaggtctcagttcctccctatgtgggctactcacagggctgctcaaatgtgacttrgagagagagagagagagagagagagagagagagagaggcttgtttgtttagtgtccaggaccgagagaggatatagagagaaagcacaaaagagagagagaaaaaaagagaaaggcagagagagagatagagacagagacacagacagttgttgaatgtccaggaccaagagagagacaaaagacagaaagcacaaaatagaggggaaaagagaaagacagagagagtaagggacagagagagggggacacagagagagaacccatggcagaagcagcagtcttttttttttgagacagagtctcactctgtcgcccaggctggagtgcagtggcgtgatctcggctcactgcaagctctgcctcccaggttcacaccattctcctgcctcagcctcccaagtagctgggactacaggcgcccgccaacacgcccagctaattttttgtatttttagtagagacggggtttcactgtgttagccaggatggtctcgatctcctgacctcgtgatctgcccgcctcggcctcccaaagtgctgagattacaggtctgagccaccacgcctggccagaagcatcagtctttttataacccaatctcggaaatgacaccccaccccttctgccttagaaagaagtcactaagtccagtccaatgtgagagaaagtaattaagctctatctcttcaaggaagtggtatcagacatttgtggacacatttgtaaaatgaccagagcgttagaacctcagaatccagcagactaattgccctcatagtagattattaatgttttaaaaaatggatggactagctgaaggaataaatgaacgagtgagtgagcaggatatttctgtctcatttcacatgcagaaaaggcactgaggctcagaggaattaggacatgtgtgaggttctctaggcagtaaggggtgggggctggcctggtttgccagaactcggagatgcagcatgcagcgtgcagcagttctgaaatggaagccagggatggcaagctacagcagccactccctcccggagggagaacggacccaacaccaaggaggaagggatgactcagcagccctcaaaacagagtcaggagttctccctgcttttgccaaaccctctrcaggcacctcttatccatacagggacgcagccaaaggcctagctgtgctgaaggaaatttgcaaatcctgcctcaaatctgcagccagtatctcccccagcagcctccaaaccaggccagcacgaacccagccagagagcagcataggtgttgggcaaaaacaggctattgactccatccttttctaacagagaccagagtcctctggccttccacagagaaggtggggccttctcagggttctctggatctgctggtgtcagtcagtatctatttcttcttcctaagaattcttttttttttttttgagatggagtttttgctctgttgcccaggctggaatgcaatggcacaatctcagctcactgaaacctctgcctgccgggttcaagggattctcctgcctcaacctcccgagtaactgggattacaggcacccaccaccacacagggctaatttttgtatttttagtagagacaaggtttcaccatgttggccaggctggtctcaaactcttgatctcaggtgatccacctgcctcagcctcccaaagtgctagaattacaggcatgagccactgagcccagcctcctaagaattcttaaaggagctacggttgacaaaagagtttcagagaggtaaagttatggccctaaagtcacccagcaagtagatgtggcaaagccatgttgcaaaagaagccctggtgggtgacactcwttggatggcccctgcctctccggaaggcaccagcgttggtttctctcygcctcaccttcccatgcaggtggghmcgtttgtgcttgggctcctgctggttatgccccagaagcacactcttccctatctgcagtcccagcccatgtgtggacacaacccatttcctagggtgttccttagcccactgcaccaagtcagcatttaggaatcaagagtggcaccacaaaggcaatagctgtgaagaccacaagcagcatcacagtgatcaagcttgcagaattccattgtctgatggactctgtgtgtaccaaggtgactgcaatccagggacagtgagagtcactaggccttggactaagcatctgcttgtcccaggtcccaggctgaacatttgatgtgaatcttyagtctcttcacttttgagacaggcactacagccacactcacacaggtcccaaaggccagtgccacccactacctctgccatctccactcctgcattccaccagattccctgacctttagaaatagtctcctggaggccaggcctgctggctcaagcctgtaattccagctctttgagaggctgaggtgggcggattacctgaggtcaaaagtttgagatcagcctggccaatatggtgaaaccccgtctctaccaaaaatacaaaaattagccaggtgtggtggcagtcacctgtaatcccagctactcaggaggctgaggcaggagaattgcttgaacccaggaagtagagatagtagagattggagtgaactgagatcatgccattgcactccagcctgggcaacagagtgagactccatctcaaaaagaaaaaaaaaagaaaagaaatagtcycctggagcccctggccctgacctcccaaaagccagagtgaactttcaatctcaccgtaggctgaccccctgtgtccattttaagycagaggactatacccatccacagtcaaagaagagggtggtgaccratgtggacaaagctcccattcagctgagaccccaatcagtaaagaaaatctttccctacacagatctacagacaaccaaagccttaaaaaggcatcaaccctaaagcctgtgaaaatgtgattttctctcctgtgttcaagaatggaaatgccttccttcatttttaaagaaggagcaggggatggtggtgagagtctggatttggcattggattggtctttcctaaactccaacagctcctgcatttaacagctaggggtatgtgggcaaatcacatgattagacataggaagctttttcctccttcctactccccttcctggaggttgacacagaccaaagcttggtaagaaaacttaggataaaagaaggggcagaggycgggcaaggtggctcatgcctgtagtcycagcactttgagtggccaaggtgcgtggatcaattgagcccaggtgattgagaccagcctgggcaacatggtgaaaccatgtctctgcaaaaaattacaaaaattagctgggcatggtggtgtgcacctgtaatcccaactactcgggaggctgarsggggaggatcacttgagcccaggatgttgaagctgcacatgaggtgagattgcaccactgcactccagcttgggctacagagtgagtccctatctcaaaaaaaaaaagagggcagagatttttttcaacatcatcagagatgggagctatacaagatatacaaagagaggagacagtcagccatggcaatgtcaaaatactcgttagccagcacatgttctgcctagggaattttctgcacctactgggaggtatggggaaaggacacagggtttagcaggatcaagaggttgtgggggatgcagagtacaggacagcaatccccagatggccttggccttggctctccttcctccaactcttagctctcaggataactgtagaatatgctaagaatgcagtgccctgagacaaggagaaaatatcaggaacaatctgagctttgtcttcattcctcctaaaacttgtttcagccatccaagtgacttctgagatataaaacccagggaggggtgtttttgaggccccttagctgtggtgcaaagtgaggcacatgcaaacaagaccccatctgccggggcagctttcctgagccttgggggactggttcaccatggatcctaggcgtctgttgattcttgctgcctatatctgtaatgaagttggtttgcgtggcttgcatagtattctgtcacatcaaactcatactctagcaactgggtttgtgtaaaacctcctcccacatccaggaaattaagcagaaattagcaagatgcttagagtcctctctgaggagcgaggcaggtgcacagtgttggggacatgttgggagtcctccccccagattgataaccattgcatgggactctgcttcccagagagaagaaagagaagatttcaatcaggaaggggctccctgcaatttcaagtagggcaggatggagttgagaggtgggatggaagcaatgaaattaacttgcatttcaaacctctgggggcaacgcataggcttgaagctataatgtgagcctgagctaaaacagtaagggtgtttattcagtattctggactccatatgtatctgatcacttcacagctgcttaaggagattgtccaggggtcggctaactagacccactggccaaacccaggcccaaaacagacagcttttaaatatttcacaagctaagcttcatacatttttaaaagattatgaggaagaaggaagaaaaggagaaagacaaagaggagtcrggggagaagaggagacagagatcatatgcgaccatcaaagtctaaagcacttactatttggcccattacagaaaaaagtttgcagatccctggaatgtagtccctgctcccttccattaaggccactgccccaaaactgcagagacagtgtcaccctgagagtgggagcattatttgttttgctcgttgctggatgcccagtgcctaggatcatgcctggcacataaaatcactctgtaaatatttgtggaataaaggaaaaaataaatgaatgaacaatgtatagaaaagcacttggtaacctataaagtccaagtataggacaaataaaaatacatactttatttatttattttaatttttttttgagatggactcttgctctgttgcccagcctggagtacagtggtacgatctcagcccactgccacctctgcctctcgggttcaagagattctcctgcctcagcctcctgagtagctgggactacaggcatgtgccatcatgcctggctaatttttttgtatttttattagagatggggttttgccatgttggctgggctggtcttgaagccctgacctcaggtgatccrcctgccttggcctcccaaagtgctgggattacaggcatgagccactgcccccrgcctacatactattttaaatccactgcacctgttcttattctggagtggatgctgaattctgcccttggacaaggccctcagtgtgttctgggagagcctggcttgaagccacattatgaagaggcagggcagatcccaacccaggaagctggagacagaggaaatctaaaggcaggaacctcctacagaggttgctcttctgcttagcctaagaagcagagcttctcaggctttctggtgcacacagatcaccttggggttattattagtatccaaattctaaattagcatgcctgggctgggccccaagaattagcatttctaacaagctcttctgtgttgctgcagctactggtccctgaatcacatgtgctgtacagcaaggatgtcaaagctctcttcctcaaaggcaggagcatctcctcagaccctagtatcctcctcatttcctctttgcttcctttkgtcgggttccaaaaaacagtagaagtgccctggattctgatgagagaacattctcaagggattgctgactcgggaggcaaacaggctccagcgatcctgcagcccacgggctggtggggagatgacccacagggggctgttccaaaaaggaagagcagtgggcctggaagagtatgatttggccttagtgttgcttcacttttctgtcttaattgccctgtggtttcatctggtcatgggagtccacgatgacatgtgccatcyttgtatgaatggtgcttgcagaaccgaaggaagggcctgtaccaatgcctggggaaaagcagaccaatgaagacttgtaagagcccagaaaagaggctgggagaaggtcaggaatggggtaaacgtggccttggggcatcygcctggagctccaggtgaccagtggcacccagaacaattcttgaccctctgcaggtcctccaaagcatcctcagtaggacctgcagaaggtcaaaaattttctgctttcacgttggatggaggtcaagactaagtcagctcaactgtaaagaaaatgatgcttttccctttgaaaactggtacaagacaaggatgtcctctctcaccactcctattcaacatagtatgggaagttctggccagggcaatcaggcaagagaaagaaataaagggtattcaattaggaaaaaaggaagtcaagtctctatttgcagatgacatgattgtatatttagaaatccccattgtctcagcccaaaatctccttaagccaataagcaacttcatcaaaatcttaggatacaaaatcaatgtgcaaaaatcacacgcattcctatacaacaataacagacaaacagagagccaaatcatgagtgagctcccattcacaattgctacaaagagaataaaatacctaggaatccaacttacaagggatgtgaaggacctcttcaaggagaactacaaaccactactcaacgaaataaaagaggacacaaacaaatggaagaacattccatgctcatggataataagaatcaatatcatgaaaatggccatactgcccaaagtaatttatagatgcaatgctatctccatcaagctaccactgactttcttcacagaattggaaaaaactactttaaatttcatatggaaccaaaaaagagcctgcatagccaagacaatcctaagccaaaagaaccaagctggaggtataacactacctgacttcaaactatattacaaggcttcagtaaccaaaacagtatggtactggtaccaaaacagatatatagaacaatggaacagaacagaggcctcagaaataacaccacacatctacaaccatctgatctttgacaaacctgacaaaaacaagaaatgggaaaaggattccctatttaataaatggtgctgggaaaactggctagccatatgtagaaagctgaagctggatcccttccttacaccttatacaaaaattaactcaagatggattaaagacttaaatgtaagacctaaaaccataaaaaccctagaagaaaacttaggcaataccattcaggacataggcataggcaaagacttcatgactaaaacaccaaaagcaatggcaacaaaagccaaaattgacaaatgggatctaattaaactaaagagcttctgcacagcaaaagaaactatcatcagagtgaacaggtaacctacagaatgggagaaaatttttgcaatctatccatctgacaaagggctaatatccagaatctacaaggaacttaagcaaatttacaagaaaaaaacaaacaatcccatcaaaaagtgggcgaaggagatgaacagacacttctcaaatgaagacatttatgaagccaacagacatatgaaaaaatgctcatcatcactggtccttagagaaatgcaaatcaaaaccacaatgagataccatctcataccagttagaatggggatcattaaaaagtcaggaaacaacagatgctggagagtatgcagagaaatagaaatgcttttacactgttggtgggtctgtaaattagttcaacctttgtggaagacagtgtggcaattcctcaaggatgtagaactagaaatacaatttgacccagcaatcccattactggatatatacccaaaggattatacatcatgctactataaagacacatgcacacrtatgtttattgtggcaccattcacaatagcaaagacttggaaccaacccaaatgtccaccaataatagactggataaagaaaatatggcacatatamaccatggaatactatgcagccataaaaaaggatgagttcrtgtccttttcagggacatggatgaagctggaaaccatcattctcagcaaactaatacaggaacaggaaaccaaacaccacatgttctcactcataagtgggagctgaacaacgaaaacatatggacacagggaggggactatcacacattggggcctgttggggggttgggkgctggcagagggatagcattaggagaaatacctaatgtaaatgacaagttgatgggtgcagcaaaccaatatggcacatgtatacctatgtaaaaaacctgcacgttgtgcacatgtaccccacaacttaaagtataatttaagaaaagaaagaaagaaggaaaatgatgctctgaggccggagaacttgagaacactcagataatgctctgaggcaagatgactagtcatccccaatgtccactctctttgtctctctcatggtaatggaactctgaatttttagctgggaggtggctacctagaatcttgactgcactgcacagcctcctttgtagctaggtatggccatgggacaaaactccaggcaacacaacacaagtgggaatgacaggcaatgttcaaggcattcctttcaaaagaaagggtgtgcccttcccttcccctgtggccctttctatggactggaaggtggacatagcagtgagccatcttagcctagacaaacagacgtggaggggcagctgagcaaccasacaggaggacgtggtttctgacaacgtggaggcaccatatcaacccactgcctccagctggasctgcaggagagggaaatgaacttcagtctcattttagcaactatttctttaggattctgtgtaacttaaacatatgtattggccaggtacagtggctcacacctgtaattccagcactttgggaggctgaggtgggaggatcccttgaggccaggatttcaagactagcctggacaacacaatgaaaccctgcctctacaaaaaaataaaaatttaaaaattagccaggcatggcgttgtgcacctatggttccagctactcagaaggctgaggcggcaggatatcttgagtcgaggcggcaggatatcttgagtccaggagtcagagtcttcagtaagcaaygagcaatgattgcgccactacattccagcctgggtgacaaagcgagyctctctctctctctctctctctctctmwmtmtatatatatatatataatatatatataaaaatatataatatattatatatgtgtatacgtatatatgtatatatatacacacacacacatagagagagakatatatataaagacacacacacmcacacacacacacacacrcacacacacacattcaattccaaaactgggagcctgaaagtcatttaagaaagatgggcccagacagttattggtcatcttagtgccttacagtcaacaaatatgtaagtcctctaaagatgcagcactatcgcaacagacaaacaaaaaatcctgtcctcgtagagtgtacatttaatatcatttcatttcatcttgattaccactctgtcagggaatattgccttgcatcttagacaygaggaaattaagctgtagagatttcccatgatttgtttgaagtgagtcagttggtgagtcagacatcagagattcaagccaggtcagctcatgccagagctagaacctcgccactggtctggtggcctccaaagcatgccctctagagaggcctgtcagggctaccccggatggggactgtgaccatgaggaatcaagaggaaggatttttttttttttgagacagagtctctctgtgttgcccaggctggagtgcagtggcgtgatcttggctcactgcaacctctgcctcctgggttcaagcgattctcctgcctcagcctcgcctcccaagyagctgggttacaggcatgcgccatgatgccctgctagtttgtttgttttttttttttttgtatttttagtaaagatggggtttcgccatgttggccaagctggtcatggactcctgacctcaggtggtctgcccacgtcagcctcccaagatgctgggattaccagcatgagccactagtcccgcccaggattttttttttcctttttcatgagccaaagaaagaccccagactagctaagagagaggcccaaggatacctgaaggccggggaggagggacaaccacttgttggggtgaaccaatcgcagaggctcagcaggacagaggccaaggctgaggaggcccccacagagaaacagagcctgaggacaaggggttcctcacaacacctgtgctccccgaaagctcccctccacacccctctctaggtgccctactctctggggttggtgaaggggtgccaaaaatgcaaactgatccacagaaaaatagagtcctgtattttaaaaatatatctaggtttgtatatggacattcacatcacacagacacacagacacacatgcagccacacacacacacacacacagagacaccaaagaaaagtgctttagaaatacaccaaaatgtggctgggtgcggtggctcatgcctgtaatcccagcactttgggaggctgaggtgggcagatcacgaggtcaggagttcragaccagtccgaccaacaaggtgaaaccctgtctctacgaaaaatacaaaaattagctgggcgtggtggtgtgtgcctgtagtcccagctactcgggaggctgaggcagaaagttgcttgaacccgggagtcagaggttgcagtgagctgagatcacgccactgcactccagcctgggcaacaaagcaagactctgtctcaaaataaaaataaaaaataaaaagaaataaaaaagaaatataccaaaatgttagctggggtcttctctgggtagtaaagtgctgggggatattttccaaagtccttctttacattctctgagttyttccatgttcttcaatgagtatttaataagcagataaaaactaatacaacaaaggattttttctgtgtgcttttttgacctttggaggaagagattagagctagtcccataaccaggttatttgagtaggtctaacaagcccgtattaccagaaattatcatctggtcatttccagtccgagaacagaacacttggttgtcctggcatttcccaagcagkgggaggagttctctgcaggaataaataagcctcagcattcatgaaaatccactactccagacagacggctttggaatccaccagctacatccagctccctgaggcaggtaatccatgatgttttacatyctgggagcggaggaatctgtttttccaggagagttttaggcagcagcctggagtgtgtggagtgtgaggggtaagcagaggccaggaggaggtgtactcaggtgttaggggccaggggtctgttcttggctgccactgattccctgtgccttttttagaggcatcctctgtgtctgggttttcacacctgcaaagggtggaggtgccctggggcctctatggtcatttctgccttgatacttacagattcggattygagtcagctgtgcatctgaccctcagggaagaggtgctgtccccttgcctggagcagggtgcagctctcagaacatgtggcagatgtgattattgcagcaggtccctctgagcagaggccacaggcctcaccatgatttcagggtctccatggggctgcctcgggagctccacttccccaaaaggacccctggccaagtcgacagatgggctgtgtctctgtccagcaacagaaaagacaaactgctgggaaacagccagccctccaacttgcccaaacagaaaagacaagcctttgcccctgaaataattctggagaaaaatattgtctaacatttatccagagaaatgattgcatcagcctgagagtgaacagttgaagcaaacaaggtgcctctgtccctgggcttggccaaaggcatttccactggcctcccctccttcccctccttcccctccttcccctccttcccttcctttccttccttcccttccttccactctctcttccccttyycttctcctctctctacccctctcccctcccctcccttccaatcgcctctcttccccactcttctccccagcacccaagctgccccttttctcttctgaattctaggactgagtgggcggaggctgaaggtgaataatcttgtttgctgcggtcaccggcttggaactcagcccttccagggtctcttgtgcagtagctcatggctcttctctggcttgtagtttcaggaaaggggtagtatgggaggtggtgactgctcggtacgtctaatatgaaccaggtgccttcatcatttatctcacctgagccacttaacaggttgtgcagagacggaaacaggttgagagatgtacagtcacctgcttgccagtacacagcaatcaaaagtggccaaaataaaatcccagtccaagtctgggagactccaaagccctctctgccttctccccactaagaggcccttccaggcttatggtgracacaracaccacgtggcaacctggcaggggcagagaagaacatttgcctttctttggtcttgctgccaaccattatcagggccatcgaggctccagacactgtaccagggactttcatttccctctctcagtcgaccctcactgccacccagcatcacatcgtggaggcctgtggaggccacaccacgtgacatctagaggctgggagagtcactgtggcctctatctctgcccagggctccttcatccctgggttctactttggtggcagttgggagaatgaaggaagggagcccctgctttctaatcccctaggatgagatctgctcaccaagcaggagaggagcaggcattctgattggactgaacctcggaccccccatcagcttacagaccgaggagccaggcaaacctggctgcccactgggctcctttacctgtttgctgtatgatcttgggcaagccccctcaccgctctgtgcccggcttttccactgcaagaaaatggcaacaattatggtacctacctcaaagggtgaaatgaagcagagtgatgtgtgtcgggtgccccagagagyacctacctgagggaggctccaaarctagcaagaggcagcaggacagggaccaggacgcaggctgggtggagggcagtgggaggtggtcggggctccatctggccctctgagacttaaaggagctttgcttttcagagttgagaatggagaraatgttacctctcctgrctctggggctcttrgcggctgggttctgccctgctgtcctctgccaccctaacagcccacttgacgaggagaatctgacccaggagaaccaagaccgagggacacacgtggacctcggattagcctccgccaacgtggacttcgctttcagyctgtacaagcagttagtcctgaaggcccctgataagaatgtcatcttctccccacygagcatctccaccgccttggccttyctgtctctgggggcccataataccaccctgacagagattctcaaaggcctcaagttcaacctcacggagacttctgaggcagaaattcaccagagcttccagcacctcctgcgcaccctcaatcagtccagcgatgagctgcagctgagtatgggaaatgccatgtttgtcaaagagcaactcagtctgctggacaggttcacggaggatgccaagaggctgtatggctccgaggcctttgccactgactttcaggactcagctgcagctaagaagctcatcaacgactacgtgaagaatggaactagggggaaaatcacagatctgatcaaggaccttgactcrcagacaatgatggtcctggtgaattacatcttctttaaaggtgagtgtgcctggcttggggttcagaagaggtggatctcagggccatttctgtcctgactcaacaatggtgttattaggcaaaccactgtagaggagagtgcccacagcatgggggcagcataagcatcaaggccccaccctgcccataggcatcgccgtctcctgtggggtttttccaaattacagtttgtccttggaagacataattcagtggagcccatcagcctctggtctgagtcagtgtggtgcttttcactctgatttaaacttgtccggcaaacagaaagaaggagctctcctttcaaaccactccagggcgcrtaggagctagagctccctccttgcaggggtgctgctagactaggccaggaagtccctctgtctggatgcacctggggctcctgccctgcacatgtgggaggagcacattccagccaggggccttggtgtctggaggtggccaggtggggctggggccatcttcacagggcaagataatccccaaggagcctggccacttccaagattctatgattctactctgctatcatctttaattattttaaaaaatatgtcactgacacataacaaatgagggcagaaatggcattgttcccatctggggaagagcctcaagggtgggcagtatacaaaacatgaccctttgccagattctaactggtccagtgmccaatcccattgatagaaactcaaccaatgcaaacctcagcctgcaagctccgaaggggcagagtgcaagccggtagcttttgcctcctggagcccayagtccagatggggacaaaaaaagagatagggacacaaagagtgatcactgagccagagggtggaaaggtgcttaggagacatgagctgcttggaggcagagtcctgcttggaagctgttggttgattcctgggcaagccacttcccctcctgggcctgggttttcatctgtaaatgaaggcgtggatccagatctccctctaagactactccaygcctcacgtgccatttgttctctgagtttcccatgttctcgcctcctactacctagccctatgctaggactctcccctccaggacacagtagccagcctagctttcccctccccacctgcctctaacaatgggaaacaggcaggtggtaaacaggtgggcagtggaggtggccccatgtctccagcctcccctggaagctcccacccccctcattgttcagtgctctggtcctcctggagtggagacctgcagggcccctccccttcctctgttgacctctcctcactctccaggtgccagttttgctccctgcctcagcctggtttacatacagtgtatgtgacggggcttggtcactgctggggcagccctgtggaaggtggaggggaccgagcatgcatgagcttcaggctgagacagtcccagctcagaaccctggagtgcttgttccctccctttctgctcttcctcttccattgcacccactggacccaagagcatgcaaggattgactcacccagtgatgctagaactatgtattcagctgaaagtaagggggtgggggcatccaaccaggggcagaagatgggaattcaagaaaggaaggtttcccctagaaaacggttttcgtcttttctcttaaatccagatagaataagaagcgaaggccgttacagcagagagaaagtygagtcaagcagagatcagatactaaagacactagactaaccagacattcgggccctcagttgaacagctgaggatgtcagaagatgttaaggaggcaaaattggaaaacttggtggctggcagacagaaatggggggagatgggagcagatgtgagaagatttaaaggcttgtagagcttgggtggtgatttcatccaccaaacctatctctctccccattctggcatacaaggcagcagtcagggtccccagaggcagcccrtctttctggcagggacccatgctggagatctggccagctgaaaggccccaaaggagctcggtgccctgggtaatatgggaaggtgctccatggcactgccctcacatggaggccacagaagcccctgaatggctgctgcaattggtaacggggacacctgttcaactgaaatatctcctaccctgagatgggtcctttctccaagggatctttacaattacatttgtccccagtcattccatgttgggaggctgcagggaccagagaagctgagatggtctttggggaggggaaaggaaagatggacagttattttggtcctagaaagcccaaaggtggggaagtgtcaagaaggaagatgagggcacaagagaatgtagggccacccagaagctggctctcattgcaattacagaaagaaaaaccaaaataaagaaagaaaggaaagaagctcccatttattgagcagctactctcaccagccattcacatgcaatacctcgtttaattctcgcagcggctctgaaaggtggatggtggtattgccatttgttaggtaggagacatgccgtccagaaaagcaaataattaaacattcaaagttgacctgggcccatttgaaaattccttttgctccctcattttaacccctaaagtaaagccgtttgtgactttatgagcttttaccaagcatctcctaaaaccaagaatggaggtgaaagattgtggagcccacaacctagagaaaggattgacaattttttttccataaagggcctagtagtatgtattttaggctgtgtggtccacatgagggcagattcttctttttgacttcctcctctgcatcttcttcatcttctctttcctcttcattttttttacaacstttgaaaaatataagcaccattcttagctttaggtacacacaaaaataagctatggctgtattggcttacaggctatagtttcctgacccctgttctaggggaggaaaataattgtacccaactaaatgcgtgcgaatcatgggcctatgtcatgattcccaaagaatgagtttcatggaattttcaacattttaaatattttactccattcttcccttgcttgcmtagtttctgatgagaagtctgctgtcattttcatccttattcctttttagataaggtggagttttcctccctctgcctctacctctacctctttcaagattttctctttctctttactatggtaaataggcctttagtgagaggagttatgtcagcctggctaggagtcaggctgcatttcaggtttgtgatagctagaggtaccagaggcagtttcatggaattttacctttgcaacactgagagcctaggcagcctcagagtcagaacacccacagttgaatcctcagcctgacagacactgaatccagggcaaatcttagctgaatattcatggtctgtagaggtggacatgagctagatatgagctaaggaccatagccagctcatggcttttgtgatgtccaacaccgctatcctctaagatgtcacaagtgtccctaggcttttattcccatggtctctcctggctctgagttctatcttccattaaggttcttcctgttcctcccctcattcacactgattggcatctcttctgtctgccctcaccaactcacatacagaacccagtctctttcctcttatttccacccaaagccctcccacaagccactgttatatgttcacatccctgtaataccagtgagtaataattgctaatgagacatttttccttttatggaacaaaggctgtcccatttctcctcaggcaccagcctcccacatgttgtcatgcctctttcccccactttccctaaaccttctttctctcttgcactccttattccctggttcctattgatttctcatttagcacaaggaactaggtctttcttttgtggcccttttcccaatccaagcctgctgggctctccctcacccccaataacttttactcttgccaagctacttctctaaaccaaagcagggtccctcctatgagggactctgggcacttccactgctgsggaagcagggtcgagcagggcgacccttgcactcacaccttctccaactgcttgctccaccttcagccaaatgggagatgccctttgacccccaagatactcatcagtcaaggttctacttgagcaagaaaaagtgggtaatggtgcccatgatgagtttgcatcacctgactatascttacttccgggacgaggagctgtcctgcaccgtggtggagctraagtacacaggcaatgccagygcactcttcatcctccctgatcaagacaagatggaggaagtggaagccatgctgctcccagagaccctgaagcggtggagagactctctggagttcaggtgattcttcctggcccccaaagaccccacatctctccacgtcaaggtctcaccaatgtccagggacaagggcatggtggtgggagaactcatacagggacaggtggaatttacacttactttgccctatgctgcctacatggctttgggcttgatttttctttttcttctttaagacaatgacatcagacaggacaaggggctgaggcttcctctgactccagcatgttctaagtcatgagaaatcttctgcacagtcccaaacactcatgcatggtttctcctggtctcaatctcttgaagggagagagaaacagaaggaattgtgatcagttgagggctgcagtgagatggactctgagaatcagttctgcactggtgaaccactgtatttattcattctctcagcatttgctgcatgattaattgagcacctactatgtgtcagacactaatttgcaccctgagagtaaatcagcaaataaaacacaagattccctgccctcctggagcttaatttgtaattggagaggggacaggcaataaataaatataacaaataagttacgtgatatattagaaggtgagaaattgagtaaggggatagaaattgagtagaggaggatgaaaggatcaggaaaactggaactcgtgttagtttgtgattttagatagagtagccattaggtgatgtttgagcatccatataacagaggggargggtggagtcatgttggtatattagggaaaagcattcctggcagagggaacagtcagtgcaaggcctctgaggtggaagtgagcttgatgtggtcaaagaagagtcaggccagagcagctgggcttccacttcctccatcttgtcttgatcagggaggatgaagagtgcgctggcattgcctgtgtacttcagctccaccacggtgcaggagcagagagagtgaggagagagttgagagaggtcaggagtccccaaaggggtggagcagcttaggtagggccacgtagacccctagaaaaccttgcccttcctcctgtgtgtgaaatggagagccatcaggaggtttggaggagtgctgcgatccgagtgttgttttaaaagactaatcctggctgctgagaggagaataactgtagagcaggtatggagtcagtgacacccgcaggaaccaggcacagacatgaggtgggagcccactgtggctgggatccaggagggagccatgcatgtgagaagtcattgagttctggataaatctgagggtagaggaacttgctgggacacacggaattgagctgaccratttcatggggacacagtgaggaggagcagtagttccgggcccagaccctgcagtgggcccagggagtgcatgtgggcagctgtgtggggtagagaggaaggagcaccagccttgggttcagaccgtggtggctggtgtgacctggagcargtcgctgctcttctctggagctcagctacctcctgaagagaaaggaatgtcctttccccrccacccctgttttcactgggtgattgtgagaatccggtgaggtattgtatgttgaagccataataaaccactaagggcaagggagctgcttcaacactaacctgaggctgcaacccctgccccaaccactgtccagaaggccggacacctctcgggattgcctgaccctcagcccctcctcactctagatcccaggagaccccagaacgtgggggtcctacccaacccatccgtttactcccagactccttcctcctttagcacctaatagccaccagggagcaggggctcagcagataattttgagtggaaagaattctccaaacacttttgatttacaaaatgctgaggaaacatgtgtccacacactcctggcccacagagaatgctcaatagatacttgttgaatgaaggatggaatgaacggacaaacacatgaatgaatgaataaaaatagaaataggacaccttcctccttcakgggactcagagtttaatggaagacacagcctcctgtataattgtaagaccaggcagacagtgacargcatcttaagagggctataaactaagggagggggagtttgcaggtggcrggtgtgacctgggcctctaggagcttgctacctgctctatgccagcccacacctggcttgagggacagtgcccactggtgaggcaagatgggaacctccaattgattgtttcaggatccccaaagctcttctaacacaatcagactcttcagagrcccccaggccctttttgacctgcctctggctcctggcccacctcatccctcactaccctcctccctgaaacactgagatcacccaccgccccgtggagcaactcctcctgctcccaccttcttccaggttcttccacctgcctcctgcccacctcttcacctagctagctcctttcctgcctttgggactcagcctcaacaccacctcctacaggaagccctcctggtgcccccgtgaagcaggctgccatgcagccactgcagctggccyagcccaggctctcaacacactcaggggtccctgctggtgtgaaggtgcttcaactgcattgcaagctkcagggaaaggrcagggccaggctcgagcagggccacaactccaggcttggtgtgctgcctggagactttcacacttgcagatctgaatgaataattaatgaataagaagagtaaagacaggggttaagaaattgaggaacagattatttattttccaatcagaagggggtgactgtagaggaaaccagggaagaccatgctgcgaggtgggaggcasgtaggtactgatcagcagaggttcagatactttttttttctcgttttctagagagataggtgagctctacctgccaaagttttccatctcgagggactataacctgaacgacatacttctccagctgggcattgaggaagccttcaccagcaaggctgacctgtcagggatcacrggggccaggaacctagcagtctcccaggtgagtctttagacttggrtcaattcatcctttgtatccgaacttgaattggtgaaggccagatgkacttttgggtactcttgaacttgggttaatrcacgtgcatttctcattatatactcaccctgcttgggacacccccaagccaagaagagctaggttacagcccagctcctcctgccgtgttaggggttgagcctctacaacataatgtcatccaggcttggaatcagagagccatggacaccattccacactataccatttactatccatgggggcaaacaattaaagtcctccacccccagctttccatgtgtcaaatggtagtgatagttcttggctagtatccagtgcctggctggacagggaatgccaataggtaataacaatgattatctggcaattgtaatgaaaatatgctcggagtatgagagaagactacttgggacactcagcctgtgttactaaaagcagaggcgccaaggcagggtggccatgcagccttttgctcttgtctgccctctgtgctcacacagcactgggttgaggtctgcactccacctttcaaacagcaaagtaagagagggttgtgtgtagaggagcagaccygtatggttcaggaattcaaggccatgaaaagtacttgaaagccccaaggatgtttaagctagagcaggagagatgctgaaagccatgctggcttggctgaggaggtttctgcagcagctgcttgtggtcaagagctgccgggatgttgcttagaagaaaaatgctttacattgttcttgctcttcctcccaacagtagtggctgttttgggggcaaaatagactctcaactcagacacaaagggatgcatatgaggtgctccattctttacctcgatggctctgggcaaatcatactcagcatctgggtctccatttgcacatctaggcatcaggactgtgcaaaactagttgrcaggggagttgggaggagcaaacattcaacagcacaaagacaggccagcactaggtgctcaatgcacattagwccccttagtggcacacaggcaggtcgctgaactcctgcgcatctgtgtttcccgtgtgtaatgttctgctgtccccacaggtggtccataaggctgtgcttgatgtatttgaggagggcacagaagcatctgctgccacagcagtcaaaatcaccctcctttctgcattagtggagacaaggaccattgtgcgtttcaacaggcccttcctgatgatcattgtccctacagrcacccagaacatcttcttcrtgagcaaagtcaccaatcccaagcaagcctagagcttgccatcaagcagtggggctctcagtaaggaacttggaatgcaagctggatgcctgggtctctgggcacagcctggcccctgtgcaccgagtggccatggcatgtgtggccctgtctgcttatccttggaaggtgacagcgattccctgtgtagctctcacatgcacaggggcccatggactyttcagtytggagggtcctgggcctcctgacagcaataaataatttcgttggamacgttgcttgtgcctttcyatgctgactatcagactctgcgcccctgaggctacctgtgccccaaagacaagccccttgagctcccatgcaggctcagctccaycccaagatctgggctccttctgccttcagctgcagcagcctgcccaggactacctaagcttgtggccaagctcacccagacctcaggcccagggttgggaggggaccctgctgctctaaggccaattcctgccccccaggcttctgggtgcccactttcagtttctctccttccacccccagggcccaggctccacctggctctttccagagctcctagccctgaccacatctggcacagcccccggactccttgctcctgcagctgtgcagggctttatcatgcgacatccttcttctgccctttagcacccccaatttgggggaagtagctactttctgggtttccagatggagcccctcaactgcctcaccagttcctagccctggctctgtgaatgatctccctcaacaaccagaatgcagggctgaggacaaatgagccatcagcgcacaactgcaataaagcaatcgtgtagtcaggcatttaaccgaggctcccaggcaccttgcaatctctatcacaaaggcaacaatgatactgttgacaacagctcagtacttgaggttttgatgccagacaacctgccaagatctctccctgaaatagccaattgaatcctcctcacgtccctatgagataaatgctctcagcagtcccattctatggatgaggaaactgaggtgcagagaggcttagtaattttcccaaggctacagagctagtaattattgcctgtagaatgttatcccaaccctcctgacaccacaggcgccctcttaaccacaaagtgatttccgtagggattgccttcatggaacgtacaacccgatggcaaatagatggtgaaacaagtctgtggaagctgagggagagcaccaaattcagtttgggaagtcagggaaggcttcttggaggaggcaacttctgtgctgaggtcagggaaagagaaggtggtcaagtgaacagagaggacaatgcttcagatgggaaaaagagcaatggtagcattcaagaaaccaaaagaagttgggtggctctggggcaaagagcagagaggctgaggggctacagagaggaaggtgccatgacagagctggtgggctgcagaagggctggccgctggcaaggattcccaagtgattccttagagccacagggagctctaagcgagtttaaacacagaggtgatggaagcagctttacacactagagaaggaccctggctgctgagtagaaaagtgattcatagcccaggacaaggatgtgggttggacatcgagggggctctgtgggaactggggcaaaataggtcagagctggggagggagagcgggatgattctgttggaaggctttgaggagaatgggtgtgaatttatgattgcaggtggggtggaagggagaataactatttgggtttgggtgcctgggtgatccccagttckctgaataggaaacccagcagggacttgctggcaagggaagtcgatacattcagatttgaacctcccatgtctgaggttcctgggagacaccccaggggtttgttcaggaagcagctaggctgaggtcaggagagaaatctgggctggagggaagcattcaggatcctcccctgggatgggcaagtgagtattgagggtgtcccctcaaatgagtgccatggagtgaaaagaaaagggaaacctcaatgactggctaagaaagggcagcccaccgaggaaagtcaccagcgtggggcaggagacaagaggacaggacgaaagctgtcgccgcaggaacaagaggagatacttatccgggggagaggggagaaaacctagagacaaatgatgaatgaatggaatgaatgggtctgtgggatttagtgatctaaaaccactcggggatcacaagtgcaatgttagcagaattaagggaggaccacagtgggctggagagtgagcaggagagggagagagggaaggcaagacagcgtgtagggaaaaaagagatcagactgttactgtgtctatgtagaaaggaaagacataaaagactccattttgaaaaagacctgtactttgaacaattgctttgctgagatgttgttaatttgtagctttgccccagccactttgccccaaccttgagctcacaaaaacatgtgttgtatgaaatcaaggtctaagggatctagggctgtgcaggatgtgtcttgttaacaaaatgtttacaggcagtgtgcttggtaaaagtcatcgccattctctagtctcaataaaccaggggcacaatgcactgcggaaagcyrcagggacctctgcccttgaaagcwgggtattgyccaaggtttctcccyatgtgatagtctgaaatatggcctcatgggatgggaaagacctgaccgtcccccagcccgacacccgtaaagggtctgtgctgaggtggattagtaaaagaggaargcctcttgcagttgagatagaggaaggccactgtctcctgcctgcccctgggaactgaatgtctcggtataaaacctgattgtacatttgttcaattctgagataggacaaaaaccgccctatggtgggaggcgagacatgttkgcagcaatgctgccttgttattctttactccactgagatgtttgggtggagagaaacataaatctggcctacgtgcacatccaggyatagtaccttcccttaaacttaattatgacrtagattctwttgctcacatgtttgttgctgaccttctccttattatcaccctgccctcctactacattcctttttgctgaaataatgaagataataatcaataaaaactgagggaactcagtgccggtgcaggttcttggtgtgctgagcaccggtcccctgggcccactgttgtttctctatactttgtctctgtgtcttatttctctttcccggtctctcgtcccacctgactagaaatacccataggtgtggaggggcaggccaccccttcacagtgtgcaaatgcctatttagagactggcctttaggggaggtgagagagagggtggtgggtagtgagtgctaggctgaagttagctgcagtgcttgacagatgtgagagccttgaacaagctttcataaccatagaaaggattcaggaggcagggtgacaagcaaccagggtcgcagagtggcacaactcctcaggttacaattcacaggtggtttgacaccatcctaagttacagttcacaggtggtttgacatcgccttcaactcggagttgcagaattagcagttggccaggctgcatgaagcatccctggaaagggaacaggtggagggctggagggccaggatcaaggatcaaggattccactgtgatgggaatgcaggcagggcctggcgagggggctggtgagggagtgtgtttcttggtaggatcaggtgggacctcctctcctccaatgactctgatgattcctagtataggaggcaaagtcacctgcttagtgatatttgccacaggttggggcaggaaaaggcacaaaatrggacayagagtgggccacggtgtcacggcagttcagccaggctcactgatgagcgccttggagatccagctgcaggaattcttggtggttccaggctttacagacagttgtggaatcccccatcttgtggaatatttctccattcttaccagcccctttgtgggcttcaagaaggccaactgctgatcagaaggacaggagtcaagggggctggaggtacagactacagaagggttgacatcatggacttgagaccagcactggggggtacagatgagggcagagggagctgatcactgaggaagactgaggatggggagatggggtccctaggaggtccaagaatgacctgttagaagtgccatatgaactayaaaggcyacttttyccccccaaagaggattttttcacattgactctcagttttctcaactgtaaagtggaaaccatgacagtgtgtgcatgcctgtgtcatccgtgtgtaagaagtcagcaagtcactgaaatgcttgctcctgagtctgaacgttcccttgacagcaatttaaaaactcctgagatgatcttttccatgtgaactaactcctcatccaggctggcatggcttctcgtcactcagctggggctggatggcattgcactggacaaggctctgacctgcccacctgcccagctcctgcccccggtccctcctgaccccagtccaggtgtctaaggagccttaccacagcccagcattcattcccttctgtgacttaggtctggaaattgctggctgaaaactgagttcctcccttaagggagcgtctgggccccagatctgtgagggtggggcttagtttcattcttccgcctcccctgggggctgagggcccatccacctgctggtcactagctattgcccttaaatggcttcctgacgctagctgcagggacaagacagcacctgtcctgatttactacctccctcactaaccaraagtgaagtccaagcctgagaggcactgacaccaataaaagacacctacttactctctcattcagcccacgcaaattgccaaccctccaaatgcaggccctgagctggccctggagattccgaggttaagaaagtggacctggaatttgccctcatagaatgttcaatttgttgagcaagacagaaaactgagcatggatgtgacagcagccctcgggagtggggtacgtgatgcccagagagggcaggaataaaccccagactagaagagtcaagtttggtctcctagaagagctgtcctcaaatgcaaaatccagtacagtgaagaggagacaccagggagatgtaccagcagaaaaggagagggagtgcagtgtgtccatggagctagaagaagatcctatgttctggataactgatgtttgagggaaccatggtcatctgtggagctaaagagaaaaacatgaacaagaccatgctttgtaaatcatgttaaggatctcagagtttattcaaagagtgatgagccacagtgaatattatacacrgggagctgttttgattaagtttcattagaaagatcaccgtggctgagcagggaaggatggatacagtattragtgtggatttggtgaaaagaagagaagcagaatgaccaagaggttcagccttagctaggaattgggagaggacagagaggaaaggagactaattggagagatatttattagacagaattgatgagrcttcatggttgattgtgtgggggacagaaaggaagcaaagttgctgggtcgggaacttggggaactgaaatccacatgccattctatgagctaagcattacagaatgaataacgttttgtgcaggaagcagataagtcctcatgtgggcatgtggagttggagatgtctgtaggccatctaagaagagaagtccaatagagaatgggctctatggatctgaacttcaatagggaaatttgggcaggagggatggatttcaggatttcttcttgtcaaaaatgtgaggacacccctggcaaatgacttctatttttccctgtgccatacaaagagatgttatctgctgagtccaccatggggaagcataaaacccagaagtctggaggaggggagacgaggacacwtcaggaaacctcgatgttctagcagtcactaataagggtcccttgggggctggagactactgtgtcactagcctgtacagttgtgtggttctaggtatactmggtagttcagacatagacaaaaaggggatagactgcaagtggctactggagccaaagtttcccctggctacaggacggagggaccatcagtggctgacacaaggaaaaataaatatatctgaaaatattgaccagagagtca

SEQ ID NO: 13280 - DNA, 17483 bp, Homo sapiens
  misc_feature (1)...(17483): n = A,T,C or G, or insertion/deletion polymorphism (see Tables 1-2)
gtgagtcccctgtggctgccgtagctgatttagctgattaccatgagctccgtggtttccaatagaatgcattcttttacagttctggaggccagaagtccagaacagtatcactgggacaaggtcagggtgtcaggaaagccgagtgtccttggaggctctaggggatgtgccacttcttcctcttccaatttctggtggctgcyggcattccttgacttgttgcccctccagtcacggcctctgttgtcacactgccccctctttctccatctgtgtcaggtctccctccccctccccctcaggaggatacttgcgatagcatttagggaccacctggattgtcttctcctaccaagacccttaacgacatctgcaaggacatttcttccatagttggtaacatatctctggggggcgctgttgagcctgtagaaygccctactttaccagtgaggggatgatggggctggaagagggaaggaatgaaaggagtgtgaaggaagcgccaccaaggagagctgtggaagcccaacccaaagaccgcacctgggatgtcgggaagggccaaggtacagaaggagaaggaagagggttggaggtggagggccagcagcaccaaggctcggagccagggtgaaactcccccgccaggggatggagagaaatggtggggtcgttctctcaggcagtggcacagcagagccagggccagatctggaggtggctgtgcccccctggggggtgcagactcacagcccctccaacagggagcccctccaggtgagagcgaaatggagatgagcgcaaaaccccgactatcaggcagattctgcagcaaaaatgacttcagaggtgaactgtgtgtagcctcaggaacgggatagaggtggcccttgtaaacctaccctgcaatggtgtctaggtcccatgtcccctgttccagacagaggcaggccttggcctcctgaggagggacagcaggagggcaggtccctcactgagcctggagtctctctctctgtacagcaggcaccttctcccgaccactcccaccaccaacatttcattctattccttccctcagggggcagctacaatttctctcttagcccaaggaaaggaataaaacaaactgccttatattgaagtgaacatggctgatctgggcttattgggagccctcccaaggggcggggtctagttctcattatcttctccatcaaggtggctaagaatttttgcagtttcttataactcacaaagtactgtcctagaagctatatccccatgaggggaggtagggcaggtattatcaggttcgcttacaggtggtcaacagagggtcagagaaatcagtgatttggggagctcatacagctgctagatgtagcctggcatcagtcaccgcaggagggcccaccccggcctgagtgcaggcagaacgctgtgacactgagtgacatggacaagtcaccatcctgagcctcccattctcactaacagagaatcaccaccctcggcctgaaggacaggttgtctgcaggtgactgccggggtcacggcaacagcttcccccctgccaggcctgggacccgagttgcagggagtcaggtgtatggccttttgtggtgtctgtgtggtccaggaagagaggggctgcaccgtgtgtgtgtgtgtgtgtgtgtgtgtgtgtgtgtgtgtgtgtgtgtgwktgtgtgtgtgcatctgagtatccgtgtctctgtgtgatgctatatgtcaatgtgtctttgtgtgtgtgtgtgtgtgtgtgkctctgtgtgttggcatgtaactgtaatgtctttccttgtttgtgtgtgtgtctgtgagtgtgtgtgcctgagtgcacatgtgtctctgtctctaggtgtttgtatctaaactgagggtgtgtctgtgtgtttctgtgattgtgtgtctctgagtcggtgtgtgtctgtaactgtgtgtgttacatgaaacagaagcagatgtagtgagaatgagagggtctaactccctttatcctcacacaaggacccctcactagagtggagagaacgagtccttcccagtcacacccaggagccctcgggtggcacttggcagstggtgtcaccaccctaagtacccacacaaatgggctatggaggcagagcaacaaggattccagctcctggtgagagattcccaggccagggtcttggtagacacaagcctggtgacttcaggcagctggcaattactgggcatctaccaagggtcagccacggttccaggcccctagcgtgtatgaattccttggctcctctcgtcacctctctgagggtgtgtcaaggagagaggaacctggatcttggatggccayggggctcccttccacccacatcyccacatggctgcacagcacaggctggttctgttggactgagcccatccggggaagaacagcgagaccctcgggtgagatcgggctcactggagacaaaaagcatggcaggagctggaggygccccaggctgatttccrggacaggagkttcctgracacagggactgagcatccccacagccccctagactggcccatgagcacgagaagccctgagagtgcgtggggatggcctgtgtgcaaggcagcgcagcgagcctctctgcacaacccacaggctctgctgggtgaggagttctccctcagcctcctctggagctgacgctgggggagagcgccgtgagyctccctgcctgaattcttatctgcgcttcacacaggaggaaactgaggcacgcagagttttagctcctcttggccagagccaggatttgaacccaggcgtccgaaccttggtgatcctgcggggcagagtgagttgggggwtggaattccatttctcacaaagtgcccagcacagggtgggcccctacagagggtaagagctggggggcggggctcggtcgggtgtgattttccccttctcctgccttccccagggtgggactcccctctggtgtcctggtattcacctgtgtctccacctgtagaggcaggaaggattcagccttagggatgcccccttgctctccaacaggcccctccgcctcaggctctttttttcttttttcttttttttttttttctttcagatggagtttccctctgttgcccaggctggagtgcaatggtgcaatcttggctcactgtaacctctacctccyrggctcaagcgattctcctgcctcagcctcccaggtagctggcatyacaggcatgcgctaccatgcccggctaatttttttttgtatttaatagagaccgggtttcaccatgttggtcaggctggtcttgaactcctgacctcagctgatccacccaccccagcctcccagagtgctgggatcacaggcgtgagccaatgcgcgcagccaggctctctttttcttaccctgctcattcaaacctccagcctgagccagagtccaagaccctgttggaccccatggccactccctaagagtctcagaggaggarggatgcccttttagctctggcccttcagagcttgttacccagattccagaggacactgtgtcatctcctcactgctctccggtccccaccttcctgcccccaggggcctctgcccttgatctcttggttagaactcctggcttgaaagggtgaggtgaattcattaacttctctgatggcctgaygaccttttcagtcccctcttccctctctcctacctggttcatggtccgctcctctacctgctggggccctcacaggtcctgaaggctttgtgggttcgaaacccagccctctcctccccgcaaarcgctgcttctraggccccttcccrttgtccagcttcacatttacattgatttcacctcattctccccatattcccacttcaaaaggaagatggagaggtggaaatacttttctgagatcacatcgttggtgagcgacagagcctggaagagaagccaggcctgttgtcatcacttcctctcccacacactcatgtttttctggagagctcaacctccccgggtcccttattgctgttaggcccagggctggaaccagcaatacctgagtctcccctgagctgacagcaggmgcctcagcccacgtgtgtggcagggacctccgactcatagcggggcaactccaggacaggctccaggggctggggcacaggctcctctgtgggcacagcccctgagtctccctgggggctggcattaagccctgggtcagggaggaaccttatggatgtgagagctccatcatgtcagtgaggasatcggctataggttcctgagacctgggacagcagacgcagtgcaatcctkgggaccctaaacagggcccccatcccagaggaatggacatcccacacggcctgggsccaggcagattcacatgggcctcacttgacttaagtccagtctgaaggagagaagcttctgtccaattaggcaagaggagaccttcaagacagccagggtgatctgagcccccaccccaggggtgctccacaggggcaatcagcaaggccaggggatggtttatcaccatccctgtgagytgagggtcactacatgactgtggttttcttgagaatgttgtcaaacatcctaggatgcaccacagagtcccccacagcatagcactgcccagcccaatatgtccaaacggccaggatcaggagccctgacgtcctccgggcctggccaagagcagcatccaaggccccagcctctgaggaggcagtactacagctctacgcaaagcacttggccagcagctggtggcttgtcggctccyggttctgcctgaccagctatgtggccttgaacaagttactgaaccactctgagttcacctttcccatcctatgaaaatggaaattacaagacatatctttagacgaaaggcaatgtctgcgattgcccctagaaacagggctgtcatgtgctttaatcagcagcattccccaggccaggaatgtcacagggctcagacaataatcaaaccaggctccagggtcctataaagtgaaggctatcacagttgggaggagagggagatgcatgaagtgtgtggaatctggggagagcctaggcagaattcaggtaggctgggtttacacagcgcctctgagcyctggctgtgtgtcacggtacagtatcccgtccctctggggacagagcttctctgtccattaaataagggaggtcagtggagatctccaaggactgttgtggtgtgtggaagtcattgctgatcctgacttaacccacttccttagtaaccctgggcaagtcccttatgcttcccgtgccccagtttcctmttttctaaaatgggggccagatgctgtggctcatgcctctaatcacagcattttgggaggccaagtagggaggatcccttgaggtcaggagttcaagaccagccagggcaacatgacraaaccctgtcttcactaaaatacaaaaaattagcctggcgtggtgtgcacgcctataatccccgctacttgggagactgaggcaggagaaacgcttgaacccgggaggcggaggttgcagtsagccgagatcacaccactgcattccaccctgggcggtagagccagactctgtctccaaaaatataaaataaaacaaaatggggctgtggcatttgcacctcaaggtcattacagaggtaagtggagctgcagagagcaaggactcaagacccagccggccaggctgagggatgcttgcttttcctgtttgctgacyttgggcttgagtctcacctctctgggctttggtttcctcatgtgtaaaaggaagatagtagcattaccacctcacaggattgttacaagaaagcaatgagttaacacacgtgtgcttagaacagttcttggcataagctaagtaccttacacgtrcttgctatctttcttattctttcartgatgatggtgtaggaaagtgtttgcaatgggctgggcacatggtggatgtttaataattcatggttgcaatmacacaatgtcagtccctggtcactgkgagtcatcatgtgccctgacttggggcctggccctctgcctctgtcttgcaggacaatrccattctctgtctcatggggcrtmctcctgctggcaggcctgtgctgcctggtccccagctccctggttgaggatccccaggaagatgctgcccaaaagacggatacatcccaccatgatcaaggggactgggargaccttgcttgccagaagatctcctataacgtcaccgacctcgcctttgatttgtacaaagagctggctgatctatcacaaaccagcaatgtcttagtcacyccaacaagcgtggctatggcctttgcaatgctctccctggggaccaaggctgacackcgcacagagatcctggaaggcctgaatgtcaacctcacagagaygcctgaggccaagatccacgaatgcttccagcaagttctycaagccctcagcaggccagacacccggctccagctgaccaccggcagtagcctgtttgttaacaagagtatgaagctagtggacacgtttttggaggataccaagaagctgtaccactcagaagcctcttccatcaacttcagggacaccgaggaggccaaagagcagatcaacaattatgtggagaaaagaactggaagaaaagtagtggatttggtcaaacacctgaaaaaagacacaagtcttgccctggtggattacatttcctttcacggtaaggtagcactacctgtccaagcccgttccactgaaataatccaaacatattctcaaattactagttcttaagctttcctagacaatgtactatgagatatggcagggcatttaacatggattctgcaattttccaaacacaaacaataaaatactttccatgatcaaacaagattgaagaatgatgagtttaagacagccaaaccatcatcttctctacagaccttgtcagagcctttattgtcctaatactcattggaaatccctaatagggagggggcagaatatgaaatgcttcccacatgctaaagccagaaaaatattttgtggcacatgcataaaggaatagtttcatggaacatrctttagacgaccctagtgtcccagaagcagtgtcagctttgccgtctaaaatattggggttcaaatcctgcctctaccacttactagcttttgataaaggacaatgcattctacctctctgaggtgctaatttcccgtcttagcatggacaaaatagcatccttgctgtcaggttgttttaaggattaaacaagtgacagakaccatggggatggtgtgtggcatacagcaggtgatggactcttctgtatctcaggctgccttcctgmccctgaggggttaaaatgccagggtgctgggggccccagggcattctaagccagctcctattgtcccaggaaaacagcataggggaggggaggtggaggcaaggccaggggctgcttcctccactctgaggctcccttgctcttgaggcaaaggagggcagtggagagcagccaggctgcagtcagcacagctgaggtcygggctctgctgtggccttagggcaggcccaggcccctctccagcccccgtctcctccttctgtccaatgagaaagctgagctcaagggtccctgaggcacctgcccacttggcatgcctcgatggtgaagctttcttggtacggcagaggggagtctgcctaggcatctgcatctcccctgctsatccagggaaaggcctcaggagaagtaagcacaatgctgtcctcgtatctcaacagaaccagccctctgcatgagatcagaagcctccagccaaaggtggcaaggcataaggagttccgattttactcattaactttcattaaccatccccaagccgctatcgaataaacagagccaaatataaatgcttcttctgtggcaccaggattttgccaattagttcaagtatatagaaactctggattcttctttatcttcaggtgattctcacaaaagctctccagcagccagatagttccatttgaatcccattttacagatgataaagctgaagsagagggaagtgtcctgccaaaggggctcagggctcctttcattcacacacttccacccttttatcccacacctggctgatgcccaccttccttttcttccaggcaagtggaaagataaattcaaggctgagcgcattatggtagagggcttycatgtggatgataagaccatcatcagagtgcctatgataaaccacctgggtagatttgacatccaccgggacagggagttatccagctgggtgctggcacagcactatgtggggaacgccactgccttcttcatcctgcccgatccaaagaagatgtggcagttggaagaaaaattgacctacagccaccttgaaaatatccagagagcctttgacataaggtgatttccagttcaggggctgagtcagaagctgcccagacctttgagccatgtcaggactgaggcccaacaggactggccagagggctggggagggtgracctcacatccctgggtcacagctactgcagaggccacyactgagttcaggcaggaccatccatgctccatgaggaggacagtacccaggggtgaggaggtaaagawctcgtccctggggacttcccactccagtgtggacactgtcccttcccaatatccagtgcccagggcagggacagcagcaccaccacacattctggcagaaccaagaaggaacagatgggcttcctggcaaaggcaacagtggagtgtggagttcaagggtagcatgtccttcaggggacgggggaagagcctgtgtggcaaggcccagaaaaacaaagttcggaattggaacagccaggccatgttagcagaaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntacccaatagttattttctctgatcctctccctctgacttctgatcttgatatgggtgaggacatggcactaagtgggagacgcaatcagaagagaaagcactggcactgtggtgggttccagaagaacaggagaaatgctgctccatgccttgattctctttcctgcatggcaggtctatcaatctacattttcccaaactgtccatttctggaacctacaaactcaagagagtccytaggaatctgggcatcaccaagatcttcagcaacraggccgacctctctggagtcagtcaggaggcacccctgaagctctccaaggtgaggtcacccagaagaccgtgttgtcccctggtgtcggctggcagattgtgtggaggttgcagttctgycctgaggctgaagaaggggctaagagacacaaatgaagacccaggccgagctcctgaggatgcctgagattcactgagatgggccatggtcagacggcggagctggggaggcgcctcctgtgcagctggcactttcagggcctcccccgctgttgtgtcattgaccctttgcccagaaccttccagtttggggccttaatttatccgtattgatacaagaaagcttaggctcatttcaaaagactttctggcccctttcatctgtgaggttttgagtttctggtgcatcaccaagcccgaatcaatgaatgatttgagctaaagatgacgctaatttaggaaaactaaaggtggccaaaggacaactttggcagttctgtgaatggctgcgttctcttggggtctgggcaccatgaaggacactgtcagagtccatgtccccaaggagcttcaagctgtgtacaagaaaggagagagccctggaggcagacgtgcagcggggatgcccctccactttctgaattgtgggtgcaccctgagcaggggagaggctcttatagggaaggcagacggaggggagccagccccatcagccaaagccttgagggggagcaaggcctgtgtgacagggagggagaggacgtgcagggtcagtgccacccgagtggagaaaggctggagtgagttcctcacctcctaggatgaggctgtccacatgggcctcgctccaggcctgggctggggcatggctcagcctcggaacgtatctctgcttctctccccttcaggctgtgcatgtggctgtgctcaccattgatgagaaagggaccgaagccaccggagccccccatctggaggagaaggcctggtctaagtatcagacagtcatgttcaaccggcccttcctggtcatcatcaaggatgacatcaccaactttccgctcttcattggaaaagtggtgaatcccacccaaaaataactggctgtcactcctcagcccctcccctccacccctggccccctccctggatgacattaaagaaaggctgaattgccctctgcctgcrtgtgactgcaaacccctcccctgttgtttctgagtctccytttgtgcactgaggctgtgtgtggactccaggtcacagtgctgtctccgggcctcctgaactgtgttcatggagcacctgactgggcaggcatgtgctaggccaggatggagggggctgaatcctcagtttaagggcctggacctgggagcttatggaagagcaaggggctaccaggagcggccgccaagtgcgggtcacccagagagagccaggccagggcctgagtgctagaacgctgtggcactgtgtgacmcagaaaagccactttgctgagcctcccgttctcagtggcagcatgaggagagaatgcccccacctgtgagtgcaaagcagcccgtcagaggcgacggcggggacactgccacaccttgcctccctgccaggccccaacccggaggttggggaagtcagatgtgcagcctttggtggcgtctgtgtggcccagagtgagagggactccaccacgtgtgtttgtgtgtgtctgtgtgtgtgtgtggctgcgtgggtgtgtctctgcgtgtgtgtgtctctgtgtgggtatgtctgtttgtgactatgtgtgtgtgtgtctctgtgtgtgtktktgtgtgtctgtatatgtgtgtgtctctgtgtgtrcatctgtgtgtctgcgtgtgtgtgtgtggctgcgtgggtatgtctgtgtgtgtgtgtctctgtgtgggtatgtctgtgtgtgtccgcgtgcatgtgtctctgtgtgtttgtgtgtgaccatgtgtgtctgtgtgtgtgtgtgcgtgtgtgtctgtgtgtgtgtctgtgcatgtgtgtctgtgtgtctaggtagttctgtctttgtgtctgcatatggctgtggatatgtctgtgtgtctargtagttctgtctttgtgtctgcatatggctgtggatatgtctgtgtgtgtctgtgtatgtgtgtgcttctgtgtttgtgtgyccctgagtcaatgtgagtctgagagtctgtgtgtctgagtctatgtgtgttagggtacctaggtgtttctgtgtgtttgcatgtggttgtgggtgaggctgtgtgtgtgatgtttctctgtttgtctgagtctatatgkgtctgtgtgtctaggtgtttctatctagactgaggatgtgtctgtggctatgtgtctgtgtgtgtgtgtttctgtgattgtgtgtctctgagttggtgtttgtctgtgactgcatgtgttacatgaaacagaagcagatgtagtgagaatgaaggggtcttaattctctttattctgaaacaaggacccctcactggagtggagagaatgagtccttcccagtcacaccctggagcccttggatggcacttgtcagstggtgtcaccaccctaagtacccacacaaatgggctaggaagcccaagctacatgaattycagctcctgrtgagagattcttgggccagggtyttggtagacacaagcctggtgacttcaggcagctggcaattactgggcatctaccaagggtcagccacggttccaggcccctagcgtgtatgaattccttggctcctctcgtcacctctctgagggtgtgtcaaggagagaggaacctggatcttggatggccatggggctcccttccacccacatcyccacatgrctgcacagcacaggctggttctgytggactgagcccatccrgggaagaacagcgagaccctcaggtgagatcgggctcactggagacaaacagcatggcaggagctggaggtgccccaggctgatttccaggatagggggttcctggacrcaggcactgagcatccccacagccccctagactggcccatgagcacgagaagccctgagagtgcgtgggggtggcctgtgtgcaaggcagcrcagcgagcctctctgcacaacccacaggctctgctgggtgaggagttctccctcagcctcctctggagctgacgctgggggagagcgccgtgarcctccctgcctgaattcttatctgcgcttcacacaggaggaaactgaggcacgcagagttttagctcctcttggccagagccaggatctgaacccaggcgtctgaaccttggtgatcctgcggggcagagtgagttgggggatggaattgcatctctcacaaagtgcccagcacagggtgggcccctacagacggtaaaagctggggggcggggctcggtcaggtgtgattttccccttctcctgccctccccagggtgggactcccttgtggtctcctggtgttcacttgtgtctccacctgtagaggcaggaaagactcagccttagggatgccccccaccctaagggtcaaagaggaggaaagagtgtccttttagctctggcccctcagagcttgttacccagattccagaggacactgtgtcttatccccactgctctctggataccacccttccgtcccaagtggactctacctttgatctcttgtttagaatcctggcctgaaaaggagatatgtattcattaactcctcaggtgacctggcratcttttccatcaccttcttcctctttcttatctgggttcatggccccatcctttacctactggggccctcactgtttctccagcctgtatctctaattctgcagctcatctgatataaaaggtagttatttcctaggaggaaatttaagggatagagagagccagcaataacaaaagagagatgtctctggaggtggatcagaacacttaattgagtgttaagagttttttaggagagataaataaagaggacatgggtaacaaaagggtaaattggggaggccacacagtagggagaaagctatgggatctgtattcttgtggaccacaatgagctcgrgggttaaaggataaagtccaaggtaaataatagtgttgagacctctgggtatatcaaatattaaaacatcagaaacatcaatgttctggaagaaagtaagaagtaatttattttcttaattttttaagtggatatgtcctttctaaagaaggtagaaaacccaaaagtcacaaagcaaggactgatatatttacctttaaaaatgcaaactgtatgccaaaaatgccattcaattcactcagaaaatataacaattataaatatacattcacccaacatcagcactctgaagtatatgaagaaacattgacccagtagaaggaagaaatagacagcaacacaataatagtaggagaatttcctgctttcaattaccaatagaacaaccagacagaagatcataagaaaacataaaacttgaacaacactacagaccaactggacctaataaacatacagaacactctaccccaaaacagcagaagacacatttttctgaagtgcacatggaacattctgcaggatacaccatatattaggccacaaaacaagtctttgcatgttttagaagatttaaatcatacaaagtatctttttctgattaaaatgaaatgaaactaggaattaataacagaagtaaaactggaaaatccacaaatacaaggaaattaaacaacatactcttaatcaattgttaacgatatcacaaggaaaattagaaactatcttgagacaaatgaaaatgaaaacacaacataccaaaatttcgtgtgcaaaaatgcagtgctaagagagaaatttgtagctgaaaatatttatgttaaaaaataaygatctcaaaccagcacctaactacacctttaggaactagagagaaaagagaacagactaaacctaaagctagcagaaagaaggaaactaaagattagagcaaaacctacaaaacagataatacaaaaataagggagaacatcaacaatagaaaaataacagagaaaatcaacaaaatgaagagttggttctttgaaaagggcaacaacattgacaattctttcgttagattgactaagagaaaaatgaagaccaaaataactaaactcagaaatgaaaaagtggatgttacgagacttttttgcaggaataaaaagaattatagcctgggcatggtggctcacacctgtaatcccagcactttgggaggctgaggtgggtggatcacgaggtcaggagttcaagacaagcctggccaagatagtgaaaccccatctctactaaaaatacaaaaattagcatacctgyaatcctagctacttgggaggctgaggtagggaattgcttgaacccgggaggcagaggttgcagtgagccgagatcatgccactgcaccccagcctgggcgacagagagagaswctctctcaaaaaaaaaaaaaawgattataagagaatactaggaacaactgttcactgaaaattggatgatgtagacaaaattggatgatgtagatcctttagtatctactggctaaatgaggaaatgtctgtgctattgctaatactatatgctgtacctgagtaaactcttctgggaagttaagacccatatacagaaaatgaagaaaaacagttcacatggtgacaacaagtctcacctaatttcccatggtcatttcatttattcaattagttgcctttaagcctatgttcatagctcaagaccattatgcaaactgggggttgccatgttactatttattttattttgtattttcctttttgcactttatacctgttagttgtcaaatttctgcagaagtacaatcctaatataataatgctcactaaggatgattgctttaaccatttctatttagaactggagtttcgaaccagggcccttggacaagaaaaagaataaaatggaatccgcatcggaaaggaagaaataaatttatctctgttcactgacaacataatcttatatgtagaaaatgctaaagattcaccacacaaactgttaaactgcaaacaaattcagcaaagttgcaggatacaaaatcaacacacaaaaatcagccgtgtttccacacaagaaagaaaataagtttaatcagctcatggttccacaggctgtacaagaagcatgatgctggcatctactcagcttctggggaggcctcaggaaacttaaaattatggcagaaggagaatcttccawggtatatatgtaacatattttctttatccaatccaccattgacgggcacatagattgagtccgtctgtgctattgtgaatagtgttgcaatgaacatacatgtgcatgtgtctttttggtagaacaatttattttcctttgggtatatactcagtaatggtattactaggttgaatggtagttatgttttaagttctttgagaaatctccaaactgtgaaagcaggatcttgatgaagtatttgtacacccaggttcacagaaacactattcacaatgggtaaaaagtagaacaacccaaattcatcaacaggtgaatgaataaacaaaatatagtatatacatacaatggaatagcattcagcatcgaaaaggaaggaaattctgacatatgctacaagacagatgaaccttaaggacattatgctatgtgaaataagtcagtcaaaaaaagkcaaatactatatgattcaacttatatgaggtacctagaatagtcaaattcataaagayagaaagtagaatggtgattgccaagtactgggtgcaggggagaatgartaattgttcaatgggtatggmtyttgagttttgcaagatgaaaatagttctggggattgattgcacaacaaagaatgtacttaacacaattaaactatatacttaaaaatagtcaaaatgatarattttatactaagtgtactttactacaatttaaaaaaattaaatacaaattatctttaaataacaaacataataataattgtgcagccaatattttcataataaaccagtcaaatctctaacatattactattactcagaatccttatggttttaatggtatttttacatcaatttttagaaaaatagata

SEQ ID NO: 13281 - DNA, 15510 bp, Homo sapiens
attctcctcccagtggcttgtgggtgaggtggggcccagaccccatgcttcctgtgctcccaggatctgggcacgggtggagaaggggccccacggggtcttcagtgcaggtccctgctgaatgccaaggccctgggtgcacgtcctccttgaacttgctgtggagttcgtcaacagagctgcgtgccttgttggtagagggtctcagggcagggctggagcagagaggcccctatgtggcagccggccttcagtcttgttcctccaagcaagtggggtggagatgttggggtcctttggctggatgccactatctgttgaatctgacaaaataattttcttttttttttttgagacaagagtctcactgtgtcgcrcaggctggagtgcagtggcgcagtctcggctcactgcaagctccgcctcccgggttcacgccattctcctgcctcagcctcccgagtagctggggctacaggcaccygccaccaygcctggctaatgtttgtatttttagtagagacggggttccaccatgttggccaggmtgstctcaatctcttgacctcatgatccgcccgccttggccccccacagtgctggggttacagctgtgagccaccgcgcctggctctgccaaaataattttattagagaacttgagggcagtgcccagaattgaaggcgaagccccagaagcatgttttgcagagaagtgcccagggaagctctgagggcccatgtagcaaagatcaggggatagtcggtctgagggtgaatgggccactcggaccaagaccccagtcttgggggagggcttagctggagcaggtcctggcacagttgactgatggtgcacagaacccgtgcatcccacggccccacggtgctgcagctgcaggaggggcggaggctgcagccagacagcatcagaagccagcgtggttctggaaggatcgagaacaccaagstgttagggctgcagcaggggtcctgtcccctggcacccctcaccgccctaatcttttacccttaggaggcagcagacacgaggggctgcccgaggctctagggcggccagtgaggcaggaaacatgttccagccccagctaggtactggtccgtggacccacctcccagaaagcccatcactgtgtaatcgtctaacctggggctcgccgaggcctgtgagttcatccttttggcagttcctggtgtctccttactctgctcagcatttcctgggcgggagcttagggtgcaggaccctccccaggacgacgagggcccagtgtccatgacaagagttggcccgagggctgagccacgtgtgcccatctcagacgtgggcctgagggtgcagccctggccctgtgctggccatttctaggagcggtgccctgaggtcccagctgtgatagccccacgctctgcaggaagagatcatgggggcggggagttggtgctgcggcctcgttcctctctgcagtgagtgaacgatgtttgtggtcagcaggagcctgtggggagcacaggctggtcctcctggtgtcccacccacccctttttccatgggggatctgcactcatctccagggaagatggttgggagataaccccagtctgcyctaggtccccaccctccacagccagggtggtccgtggtgagcttcagccatcgagatgcgggagtctgctagagtcttcagggtcttttctctgaaaatgacaggctagcaaggagacctgggtcccctgcctcttccattccagatgccttgagtccacccaaataggggatgtgatgtttggagctgcagcagccgccctacggttgggagtcagagaagagccggtgttccagggacaatgcagcagaggctgagcccaggcctgctgtcctgagaggtggctggatcactgacactttggcagtggtgctggggtttatgtcatgacctgcagctgagcctacttccaatgamcgtgagatctgaaagactgttttgagggcgtagcctctgccatgattgtggggaatgctgtcctgtttcctcccttggccctgctcagcccagcgagaggctgaggcrcacgtggctccccgggtgcccacaggcagcgtggctcaccagccgggcccttttccactgagccagaaccccccaaagccttcaatgcaggcaccacggtgagcccacgagaaaccctgcttgccacctcccacacccccacccccaagttcaaaggaaatggtccctgaaccaagggctgagatcagctgtgggtccagctgtcctggggagctgtactggagcccaccacggtgggactgttggtccggcggtgacccccacctccatgtctgtggccgcagctggacaggccactccctgggccacagagatgttttacctctcgcagccctcgggcacacattgagcagatgtgtgtgtgtgtgcgtgtgtgggtgggtgcgcatttgtgtgtgcctgtgtgtgtgcgcatgtggtgtgggtgcacgtgtgtgcacgtgtgtgggtaaacattgtgtgtgcgcatacgtgtgtgggtaaacatttgtatgtgcacgcgtgtgtgggtaaacgtgtgtgygcacgtatgtatgtgtgtacatttgtatgtgtgtacatttgtatgcatgtgtgcctgtgtgtgtgtgcctgtgtgtgtgggtgcacatttgtgtgtgtgtgtgtgcctgtgtgtgtgtgtgcacgtatgtatgtgtgcacacttgtatgcatgtgtgcctgtgtgtgtgggtgcacatttgtgtgtgtgtgcctgtgtgtgtgggtgcacatttgtgtgtgtgggtgcacatttgtgtgtgtgtgcgcctgtgtgggtgcacatttgtgtgtgtgtgtgcctgtgtgtgtgcctgtgtgtgtgggtgcctgtgtgtgtggggcacatttgtgtgtgtgtgtgcctgtgtgtgggtgcacatttgtgtgtgtgcctctgtgtgtgtgcctgtgtgtgggggtgcacatttgtgtgtgcgcctgtgtgtgggggtgcacatttgtgtgtgcgcctgtgtgtgtgggtgcacatttgtgtgtgtgtgcgcctgtgtgtgtgggtgcctgtgtgtgtgtggggcacatttgtgtgtgtgtgtgtgcctgtgtgtgggtgcacatttgtgtgtgtgcctgtgtgtgtgtgcctgtgtgtgggggtgcacatttgtgtgtgtgtgtgcctgtgtgtgggggtgcacatttgtgtgtgtgtgtgcctgtgtgtgtgggtgcacatttgtgtgtgtgtgtgcctgtgtgtgtgggtgcacatttgtgtgtgtgtgcctgtgtgtgtgggtgcacatttgtgtgtgtgtgtgcctgtgtgtgtgggtgcacatttgtgtgtgtgcctgtgtgtgggtgcacatttgtgtgtgtgtgcctgtgtgtgtgtgcctgtgtgtgtgggtgcacatttgtgtgtgtgtgtgcctgtgtgtgtgggtgcacatttgtgtgtgtgtgtgtgcctgtgtgtgtgttgcaggccctggatgccagccacagagataaacgcaggaagacgtctgtcttcattctcctcgtgggtcgctggtccagaaacacctggatggaaagtgctctgcaggaacggtgcctctgcctgtggcggggaccctggtgagcggatgggccagccccacgtgtcttccggccactcagcatgcagtgtttccaggggcactaagagaccaaaatcgagatatgattagctgtaggatgtcatctaatcacagatcatcccgaggctaatttatctcccccatgaccataacacatcaaaaagttgactttttgcagctcggctgtgcctcatcttcccacgaagccccgacaggcacatccagtgaggaaccacagtgggagtcctgtggcagggtcaccccacttccgatgccctccagctgcatcttggcacgaaaaaggctgcccagttctcatgccctttcaagtcccgggctggggggtagcagtggaggctggggttaaccgccgtccgtctcaaaggcctcattgtggagctgcaaacacgaacgtccttgaaatgtgaggggacagtgctctggggcaggggctgctcactggttcatggccagaggtgagcgggctctgggtctgggtctgtraggtgctgtggacgtcgggggtgctcctggggcagggacacagccacggccctcacaccagtggagccgtcttccttcccgaggcagaggcttggccttctcacaccttgggacccttctctcccctgtgctcatgctggaagcacagcgtgagggggcaaaggtcatgggaggcaaaaggctgggctgaggccgaggctctgtggctgtggccggayaccaggtcctgtggtggtgtgggcagggcgcgctctctcctctgagcagcctggggctgcgtgtgtgaacagaaacaggcctgccratttgaagatggtttgaccaagtctcccaaagctgaagagaggtccctgcccatgtcccccgggtggcaatccacagacgcacctgtgtccatcagacggtatcgttgatagggagtctgaagccacccagacgtggtctgttcacgccgtggacaccacggtctgaggcagacggttacagccaccggcataggcgaatctcagccagagagagtgaactgggacaccattcacgtgatgggccagatgggctggcagcggctcgctggagccgtccgggtgggaacgctgtgtctgttggtctggtgctgcttatgtggctggttcaggtctgtcatccgtcaacctgcatatttatcactggtgcattttcatgtatgttgtacctcaattaaaacattttaggsccgggcgcggtggctcacgcctgtaatcccagcactgtgggaggcggaggcgggaggatcatgaggtcaggagatcaagaccgtcctggccaacatggtgaaaccccatctctactaaaaaaaatacaaaaatttgccgggtgtggcggcacgygcctgtagttccagctactcaggaggctgaggtatgagaattacttgaacccagtaggcagaggctaccgtgagccaagatcatgccactgcactccagcctgggtgacagtgagacttcgtctcaaaaaaaaaaaaaaaaaattaaagcagatggggtgtgggggctcatccctgtaatctcagcattttgggaggctgaggcggaccgatcacctgaggtcaggagttcaagaccagcctggtcaacatggtgaaacctcatctctacaaaaaatacaaaaaatagccaggtgtggtagtgggtgccgtagtcccagctagttgggaggctgaggcataagtattgcttgaayccagaaggtggaggttgcagtgagccaagaatgcaccactacactccagcctgcgcgacagagtgaaactgtctcaaaataaataaatacataaaattatatrtatatatatatatatatatatttttttttttttgagactgtatytctgtttcccaggctggagtgcagtggtgtgatctcggctcactgcaacctccgcctcctgggttcaagcaattctgcctcagcctcccaagtagctgggattataggcgtgygccaccacgcctggctratttttgtatttttagtagagatggagtttcaccatattacccaagctggtcttgaactcctgacctcatgatccgcctgcctcagcctcccaaagtgctgagattataggggtgagccactgtgcccggcaataataatwtttttttttttgagacagagttttgctcttgttgcccaggctggagtgcaatggtgcaatctcggctcacggcaacctccgcctctcatgttcaagctattatcctgactcagctgggattacaggcacccaccaccacacctggstgattttggtatttttagtagagacggggtttctccatgtcggccaggctggtctcgaactcctgacctcaggtgatccmcccgccttgggctcccaaagtgctgggattacagccctgagccaccatggctgacaataataaaaaattttaaagcaaaactaaagatttataaattgtaaaatgcggttgtaacaagtatttactgtaccagtaaatatgaaaaatattaatgtcctcacacacatggaggtggcttgwgagtggtgtgagcatttcatggtcagagtttggcagttggrcgagagacaggatggattttaactcgaacatcgcagacacaaaactgaaaaccctgatgcggtgcctgcaccgttgcctcctttcctgcagctgtaaatgggacgagtaattccatccccctcccgcttccacccttcagcacagacgcagtcttcagcaaggaagtgctgggaacgccctggagtgaacccaggaagatgcctgcagtgggtgccagggcccctcyccaccgtycctgctgggcttcggggccacgcccgactgctgtgaacggcctgcggagcaccacgtgcgacggctggaggcgagaggtctgcctttgatgtggctgttggtgcagggcctgtggtgcsttccgcagcggaaatggcgcgccgcccggggagggcgggagcagcgtcccgggtgcccctgtgaggatgagcgacgagatgactggagggtccctgaagacctcacyagggtgcccccagccggtccgctcccaggaagcgacacccccacagccccagggctgcagctgagggggtcgccactctggctgggcgaggctgggcccttgggggcaggcgccagagtggcctcaggctctacragatgcctgaaaacaccaacctctccagggctcactagcattggacgctttcacgctctgccctggccggaagccccctcaccccgcgcgatgtgcaaactcctgcagggctcactcagtttccagaactttaattattggaaagttctccctggtccagcccccaaatctgccgtgaacgttgacagctgagttgctgctccatgcgtgctttggctgagagcagaggggacccctgtcctccctgagctgctgacgaggggaggggtgaagggtggggcctctggagagggcaggtcccggggaagctccggactcctagaggggcggccaggtgggggccctggtgaccaggacagactgtggtgttttttaacgtaaaggagatccgyggtgtgagggaccccctgggtcctgcacgccgcctggtggcaggcygggccatggtgggtgctcacgcccccggcatgtggccgcyctcartgggaggggctctgagaacgactttttaaaacgcagagaaaagctccattcttcccaggacctcagcgcagccctggcccaggaaggcrggagacagaggccaggacggtccagaggtgtcraaatgtcctggggacctgagcagcagccaccagggaagaggcagggagggagctgaggaccaggcttggttgtgagaatccctgagcccaggcggtwgatgccaggaggtgtctggactggctgggccatgcctgggctgacctgtccagccagggagagggtgtgagggcagatctgggggtgcccagatggaaggaggcaggcatgggggacacccaaggccccctggcagcaccatgaactaagcaggacacctggaggggaagaactgtggggacctggaggcctccaacgactccttcctgcttcctggacaggactatggctgtgcagggatcccagagaagacttctgggctccctcaactccacccccacagccatccccyagctggggctggctgccaaccagacaggagcccggtgcctggaggtgtccatctctgacgggctcytcctcagcctggggctggtgagcttggtggagaacgcgctggtgktggccaccatcgccaagaaccggaacctgcactcacccatgtactgcttcatctgctgcctggccttgyyggamctgctggtgagcgggagcracrtgctggagacggccgtcatcctcctgctggaggccrgtgcactrgtggcccgggctgyggtgctgcagcagctggacaatgtcattgacgtgatcacctgcagctccatgctgtccagcctctgcttcctgggcgccatcgccgtggaccrctacatctccatcttctacgcactgygctamcacagcaycstgaccctgccgyrggcgcggcragccgttgcggccatytgggtgkmcagtgtcgtcttcagcacgctcttcatcgcctactacgaccacgtggccgtcctgctgtgcctcgtggtcttcytcctggctatgctggtgctcatggccgtgctgtacgtccacatgctggccygggcctgccagcacgcccagggcatcgcccggctccacaagaggcagcgcccggtccaccagggctttggccttaaaggygctgtcaccctcaccatcctgctgggcattttcttcctctgctggggcyccttcttcctgcmtctcacactcatcgtcctctgccccgagcaccccaygtgcggctgcatcttcaagaacttcaacctctttctcgccctcatcatctgcaatgccatcatcsaccccctcatctacgccttycacagccaggagctccgcaggaygctcaaggaggtgctgacrygctcctggtgagcgcggtgcacrcggctttaagtgtgctgggcagagggaggtggtgatattgtgtggtctggttcctgtgtgaccctgggcagttccttacctccctggtccccgtttgtcaaagaggatggactaaatgatctctgaargtgttgaagcgcggacmcttctgggtccagggaggggtccctgcaaaactccaggcaggacttctcaccagcagtcgtggggaacggaggaggacatggggaggttgtggggcctcaggctccgggcaccaggggccaacctcaggctcctaaagagacattttccgcccactcctgggacactccgtctgctccartgactgagcagcatccaccccaccccatctttgctgccagctctcaggaccgtgccctcgtcagctgggatgtgaagtctctgggtggaagtgtgtgccaagagctactcccacagcagccccaggagaaggggctttgtgaccagaaagcttcatccacagccttgcagcggctcctgcaaaaggaggtgaaatccctgcctcaggccaagggaccaggtttgcaggagcccccctagtggtrtggggctgagccctcctgagggccggttctaaggctcagactgggcactggggcctcagcctgctttcctgcagcagtcgcccaagcagacagccctggcaaatgcctgactcagtgaccagtgcctgtgagcatggggccaggaaagtctggtaataaatgtgactcagcatcacccaccttagccccttccagaaagtgcttgaagtttgcgggtggagggatgggggaggggaaggtgggcaggggtgagagtcgagagggaagaaaggagtcccggaaaacgtggctgcctccccaggtgaggaagccacagccccagaggccccaaatgcctggggagtgtggaggtcccaaccaggcttgcgctgaccctgcttctcggttttctctccgtgctgacaaaccccagcctagaggaaggacgagcaggtgcagcagggccccagtcccctccactcttgacgctgtcctagctgcagaagaggcgggttcccagccttccctgtgaccacatgtgacctcagscgggacacatccctttgctggccctggccctgagtccctccagccatgatgagccgtgaatgggaccatccctgtccactctgagatgcctggaagggggctcagtgcaggtgggctgggggctgggtctgctgtctgcccagcactgccattctgggagtaggcaggtggggaaggggtcgggggtggagggtctgtgttcagccagtcctgggaaatgcttgatgtgaggcttctgaagatggcagtgaggsagaggcccagccggcggagaagtccctgggagtgagtacctggggatgaactatgctgcctggtgctggggagcagtggcgcccctgggccatccctctgctgaarcctgggcgtctcgctgaagagaccacctccatttcctctgcwgagactgagcactcagtcagcccccttcctgggacaggctcaatggaggctgcagggccatcagccgactccwwcgcaggctcagtcagcagccccctggccagccccacccctgactgccggcctcagaactgggagctgcttcctggcagggcccgcctctgctgggagaccggacggtgagtcagccttaagcccggcaccagacccctctgaggatggagcaggagctggctgccctgaggctgcaaaacttcttccctcgtggagacagggaggcacctcagacactcaccccggactcccttgaacagggacagggaggaaccccaggcagctagaccccagcagcagccacacgagcacactgtggggcagggaggggcatctcttgagaacaaaagatccatttctmgactttccaaactggagagcttcttgagasaaaagagagagacaggtacaggtccacgccacccacacacagccctgtgcacacagaccggacacaggcrtccacaggcaagttcgcagctgctcattttgtgaagtgaatgctgatttgggggccgggtggggttcgtctgtacatcgtgcactgtcagacccttcctgaaggatttttgttactgaagtatcagaaggcccttgttctaaggtggtggcactgtaatatctggcccaggaggaggtcagtgccgtgccggcgagtcctttgctcccttccttctctgaccagtaaacgcatctccagtcgctcccccgaggcccccctgcacgcagwctccgacctcagagagtgagtcagatagaagccgctgcccaccctcccccaccctggccgggttcttgcctggcttgtgcgtccttgtgacaattcctgacacggatgcgcaccgggcagtggcacgtccaggtgctgtgcgcgcccgggcccacaaagctcctttggacgctcatggcagccccttggtggaggaggtcgggtgcccaccccctccccgcccactgcggaagccggcgacccacggagctcgctctcggccgccgccacccctctgtgttcgcgcccttccgagctctgatccgacgctttgtttcttctcagtgggttcagggcctgggccagcctttacctacctcccccacccaaaaccggcaaaagctcagagcaccttgtctgccaaaagacagggagctggsatggtgcgggttggtctctaaaccggcgtggggaaaaaagaccctccgtacaaagccgcagggtggggctgtcgcaagggcggaaccgagagggtagctgggggcggggttcccagggccaagaggggccattgtcctccctggagcccggcgcccccacagccagctcctctgggagacagcccctcctttcgaatgcgcggggccctcagaccgcgcccggcccagcgctgggggatccttggctgcgggaggggcgccgcattgcgcgcggcgggcggggacgcgcggtgcggagcctgcgggccgggcggggctctgcggcggcgcctcccgattggccacccgcggtgacatcagccgatgcgaagggcggggccgcggctataagagcgcgcggccgcggtccccgaccctcagcagccagcccggcccgcccgcgcccgtccgcagccgcccgccagacgcgcccagtatgagggagatcgtgcacatccaggccggccagtgcggcaaccagatcggggccaaggtgaggctgcgcgccccggcctgtcccgggccccggggcgggaggagggaggcgccgtgccccgcgggccgcacctccagctgcccccgcccctgcgaacctgcaacaaagggatgcgcccagcgccgcgccgggcggccgggacgcggggcccccgccctgggactctcgcctgcacctctctgcccctgcccaggtgacctcgggctgtcgaggcgcagctcacgtcagtcgcgaagcctcagccccctccacacctgcgccccctccacacctgcaccccctccaccgggcctccgcaggtgcagctgggagccctgtctgggcgtggccctcttttttggggccgcggcatagccttgagtgagacgggtggggtaggcaggtttgggtggggtggggggttctcctcacagccgtgatttcctcggcccgaaccccccactggagtagccgaacgtcccccgagaggctagagccgccccgatttccccagcctgctccgacacccctcggcgtcctagctccaccctgtccctttgttggaggggttgggcctggactcgagatgaccttggtccaggaccaggctctccatcggcgcagccgctcctgggcaacccccgcggggcttgaccgcgcccacccagggtctaccagtctggggattggatgtgggaacaaagccgggctgtggggtgtggaggctgcaccgtggcgcgcccctccctccattgttagcccacctcgcagatgttggggccacgcagaaaggggcgttggtgcagctgtgcagggacccctgcctaaatcattaaggggacgtcgtgtcccctggtcctgggaggctgtccctggcccaaggtcacacagcaggtgcgagagagctgggctggcccttggttctcatcccctgcaggagccaacctggggctcgggcggggcgggttgggggcgctgcttgccaaaggatctgccctccgaacagtgttggggaacaggggatcggggggggaggctggctttgtcaggaccaaggccagggacccagctcagggctggtgcagcgctgattctgggaaggagggggtgcaggagacggtcctggaggggaaggggccagagaaaggcagcctccggaggctgttgccatggaaaccaggcaggaacaaaaagctaattacaacagggccagccacgtggctgacatgtaaattgcaactttggctccgggtggaggcgcctctgagggtgggaggcccagtagtggggagactctaatcacccaagragacagctgtgcctgccaaggagagcctgggggaggggagacctgggggacagtggcctcaaatcaaaccaggactcccggagcagcctctgacagctgccttggcctgatgggaggggctgagggctcattaatgtggtcactggggccaagcctcccctgagcatctgctcctgggagggtcaggggtcgctggggggagggagggcaggcagccctggggctcctgggagggtcaggggtctctggggagagggagggcaggcagccctggggcccacctggggtttctccttctatggctgggatgggcccagagctgtggtcccacaaggcacttgtcaggcaagagctgggatctagaagtcaggtgcacatgcagacwtcccctgaggctccacgggtagcagagggagcccttgtcccctggaccgtgtccttsgctgccttgtgctctgcttctgaacactggagctcttagtttgcccgctactttttattccttttgagttgtttgttttttcttaatatatttctttttaaaaattaatacctggccgggcacggtggatgaggaatctcatgtaatcccagcactttgggagactgaaactggaggatcactttagcgaaggagttcaagaccagccgggataacatggtgaaactccgtttcttaaaaaaaaaaaaaaaaaaattagcctggcgtggtgggccgcgcctgtagtcccagctacctgggaggctgagatgggagcattgcttcagcgtgggaggtcgaggctgcaatgaactatgaccgcaccactgtactccagactaggcgatagagtgagatcctgtctcacagtaataatagtatctgattctttttaacaatgaaagcaacagagaaggaaattttctcgggggcgkgggcggcaagagcgtgttcctttgctctgctgcccttgtggaatcaatgggaagttccttggccgttctcggcctccactcccgcagctgatagggggtgcaacgcggctgcttccctgtctggggtcctcgggcggtgcctggctgggcaggaaggcccgtgcastctgggcagagggaagtcggggtgactcgaggccgggagcaaagccgggtcccgggcggtcacgcggcagcgcggacgactcaccgcggtcacccctgcgctgggagccgagcccccggcagctcgcggggatgcagtaagccgggcgcagcccgccgggaggatgagaaaacccgaagcccggaaagccgagcggccgcctgcagtcaccccggggggggcaggggcgggccgggctatgcagaaacaccggggcccgcgggacacaggacgctgccccactgccgcagagctgaatctggacccccgggctttgctttcctggggcctgtgctcctccctccccggggcggggttcgcctgcagcggcggaggggggagcctttgtcctccgcgcgggctgcggcaccgcctcctcgcggctgcggggcggggctgggggcggggcctggccgtctcagccaatgggaggcggagtccctggctcgccccgccctctcgcctgaaagacctgcggagccgcgggccgggcgggaaccgcattcgggtcctggaggggcttggaggccccagtctcgcagccccttcatcggggacccccgctcccacctgccttggccactgccctcaaagcccggccccgctttccccaggaccccaagcgctgcgcgaggtcagcaccaaggacagcgcccgggccgagcgcctggcctcgaacgccgggttctgctttgtgtttccaggtttttgtttttggttatgagaggaggcctggctctgtcgcccgggctggcgtccagaggcgcgatctcggctcactgcagcctcggcctcccgagtagctgggaccgcaggcgctcaccaccacgcctggccacaattttccttttttcttattttcttttagatggagtttggctcttgttgcccaggctggagtgcagtggcgcgatctcggctcattgmamcctccacttcctgggttcaagctattctcctgcctcagcctcctgagtagctgggattacaggcgcccgccaccacacctggcttattttgtacttttactagagatggggtttctccatcttggtcaggctggtctcaaactcctgacctcaggtgattcacctgcctcag

SEQ ID NO: 13282 - DNA, 14154 bp, Homo sapiens
tcagggcaggacacagaccccagaagggcttaaagggcatttcccagtcccccgtatccctcagatcttggcccctctgccctcatagaggccaagactccctcagacaaatgcttgttcctctgaaatgcctcctcctgactyctcagcaagagctgacctctgcttatctccccgacactccttgtaagcattcctgctcgcctctgcagctcctgccagttgctgaccctggggaaagcaagagtggatagagaggagaagagaggagaggagagggtgggaagggttgcgaaggaaggtaaattgttaacacctccccttcctatggtcacagatcatgagtatctttggccatttgggtggctataacaaaataccataaactgggtggcttagcaacaacaaacatatatttctcatagttctggaggctgagaagtccakgatcaaggcactggcagatgcagtgcccattccttggttcatagagagtgccttcttagtatatccttgctggaaggaggaaggcagctctctgtggtctcttttgtaaggacaccgatcctgttcatgacagctccacccccatgacctaatcaactcccaaaggccccctgtcctaataccaccaccttgggggttaggtttcaacatatgaacaatgtggggacacaaacattgagaccacagcastgagtgtcgaacttggactctgagatttcctatcccctggtgcagggcagtccccattacaccagattgctgagggcagctgggaaataagctaaggacggtattgactggggtcttccttcgataacgattaagaagttggaaacaggccaggcatggtggctcacgcctataatcccaacattttaggaggccgagatgggcagatcacctgaggtcaggagttcgagatcagcctggccaacatagtgaaaccccgtctctactaaaaaatacagaaattagccaggcatggtggtgggcgcctgtaattccagctacttgggaggctgaggcaggagaatcacttgaacctgggaggtgggggctgtagtgagccaaaattgcgccactgcactccagcatgggtcacagagcgagactccatctcaaaaagaagaaaaaaagaaaaaaaagaaaaaaagaaataaaataaaataaaaagaagttggaaacaatcacttgtagcgttttgttcagaagttcccawaggaaggtcagagaagggtcattgaagacttcccaatgggaaaaaccattcatttccaggatccatactaacttctttctaaaatttaaatcaaaatattgsaatgaaagtgcaaacagagaagttcacccagatatcaggtagcattcacagccagccacatttttcaccctcttcacttggagatttggtcttgagtaaaacgttagagaatcagagaacaycagggrtccagggcctctgaagatgtgaaaaccaacctccttgttttgcaaatgtggaaggaaaagtcccacgaaaagtccaagaatgtgcccaatgttataaagagacttgccttcatattcaagaggttcaacagtcactgctctggggctgccrtaaagatggtctccgctggctatctttactgtcttcactccttttatttgcagctgagaatttctaattctgacacaaaattctttttcatttttcccttttttcatctttagctaagtgggagacaagcttcaaccacaaasgcacccaagagcaagacttctacgtgacctyggagactgtggtgcgggtacccatgatgagccgcgaggatcagtatcactacctcctggaccggaacctctcctgcagggtggtgggggtsccctaccaaggcaatgccacggctttgttcattctccccagtgagggaaagatgcagcaggtggagaatggactgagtgagaaaacgctgaggaagtggcttaagatgttcaaaaagaggtactttcagactaccccagggccagcctaaacccacacagccccagggagacacacacgccctaccagggccacacagcactggtgggaaggactcacccagccaaggagctgcctccaggcccagaggcatcctgtgacatccaagtcctgggggcctagcccagttggagggacaagagctggaaactgggttccttagggtggtgccagagtgggcagagacctctgggcagcccacrtccaagtccagagcaaggggaggctcatcctagaaaagaggccagaggagccataaccaccattgttccttgggttaaggagtccttttttaaaaccatcaaaactaagaatccagtgcattatgaatccaaggggtgaggctcagtgtgccaatgccccagaacagtctaagaaagctccttttccctttccaggcagctcgagctttaccttcccaaattctccattgagggctcctatcagctggagaaagtcctccccagtctggggatcagtaacgtcttcacctcccatgctgatctgtccsgcatcagcaaccactcaaatatccaggtgtctgaggtgggttcagaagctcctatgcatctgcttcccaagrkctattctgttctattctttctaktctactctaccccatttcattccattccattccactcaactccactccactccactccactccagttcactytattcaattccactccactccactccagttcactytattcaattccactccactccactccagttcactctattcagttccactccactccactccactccagttcactctattccattccactccattccactcctccactcctctcatccactccactctactcctccactccacatctccactccactcctccactccactcctccactccactcatccactccactcctccactccactcctccactccactcctccactccactccactcatccactccactcttccattccactccattccaytcctccactccactcttccactccactccattccactcctccactccactccactcyattctattctattccattccattctactctattctattccattccattgcagtcaactccactccactctctactattctattccactcctctcccctccactccattccattgcagtccactccactgcactccactcctttattctrttctrttctattctattctattctattctattctattctattctattctattctattctattctattctctccctctccctctcttttcccacaagtagtgaaagtttcactttgtgtcttatccttcatgtaatgggaagccatatccaccactgttccttgagttaaggagtcctgttttaaacaatcaaaactaagaaggcacttcctagctatgtgrtctccaaaaaayacttgactctctgagcttcctttctctcttctataaaattgaagaattacaccttgctcaaagatgccatgagaattcaatgacagacacatgcgaagtcaccccccagcacagtgcctggggcagagtagctgctccattgttccatttcctacttgctccatggctcagttgaacagatacttagaggttgatgcccataggcagaagctttgccatttgctatgatgacttcacctgcccctrgtggcctggtgatgcctggtgtctcccctgcagatggtgcacaaagctgtggtggaggtggacgagtcgggaaccagagcagcggcagccacggggacaatmttcactttcaggtcrgcccgcctgaactctcagaggctagtgttcaacaggccctttctgatgttcattgtggataacaacatcctcttccttggcaaagtgaaccgcccctgaggtggggcttctcctgaaatctacaggcctcagggtgrgagatgaagggggctawgctatggcccwtctgtatgctggtagctagtgatttacacaggtttagttgactaatgaggyattacaaataatattactctatgatgattgcttccacccacacractgcaacatacaggtgccttggggaaatgtggagaacattcaatcttgccgtcactattcatcartgaagattarcactgagatccagagaggctggatgacttgctcaagttcaccagcatggtagtggcaaagagaggtccagagtcctggcccttgatgcccagctcagtgccacaaagctcartaggagggatgttccagtggatgagggccaccaggaagcacaggtccaaggctggtcccacacttatcagcagcaacaactstcagttcatcctgcatgggaaaaatgttggaatgggagtctgaaatggggctactgtttcagtcctaaygtgctgtgtgacattgggacaacactttccctctctggacctcagtttccctctgtatacaaggatcagattcttgctgtgacccaagaactcctgaaatcatatagaaargctggggtgggccctgtcattcrtggttgatttcaatacactcaagtgccattcatcctttaagaaaaacatctggatatcaaggtggaaatggcccatttaatgattgattatatcattttgtggatatagttataatctgatgggcctggctgggagtggaagaagggaagccttttgcaaatagtagagtrtcagttgcaggtgccaatgrctaactttttgaattctatgttggcattaacaataaagcattttgcaaacactggttataactgtctttatggaggcagctctgggaatggtgacattgatagcttaccatgctccaggccgggtgcctggcccttcacctggatggtcgcatttgcccctcataagactcccatgaagaaaggcaccactrttatcccatctgttattcacagatgggaaaggcaaggcttgaagtggttaggtggcttacccagtcacatatcttctaagtggtgcagccagaatttggcggggggagtgcgaccaagaaccctacactcagtcctgtgctctgtgctrtggaggagagatgaccaggagcagaaacttcattcagggrcatctcaggcaccagctcccccatgagccagctaagttccctccctcccttcaccaagcaccatgtgtttcctcatgtgccraatgaagaggattagatactcaagaatggaatgagtgggtgagtgagtccttcgctgcacccaagtctgattttctgtgcgcctgctcaccccaccctgcatgttctaagcatgcttccataaggctgtgccccaccctctgattctagagtctggactgtatcagaggtgagtgcctactagaggtaacaaggtcaggaccccaaaccttgtccatcccccraagtactgagcccccaccatgcaccagcccatgccagatgctttgcacttgtgatatcacccatcccttgacaacccagcaagttctattattgttcccattttacaggcaataacataagtgctttcccagggtcccacgctggtgacagtgagggcccagggtctgagagcccagatcgcacatgtgcgggctggtggcaggggagatggcagcaaccagactcagacatttctctgcagttgtgctgtgggctcagggtggctctttaygaaggggccccttcrtggggtcatgcactcctgtgtgytttcccttgcatcatgccttgcctgtcttggcaaatatttctctggagtttacccagccagtccaaggtcacagggaagccctgtctgtgtctcacacagaaggtyaacgtccagcactgtccaaactttactcagcaaacagtcacaaagcagctcctgtgtggggggtcaggggtgggctcactgtggtctctgctgcatgtcacacattgaagcactgtgctgggrgtcatcrcaggctgtttaactcaattgtcacatgagcctgggtrcacaaaatggtagagcagctcagagagagatggacagacagcatgaacctctgaggagtcaggttttcttggatgaagggacactaagatggctttggagcgtgagaaggacytcacctagcaaatgtgggaaaggagtgagacctccaggcagagggactggctggagacgagcgtgatgtggtgagccatggagtgtatgggtccccacagaacttcagtctgggcctgcacagggcatgtggaggagacaaggaggagggaggtggccgtgccggcggttcagtgacagagatcctaaatgggaggccaatcctaaatgggatgatctctttcatccyaatttcagggtagtttggtcatccrcgccacattccaagtgtcccctgggccctttctctccctcacccycctgtctgcacatgagtagatgcctccaygcagccctcccaggacgctcacctctatccacagatgcttctccaaaacccaccaggccctcccatggaacgagctcacctacagggtaaaatcaggtcacggtcacatatagcctgactactcccctcaggaccctcattcacagccactgtattaatttgctggggctgccaaaacaaagtgtcctcatctgggaggctgcagtagatttgctgaaattgatttgctagcgttgctgaaattgattcaagcttgattctggagcttgaatcgaagatcaaggcaagtgcagggctggtttccctgaggcctctccccttggtttgcaggtggctctcctctccctatgtcttcacatggtcctcctctgcatgtgcctgagttctaacttcctctcctctcctcatctmcaccagtcttatagaattagggccccccartgacctcattctaacttaataacctctttaaagkctctatctccaaatacagtcacattttgaaatattgagggttaggacttcagtgtatgaattttgggaggaygcaactcagccaggctcactcttatcattacagctgcactagtgccatgcctggttcccagtggacaccccaggaacagccatccatccagagtgatattctgtgacatcccctacactccacagctcatcacatcacactcgtctccagtcggtctgtctgcctggaagtcccacacctgttcccacatccactgtctgggaggtccttttcatgcttcaaagccagctcagtgtcctcctttgtacaaaaaaatgtcctgacctctcagaacttcattctttctctctttctgtcratctttgtctgaactcctctatcattttgtgcacccaggaacgtgtgacaattgagttgaacaggctgcaaaaacgaaaaagaagaaagaaatgctgagttaaacaggctgcaatgacccccagcacggtgcttcaatgcatgaaacgcatcaatgacttgcagcagaggccacactcagcccccctctgccctttgagtttttgcagctcttgccaagatcattcttkttcttagaaagcccaccattattttcctytctagccatatggattctaaaagttcctcttgtgagctgtaatcagaatgcagagaagtaatacaaggttagggcccaggactcyttctcccacctctccctgcagagactcagatttttttaaaaaatgaccttggtcttcrggggaagaacttcccaccacagtgaacagccatgcccagcctacacttgactgtgcggcttacttagctcatccatccaaaggctattcctgggttgcctagtggaaatccaggcatggagctagtgcaagcacaatgataagagtgagcctggcagacactgaccccagcaataatcaggtaaacaaataaacagaactacaaactatgatgacaasaattcatccatccacagatattcactgaatggccactgtgtgcctggcactgttccaagtgctgaagaaaaatgaagaaaacaaaaatccctgcccttatagaggagacattataatgtgacaagataacataatgaaaaagaatgaagaataaaatagaaaagtaaaatggattgcatgtcacttgatgacaagtactgtggaatgaggcygtcatctaaayggagcacagaaagtggaacatggcgacatctcagccaaaagacccggcagacaccatcttggccaagggatcgaggttggcatcgccagctgtgagcagtgctgacatcttattatcttcgatatggcgtcatgagcaggctgcctcctcttggtgggatcttcccccaaacccagaacctcagtctaatcacaagaaaatgacagccaatcccaagttcagggacatttggcaaaatagcccaccactcctacttaaaagtgtcgaggtcttgaaaggcaagraaaccctgggaaatcgtctttggccrgaggaaactmagcagacatgacgactaaatgcaatgtagaatcctcggacagaaaaggacattagtrggacagctggtgaaacccaagtaagtccaggctgtaccaatgtccacttcccagttctgaggaacatgctgtggtctgtccacatttacattaggagaagcagggagagcgtatatgggacytctctgtattgtttttataacttttctgtaaatccaaaactgtcttaaaatagtttttttaaattatactttaagttmtggggtacaggtgcagaatatgcaggtttgttacataggtatacatgtaccatggtggtttgctgcaccccctttttttaagaaaatgtttcaaaaagaaaaacagccaagtaggggagggcacacgagtggggttgggaattgcaaaggcagaagcaggagaccagttaaggaagaaaacggggcactaagagagacaatcaggaggacctgctgcagccagggccctgaggggctccctgaggtggtgccattgaagcggagttctgagggacaatcaggtgtagacactgtgagtctcagaagtgggaaaaggggagtgctgtgcacaaaattgagagacggtgcctgtggcagcagctgaggagggaaagagaaggtggggtgggaggcccatcccttccttggccacaaggacactgagtagggtgctgagatgggagtaacagtaataataacaggcagcacttggaggctgcgtcccgtgtgtctggcactcgcctaagccctttgtgcacattggctgagttaatgcagaggtgaactgagaggcacctggggtaggggctgggggacaggaagcaggtgacatctccagtcctctccagcgtccttagagcaggtctacagtactgatccttctctgccacccttctccaagaccaccttggtgggagtaaggggctctaaggtgacaacacacacaggagccacagacacaagacacaagacacttttgactcccaggagaacctagtatgggcawccacacacccttcctgatggtgaytttttatgtagacatgcagagtgcagttaaccagctgttcctgcacacatctggattgctactcacacatctgtgcacacacacacacagcctcctggagcactgtggcttctgggtggctaacacagctaccacctctggttgtgctgagctgagcacccattgcctgctggggtggggagagggcaggcactttccctgcgcgaccccgtttaaccctctctgccccactgatgtggtccctgttgtccccgatgcacagaggaagaayctgtgtcaggacccccagagcggtgtctccactaagcagaagtctctgtttctctcctggcctctcccagaggggctgctctgaagcatgtggatttgatcaggataatcaaggtaaatgatccttatcttgatccatcacaaatgttaaggtacaaggctgtggagatggagagtgggtggagtctctgctgcccggtatcctaagctgggtgatcgcaagcagacacacacatgaccacctcttgggccatgcagggggaatgaatgtaatgaggccgatgttacagggttattgaaggctcaggggagaccaggccaaaaaaaaaaaaaaaaaaaaagctatgacctgagacctccctatagcagtgtttctcaaactctgattaacgttacttgaggagcttgttaaaaatacatactcctggccctgatcagataaatcagaatatttgacacagagtctttaagctccccctcgggattcaaatgcacacagatttttggtgctttgccgcctacagtacaagagagggcaggactgtcctgttcagtgcactgtgaccyggacgctcaggcccacggaactcccctactccccctgctccctgcggtgccacccacctagctttcrtgcctgagggtggtcctcagactcctcctagaacaggcccagaggctcttagctatgtaagtattcattcctccaatcactgcagagcactcaccaggtaacaagcacgcacacccaggcgagttccccatgctcgtccccacgttgatatctcagactctacaagtcttcagctgctgcctaggactctgtaagtccttgagcttgggacccctaccacacacaagcgctgggcgtgccccacaggcggggaagtgctggccatatacacccagtgaagtgggaattccagataatgagtaactttttagcaaagtacccatgccctttgaattgtgaggtgtttttgtttgctaaatctgacaattctacctgtagggaacagggatgattgagaagcagctgctccgatggccagaagccaacagccttccctgcagagatgcgggaagtcccagggacagcaggaaagtccaggcactgcactggcagtgggattggggcttgggtcagaagagggtcagggccacaaggaaggaccctgggaggcttcctgctacataatatgagggccgggagcataacaaaggattgccttatccatgattgcatcatcaaactgaagcctgagacagaacattctgtgaggtggccttgttcactgcagaggagctgactcacacagttttgtctgggaagttgcaacctgtgccaggagtagccagcctgggagtaacaaagaggcttttctactgcaggttttcctagagctcctctccctccctcccctggccaaaggtgagctctgcagggagggtccggctctaggggactttgctcctgggcatcctagctgcagagattggtggggcttgtccagaaaggggggtcttctggacctsgggatgatgcagttgggcctcagggtactgggaggccagtaggggtgcttcaaactggccagtaacctgaaggactcatattcttaaggatatcctggtggccacgtagaaaacagtcaggtggggtgagggtggaagtaagraccagctcagaggtcactgagggtgcagccagacaggctgggacccacgtgggcagcagaggtggrgagtagggatgtggagggggagacccagccccacgctgggggccctgaggggaggtggaggctgagccaggagaagaggcaccacccactcacttcctgcttgctgaatgactgtgaggagcaggagaaggagcaaaagagcaagtgaggaagtcaagggggttatttgggggcaatgctccatgtgagggtagctaaggacaggtgccaaggaggcccctgtgtcaaaatcccaggtcaaaatgttagttaccagagacctctgataaagacagagccacaggtaaaacgcagcggcacaacccctcgaccctaaaatcagaagcctatctgtgtcctggcraggagagaagcacgagtgatcatccacacygccaggacgcaagcccgttatttctgatgcaaaacccaggctccctccagggctggcacagaggactgccagaggagtcaggrggcctccaccttccccagctgcgcaacctcagagggtgtctccttatctctggggtcactgtgtcttcatggccaggctgggcacaggtcagctgggagtggagctgtgtttgcagggaaggaacgagggtggacgtcgaagccaacctgcctggttcagaatcctggctcagcttggcacttaccagcagtggtggtgaggccttgggaatgagctccgcctccctgtacttccgtttcctcatatctaaaattgagggagtaatgggacccgcctcagtgggtgttcatgtggattccatgtgctcttaagcataaagaacagagcagctatgatgaccatcatctatgtcactgggcctccggaagtgagggaaggagaggcagatttgcttaagtagaaggaaggcggaggaaggtagtaaggcgtcagccatgtggcacagattgtattatgagatttactggttttcttacttcgtcctcaaatttccctccttacccacttcccatgattcctgagagtcaagaggacgggagctgtggaatgtgttagtcatctactgctgcagagtaaatagcccatgattatctcacrgagytcctgagggtcaggaatccaggattgctgttggccagggcaatcccagaaggctcacttgtggggctgttggtagaaggtctcagttcctccctatgtgggctactcacagggctgctcaaatgtgacttrgagagagagagagagagagagagagagagagagagaggcttgtttgtttagtgtccaggaccgagagaggatatagagagaaagcacaaaagagagagagaaaaaaagagaaaggcagagagagagatagagacagagacacagacagttgttgaatgtccaggaccaagagagagacaaaagacagaaagcacaaaatagaggggaaaagagaaagacagagagagtaagggacagagagagggggacacagagagagaacccatggcagaagcagcagtcttttttttttgagacagagtctcactctgtcgcccaggctggagtgcagtggcgtgatctcggctcactgcaagctctgcctcccaggttcacaccattctcctgcctcagcctcccaagtagctgggactacaggcgcccgccaacacgcccagctaattttttgtatttttagtagagacggggtttcactgtgttagccaggatggtctcgatctcctgacctcgtgatctgcccgcctcggcctcccaaagtgctgagattacaggtctgagccaccacgcctggccagaagcatcagtctttttataacccaatctcggaaatgacaccccaccccttctgccttagaaagaagtcactaagtccagtccaatgtgagagaaagtaattaagctctatctcttcaaggaagtggtatcagacatttgtggacacatttgtaaaatgaccagagcgttagaacctcagaatccagcagactaattgccctcatagtagattattaatgttttaaaaaatggatggactagctgaaggaataaatgaacgagtgagtgagcaggatatttctgtctcatttcacatgcagaaaaggcactgaggctcagaggaattaggacatgtgtgaggttctctaggcagtaaggggtgggggctggcctggtttgccagaactcggagatgcagcatgcagcgtgcagcagttctgaaatggaagccagggatggcaagctacagcagccactccctcccggagggagaacggacccaacaccaaggaggaagggatgactcagcagccctcaaaacagagtcaggagttctccctgcttttgccaaaccctctrcaggcacctcttatccatacagggacgcagccaaaggcctagctgtgctgaaggaaatttgcaaatcctgcctcaaatctgcagccagtatctcccccagcagcctccaaaccaggccagcacgaacccagccagagagcagcataggtgttgggcaaaaacaggctattgactccatccttttctaacagagaccagagtcctctggccttccacagagaaggtggggccttctcagggttctctggatctgctggtgtcagtcagtatctatttcttcttcctaagaattcttttttttttttttgag

SEQ ID NO: 13283 - DNA, 14879 bp, Homo sapiens
agactatgagattgaagaagtctatacataaacaaagctggggttaaattcatttaaatgagttcgaagacacttgtccagtaagatgaaaacatatacagagtattatgaataccaccacattagatacaagattgaatattcatatgattaagtaacaggcgtctttagcatttgtttgaaggtgagggagaagtgtcctcacattggatagctagtcatctgagatgatttgcaaagccatctgtctctacactgccattcatctcagctttctctacatttcacagtacttaaagactatgccaatgattttggtacttaattatatcttgccctgaaatgtcatttgacagttttggttacccatgtgtaatatttttatctagaatgtatcagcacctagcacaatgctaaatatatatttggtactatatgaattcaatttccttagattatgaccaatgttgctttgacattattaggataccattgttttattcttacattggattaaaaaaatccaaacacctagcacctatttaccattttcactgtgggtttcaatggataaaaccagatatcaacttggatacatccaagaytagacagctccctgtgtaactatagatataagaaagaaaaataagcctcagtgtcttttgaatcttgctctcagttaaggttcaacataagccctgacatctttatttatttttgtttttatgtttaattttatatatgcatgtatgtatgttgagacaggttcttgctctgtcaccgaggctggagtgtggtgacatgatcactgatcactgcagcttcccaggctccagctatcctcccacctcagcctcctgagtagctgggaccacaggtgcatgccactatgcccggctaatttttgtgtttttggtagagatgaggttttgccatgtttcctgggctggtcttgaacccctgaactcaagcaatccatccgccttggcctcccaaaccaaagtgttggggttacaggtgtgagccactgtgcccagccagccctggcatctttttttttttttttttttttttttttgagatggagtttcgctctgtcgcccaggctggagtgcagtggcgtgatctcggctcactgcaagctccgcctcctgggttcamgccattctgctgcctcagcctcccgagtagttgggactacaggtgccygccaccacatccggctaattttttgtattttgtttgtttgtttgtttgtttgtagagacggggcttcattgtgttagccaggatggtctcgatctcctgacctcatgatctgcccaccttggcctcccaaagtgctgggattacaggcgtgagccatcgcacccggccccagccctggcatctttaagtagctttgctaacyattcctgtgtccttagtggtctttcaactgctgggaataaatagcctttactgtcagtgtgaatggttctgaaaactaactgcatgatagaaccacctacagagttcattaaaaacatagatgcctgttagcccaacgtggtggtgggcgcctatagttccagctcctagggaggctgaggcagaagaattgcttgaacctgggagcagaggttgcagtgagctgagattgcgccattgcactccagcctgggcaacagagtgagactccatctcaaaaaacaaaaaaacgaaaacaaaaaacaaaaaacgcagatgtctgagcacatccccaaaaataattaattaaatctttattgatgagacctggatatctgcattttaaaataaattctacaaaggatgctaaccagattttagaattgctggtatatgtcgcttctttataacttatatgttttggattaatgatgatctttttcgtcacgtgaagactatcttcacaattagactataagatttctctaggtaagagacagtatatttatatttcctgtggttactcgaatatgattttgcttaattaatatgtcttgcttttgtgaaacacatttaacttgtctactgatgatggatcaaattgtgaatattatttccttttttcatccgagaagctaggattaaattcctttaaatgaatttgaagaattttgtatttataaccagagtcatgggttgtattccaagtaaagctttttttattttttatttttttatgagataggatctcactatgttgcccacactggttttgaattcctgggcttcatatgatcctcccatctcaatctcctgagtagctgccagataaagtttttgaaaagtgttgttgaattgggaatcttttttctcttagaaaaatagaattaatttttttttaatagagatggggccttgctatgttttccagatgtttgccaggttggtcttgcactcctggcctcaagcaatcttcctaccttggcctcccaaagtgctaggattacaggtgtcagccaccgcacctggccattgtgcctggccaaaaaatataattttaaaaagaccagaaagacttttctttagaggtaaagatgaatgagcctatgttaaagtgtcattgaaagaaattattaatggtcagtcgtggtgactcacccctgtaattccagcactttgagaggcttargtagaaggatctcttgagcccaggagtttgagaccagcctgggcagcatagcgagaccctatctctacaaaaaataaataaataagatgaaaaagaagttatttattcttcgatcatgatggcaggcaatcaaagaatcttggaggcatactagttagagcttttaaccccacaggtcttcattgtccacatcggtgatgaccatttttttagtagacaaggcaagaacttaatgaagagaattactttacgtttcttgaatttactactgaagagttataggtagctaatagctaatattttcgtagctagtgttgggacacggaaaccaaccccccaaaatatggtgctttgatgggctgaactgtatagtatatctgatatatttatatagtgtataaaaaatcacctgacacaatagatggataatatatctgatatatttatatatcgtataagaaatcacctgacacaatagatrtgtaatatatctgatatatttatatattgtataaaaaatcacctgacacaatagatggataatatatctgatatatttatatattgtataaaaaatcacctgacacaatagatggataatgtatctgatatatttatatattgtataaaaaatcacctgacacaatagatggataatatatctgatatatttatatattgtataaagaatcacctgacacaatagatggataatatatctgatatgtttatatcagatatattatacatttatatattatacatatacatttatatatatacataataaatacattgtattatacatatatgtatatattatacatatacatttatatgtataatatagttgacatatttatatatttatatcggatatattgtacatttataatatatttattatattttatattatagtatattatcatttataatatattgttatatgttatatgatatatatttatagcagacatagtaaatatctattgtgttaggtgattttttatacaatatataaatatatcagatatattatacatttaaacagttaaacacctaaacagcccaattttatgtggatcagtactactaacggcttagggtaaaatgacagctacagcrtaactagaatgttaaagtggcatgtctcagacaacgtggatggacataaagtatttgagagaatattgcataatagaaaaaaacattgtaaagactaaaatactaaataagacctttttttcccgagcaataatttgcccaggctggtctcaaactcttggcctcaaatgatcctcctgccttggcctcctaaagcattgggattataggcatgaaccactgctcctggccagaattcttgattaaacaatagggtctaaataaatttaaaccccttttattctttttattcttacagggtagactcaaatattctatttctttccaactttatattcttgtcataacaacccagtattctctgaggcaaatggatgcttatgaccaactggcctgaaatgggggaatatagggttagtggtgagtcacatataagaaaatgcaagagaatagcagtgtatcatatttcaaaataaaatacaaactatacataaaactgaccccaacaagtatccatttcatttcctgtcgtgtatctatatgctttcctggaaagaataaacttcagttcacaaaatcagatgtagaagatacatcacttttaaaaattctacgtaattttaattccaagattcccatgccaccaggctggtgggaaatccagtttwagttgtaattaggccttttctccagtattacatatgaatttgagtgtaataccccaaaacttgagaaggccattgtatctccagtccactggggcaatgaatagcttgagcacctgatcattataatgacccagatgtgtatctttttcttttactctgcggtgagtttttctaagggaggaatcctattttgtttaattttgtattatagcatgggatattgtgcctggcagatagtaggcaatcagttagtatttcaggaataaacactcttggtcagtgatacagctaatgatttgcaacaagcatatccttaaagtaccttttcagtaacgatttccatatgaacaaagaaaaaaactagaaccaagaggtaaaattataatcctgttgtcttgttcccatagccatactctgatttcttttatgttctgtgccctggcttgatacttaatttgacagctaattataatgtttattaagctctgaaatatactttctcctggcctttttgtctgaagttgtttgaggtgtcaccatggttggaagttaagagcatggaagctagacttcttggtcttgaattctagctttgtcactaacttagtaactttgggcaaattacatgtctctgcttcaatttcatttgttaaggtagtacctatttcacaaggctgatggtggcagcagtggggcgtccagagctgccgctgccatcacgccagctgcagcagggaggggcgggcagcggcggcggagcagctgcgggagccgcagtggctgctgtgggacatctgtgcctcgcgtcccctgtgccttgagaccccaaagcagccgactgcgccgccaccatcctcgcgttgccgggtggggcgacgtgctccccggccaggagcctccaccgctccggaccctggccctatgtcgccgctctcgcccgccgccgccgcggagtgggagtggggaggaggggaacagtccttggagccggccccgggagtactcccggagcctgccgccctggaagccgccacgatggaccgggctgagtcgcccgccggaggggaagcagtgtagtcgggcacggaggggcaggcagagaggggccccaaggcggagctgggtccggggcggagcggtgttcgcacacaaagcgctggggctggacccagggttcggggccaaggcgagaagtgggagcggggcccgctttggggacccggacagcggtgtggccaccgcgcacacctccgacagcgccgcattcctgggccttgggaggaggctctgagtagggccgcctggggcgcgtcttcagggtcctcccggcactggggtgaccgccgagctagacgcgcctgagggctgagccccagggctcgtgatctgctcccggaggcgccccccaggcagggccgtgagccgggcgagggagagtcctgggctgcccctgagccccggggccacgggaagaacttgcagcgacgtcatccctgccccggacacagtcccgggcccagggaggacctggaacattcccttcctcccccscscccccgcccccgcccatcagcccagcctgcaaggaggcgccaccggacctgcacactcaggagcaggtgagccagggacaagcaggagccccgccccttccgaactggtggagcaggagctcccagggtgcagctgcagccaccttgccgcggctgtggacattttctgtgctctcagaggcccagcaaagtcccctgcccactgcaggctccagggtgcctactccggctgcctggcttcyctccactgttagcacccactctgaactcagagcaaggtcgggccgagcctgggtactgtcacagcctggccgagcgtgcacacgctcaggacagtgctgatacgccagccccctgccgtctcggccccctttggaacttgggcaccaacaagcgtgggagggaggctgagaggggtctgaagacagctggacactgacttkcaggcgctccttggcatgaacagcctgggagcaggaggcagacaggttcctgggtggaaggggatgggtccccagtgaagtcccaccctsaagctggtgagggcttgaagcctgcagaccagagaggtaacttgtggtgctgctccctgggcccactcatggctgcccatggaccaatcagcatgcatttcctccctctgaggctcataaaatcccccagactcagctagattggaagagaggatgggaagacaatggatgacctacctgtggagagaaactacccattccagaacctcctctctgctgaaagctgaacactcaatgggaagacctgtttgcagagaggagccagccactccagggtctcckttctgctagaagctgaacactcgttgggacacmcttgctgtggaaagracatccttactgtggaaatgagctactaactgcaggtctccttcctcttcatcttccttatccttctgttccattgctcagtaatgctcctcttcatctgkctcattctccacttgtctgcttgatgcaggagctgaggagctgcacagcaaggttaaaagagctgtaacacaaacagggctgcaacatgccccttgctccccacagggagagaagagctctggccctcggagaagcccagacctgggagctccttgagcccgggctgtgactccctctttgggkccctggttggcgtcactgcattcgccagtgccactgttggaagctgcttgtgatgcgcctggtccagggggaagctgtttgttgtgtgcctggtccagccacctcatggagagcctgtgctggcacctggagctgcccaacctgggcagcagcttgtgtgtgtgactgcacagtggccacgcttgctcacacacccctagcacacccctctgctccacccgtctcaatctcccttggatccgggatccaggttggtagcaagtgcgagtgggcagaagcagcccagtgggcccagagcaaaactcaggcaaaggtgccactagactggccaggaaagcgacaccctaaagatcccataatgctgatatgttaattctattctataagcaccacacagaagtgatagcttttatttcttattttgtctagcctggagacagagctaaggattccttgaactgcaaagtcttttccagttcttagtttatacaatccatactcaccttctgcctaactaagcattgtcatttttgtgccaaatgaagagtaggactcctacgattgtcctcagactctcttggctcaatcctcctgctttaacctttcctacttcaaaaactcctgaagttttgcttccccttctatagaatggaaatatatgtcgcaatacttactgcaaagaaaattatatattttaaaaatagactaaagagatgttgtgagacatcagacatcaatcagatgttgtgagaactgatttctgcatcagaatatctccttgactttacagctatcctttaatcctggctcaaagttccagaaraaagatgatccaatataatactcctatttggactttgagtcatacacattccttcttctgagaaaacgtgcttctgcatgaatcctcccttcattattttcagctcatctattattgaatctgaaaccccaggttaactgactgatcactctcatcagtggcagattttgktgtaacataggacacatcactcccaattcaggtcaagtcccaattatcttgcctctcaatatgacmtgttcaatgttgtatttcattctacttcattttaatgtaaaaagtcttttctggtgaagtcagtcttttattttctcataaaaattcaccctttgggtttttcatagggtattcccataaccaaacacactttrcactttcctagtacataacccaatactttcttctttccccacagtccttacatgaagcctactcagaccgacatcactgtatcatttttttgtattctgaagtccttcagcacttgattcctttaagtttaatcttggtattctattgggaatcatatggaaatgtacaatgatatttattgaatgaacaggaaacagggaaagacattgaccagaaaaagtgtttattcatcaagtctttaaagatacaaaaacacgtgtcttctgkggagctcwgaraacaggactccagcaaagcacttttcagccttgtggtcttcaagcatttccaagatctgtgacattggaaagaaaaaaaattaagacagatttgggtctccatgagcagagagtattctttsccttagttctgggtagcatagtgcccaaggaaacctaatcagtacagwgggaaaccaaatctattccaaatcattacccataagcaatcctatggactctctgaggtttgacagagtcagcggccctctccaataaatgtgtttttctataataatgtgcagtgtgagtaatttgatgtttttgacaaatatttacccagcgttttatgaaggagaaggtttgggggrcaagctgaaggagctctgactgccttttggaggagtgtgagtggcttacctttgctgcaaggagcattgtactcagcaattgcaaactcatctgaaaaaaaaaaaaccaacaaaaaaccagaaatcattacatgaagtgagaaagaaagcaaacatctgtgggatacaggccaaggaaggagtttgttgtgggaagaacagtattgtaccagaaacataagcatcattcatctgatgtgttgcttgctaccttatattctcctttcaaatatagtgttttatatattcttttatcccaaactcctgaaggactcttcagatgttctacttacttaaatctcatattgtcatacagtccatttatctgatgaaaagggaactaaatatcccacaggtgttttgtattagtagttgataaatttataatgtaggttgtttctataatgtatgtataagagacaaaaagaggrgcatcagacttgatggagacaaaatgaagtgataatgtaattacttaatgtaataaataaccccaacacatctcctaaacctgaatttctgtgatcaggaattaaatatttctacgtgaaaatcactctcactcacccgtctcgtagtaatcatagactttcactatggctggtttcagatctcttactgggacatcttgcagaaccgtgargaacaagctcagtgtctgatttgacacctggaaagcaaaagtcaattaaatgacctttcaggaagctttcttctctctttgaattagtttaagtattcacctgttttttgggggaaaagctttattatcctacagcacactatagggtccttaattaaattgtgcagaaatctctcagaggggatgataaattctccagattatttcttaaataactaacataaygcatatacctctgtcaatgccaatacatagctctgttcatgggggtaaatgatatatactttttattggaygactaactgtgttcattttttaatatccagagatttggtatagtttgacttctctgtcttgcaggaatacttgcgtagactcaaagaggdtctaaaaggttgatcttcccaggcttaagtttcataaaatttgtaaactataattcccatcaacttatgcatgaacaaactctcctaccacacatatctataaaatcagattggtttactggtgaactggtcttattattttatggttcaagtccttgtggagactgacagttttttttccctttcatattgttgttgagtatgttgataattaactaataattgactaatcacaagggctacttccttrtattactgggtatccaaaaaacttgtcaacataataaacacattttgtsaagatytcttgcttatgggattttaggaatattcatatcccaagatcataataagccatttctacctgtaatccctggtgaaatataaataaaggagagaagaacattcttttagagttaacattagaattctcaaatttctagcatggaagtgatgtttctaaaatgcatttaccttcccagatgttyccttagaggattattatctacgtttttttgcaaatagactggaagttctcttaccttatcaaggtaaatcaagacatggttgctgctgacttctgtccggctcacatggttagatctttcaagctgaagaaaattgaaataccacaaatgttaataaatagatgaaacccctgggggatccagagaaaaaatctttgtattgccaaaataaccctgagggtagaattcttcaaatgctttttgtaaggaaatatataatgtaatacaattaaaaatgaaaggcataaagggtttactattagtataacacacgactaatgtgtaaagttatttatctgaagaaaagacagctaagtatcctaaacttggtagttactcatatttcaaagttcaattcagtttctatttcttcataaggagtttttttcctgttttgcttgctctatttttcttttaacttctgtaatacttatagtttatgccaatcagtcattttcatatttttcactggttcgtgttcatatcttttatcttcttagcaaaattctaagctaagaagaaattgaaaagcaggaacctgctgacaatctttttcttgtagtcatgggtcctagcrcagtgctctgcacatggtcagcattcatacaaacacatgtgattrtatttctgagctggaaaaaggataaggctttgatagagattgactttaatagtattttgatattagtattgtcttatgctggggatacatacatcattaaataaaatagggcagtctggggttatgataaacctaccattttcactgttggcttcaggggaatgaagccagagaccatcttcacatcaacgatcgccatgttggaggcagagcggctccctgtgtaactgaggatccaggggaggaaaggattagggttttctgtgtttttaaatattttcttcttctatgtccatgttaagcattccacagctctaaaaggtacacgtaagtcttcccaaatatcttatcccagtggtttgtaaaagtggtgtgcgtagaatttttaggaagcctgttaaagccacagagaccaggccctactctagacctgatgaatcagaatgtctagtgtatgggggctgaggatctgcattttttttttttgatggagtttttcrctcttcttgcccaggctggagtgcaatggcatgatttcggctcaccgcaacctccgcctcctgggttcaagtgattctcctgcctcagcctcccgagtagctgggattacaggcatgcaccaccacktccgactaattttgtatttttagtacagacggggtttctccatgttggtcaggctggtctygaactcccgacctaaggtaatctgcccgccttggcctcccaaagtgctgagattacaggcrtgagccaccacgcccggctgaggatctgcattttaagaaagctctacaagtgatgcacaggctgtttgtgacctctaatctatgccagttattttatttatttgtttacttttattttctttcagctgacaaaatgatgtatattatgaataataaatttcagtctacattatttacaaaaacaacaataatttataatgtttacttaaacactggctttcaacaaaacacttagaaacacctagcgtcttgtcccyyagagtttgcatccgaaatttggactgcttaatttattttttggcatatatatacaccaaattaaatgaaaaaaawatatatatatatacttaacttttaggttcaggcgtacacatgcaggtttgttatataggtaaactcgtgtcatgggggtttggtgtacagattactttatcacttgggtactaaattttgcactgaattgttgtttttttctgatcttctccctcctcccatccttaaccctcaagtaggctctggtgtctgttgttctcctttttgtgtccatatgttctcatcatttagctcccacttacaaatgagaacatgcagtgtttggttttccattcctgtgctagtttgccaaggataatgacctccatctccatccatgttcctgcaaaggtcatgatctcattctttttgatgtgtgccagttatttgttacatgtattttgtcctaacttttttcctgaatagtatctccaaccaagtaataatatgtttgtggagagagagttttttatcagatctgcagctatttaaatattgatgcatataagtgtatcttccccccaaattaattatatcatatataacctgagatttattattgccagtaggaattctaactaaggagtcactacttccttctattcaaacttttcaataattcttcatctctatcttcaataaagcaagaataatataggatttcattacataacaaggaattcaggtcagaggcaatgggtaatatttacttagttgttattgagggaaattattaccctttaaacaatgaggttgcacaatagtagatcctggatggacaatgtaaaccccatcattgagaaattatatcaacttaagagaatacattgcattttttgtgaatagtgcaaatatctactgttgcactgctttacttaaagaggagttcccgaaagaagactggtggttattcttaggattaggtgatagagtcagaaggtcttacctgacacttagggagatttggaagctggtgtgggctttgggttcatcacaagtttgaggcagagtctgcactcctaaagcaaaggggaactcttccttttctgggagaatattgtatttcaaggatgtctatagaacatcaaagacaaaatcagttttttgccctttcccagaattcctgtccaygtccctaaccctttctctgatctgtcccattgttttctgagttaggacttctcagagagaacagctgctgtcctcatctgtcctgtcctcacctgcccaagagtctcacctggaggtagacacatccttctcctgtcacyttcatgctgtattccccaggcagctctggcaatgagacctgctgcagtaacaggcggttgttgttgtccacttggaatttgctggaaaatgtccctgaagactggatagtcacctgtgcagccttcccagtcctggtaaatgtggctgctccatatttggacagagcatggagagccaccactgtgtcctgttagagacagatgagtgagagaacccattgggcattataaggctttgagggctgagatatttttcaaagacccatgtgagggactttgatttcctacttccctcactacttaaatataggagctgtaatttcaagattgattataatctttagatagttgaagaaccataacattcacatatctaccttggactgtatgccctacatgtttattttatttatcagaaaattgatccttttctctctgtaagtatatgtgggacatggaatgtggaaaacatgtgaatggcaatcagttattggcatcagctatttgctaacatgtctttcttgacaactatgctcatatctgccaccactcaagcaaagttcagtctggctctctcccatattaaactttgctcagttgctgaggtcagtgtcctggagagaacccaaggttctttgcagcmatgagcagagtcatgcttcagtttctccaaaagaaataaaagatgagtattataattatcttctggatttaatgacatttttatttggctttccctttttattggatgatttcctgttcccagtgaatgtctgctggtatgtatcctcaacaacattaaacctgcttggcctccttcaaataatatgtttctaataaatgaatgataacctttaacaaaattacttagtttttttcattcatatgataaaagattaatacaatggaaataggatggaatgccattttgtcacattttttccrttttagggtatataagcaaacatccraattctctgaagataaaactttctgctgtgtacatatcaatgaattgttcagatacatggttatatagctagatttaggaggttggatgaataaagacagttctttatgctcctgatgaataaatgtttgtgtattaagaggtgaatagggggctggacgcagtggctcacacctataatcctagcactttgtgaggccaaggcggatggattgcctgagctcaggacttcgagatcagcctgggcaacatggcaaaacctcgtctctactaaaaatacaaaaattagccaggcatgattgcacatgactgtaatcctagatacttgggaggctgaggcactagaatcgcttgaacctgggagatggaggttgcagtgagccgagattgcaccactgcatt

SEQ ID NO: 13284 - DNA, 13432 bp, Homo sapiens
ccgtgattgtgccactgccctcaaacctgggcaacagcgtgaaactccatctcaaacaaaacaaaacaaggaacttatcatcttttttgaactttctacagaatgcataatataatgaagttaagatgccttgttgggttcttattaaaagatattatttacattttaatccaagtcttgtgtttatgtatttactttcagttcctggaaactctttagaataaagaattacaagtttccccccaaatatgtggatacttttaatggaaatcaattattactagtgttcttttaatgaaggtgagaacattttatgaactgatttttcaggtgagtaaatagtaatttaaggaggtgaaataatgtgatgataaggaggacacctggggatgaagcccacagtattgttcttacaggttctaaccacctaagttccatgcctcattcattattcattctgggataatgatactacacttcataaataaacatgacactattgtacatagcatttgcttttcattattggcccagtggtatcactgatctaattatattttgtcatagattccccaccaaaacaaaatatatttccaagttagttagctgatgcttggggtgcagctggtgaatcagaacagaaagacccatccagccaaattcactcatctttttcatgtccagaaaagcctgaagggaaatgccaaggtgtcaatgtaagcacatgcaatcataaattaaagctttgttatattcaaataaagtaatacaacatttattacttgcttgggaaacagcttgggaagcagccacattgaaatttcttgtagccatgaaaataatacaagttgcttgtggataacaaaattcacacagaaaccatttctgagatatcttatatttgatgtatttatgcattcatttaagtcacatattacctctttttaatggaattccaagtacttcataaatctcctgtatagaggaaaatgcttaattaattggggatgagggcaggaagtgcattaaatatcactgaggaaagcagtatcgtgaagtatttgcccctggggaaatctcaattaattcttaaacatgaacaggacatgatgtcttccattttcacatagtaagagcaaccattcaaaaccacagaggcaagaaaacttagaacctgccagatttgagctgagaattgctccgttactaagcagtagtctccctgttcaccaggtcattgctgaaggtgggtacgtggttattgcagcagagtactctggaaaatatttgctaaatttgcctttgtctcaatccctcataggtctgtgacctcaaggttgcatgtctacataagctgttgcaatactgcactaaagtatctcctttcaacaaacaaagggtgaagctaggagaaggacagagaggtatttattaaaattcttgcaatttctctgtagagtataaactgttcaaaataaaaagtttggggcagaaataaatataattgaatcaaaaaacaaacaaaaagatgtattgcctgttcatcacatcttggctgggagaagaaaagaaagtgtctgatggtgaatatccgtaccagttaagattatttgcataagtatatgactcccagtgtaattacttacaaattaaaatatttrtatagaggaaaataccatgtttctgattgctatcctacatattatgaaatgagtaattcatataaaagatgactttgctaatggaaaattgaggaaagggccaggcgcagtggctcatgcttacaatcccagcactttgggaggtcagggagggcagatcgctttagtccaggagtctgagaccagcttgggcaacatggcgaaacccagtctctacaaaaaatacaaaaaaattagttaggtatggtggtgcatgcctgtggtcccagctatttgggaggctgaggtgggagaatcacctgagcccaggaagcagaagttgcagtgaaccaagatcacgccactgtactccagcctggggaacagagcgagaccttgtctcaaaaaaaagagaagagaagaaaaaacaagaaaaaaaagaaaattgagcaaaggacgtggataggcaattcacagaagatagtaaaatagtcattaaacatttttaaatctcttacttgtactactaattcaagatattaaaattaaagtaattactaatattttaatcataatattagtgatggagaagcaaaataaaaattaaatatgttattctgtgcatcaaaggtaaattggtacaatctttctggagagttacttggctatatatatatatatatwttttttttaagtttaaaatgccaaaaacattttttttgaggcaggttctcactctgtcatctaggctgtagtgcagtagcagtagcacagtcagggctcactgcagcctgggccaagtaatcctcccacctcagccttccaaagtgctaggattacaggcatgaggtactgcgctgagcccaaaaccttttatttcctccagatattctgcttcaagtaatttatcctagaaataaataaataaatattataaatatacatttataatgtgtaaaccatgttataaaataaatattttaaaatataaaataaatttatattataaataatgtatacaatatattatataatatatatgcacaaaaggtttatggagaaggatgttaatgtcagtactctctttaatagaaaaaggttggaaaaaacctaaatgtgaaatgagaggagacgtttaaataaattcccataatggaatatcatatggccattaaaaagcaaattacagaaaatgatactatagaagaatgttaaataatatggaaaactttttgtgactcagtgtgaaaaattcaggcactaaaacatgtacagggtaagacaaaaaacataaatgaaggtattagctattccactgcttgtgttgaaattataaatgggtctaatcatttctatatttcccaaaatgtctgcaaagaatacgggctactttcattatttaataccacaactaatgttgttaaaataaatgtcagttggccaagcatggtggctcacacctgtaatcccagcactttgggaggcctaggcaggtggatcacctggggttgggaatttgggaccagcctgaccaacatggagaaaccccgtctctactaaaaatgtgaaattatccaggcatggtggtgcatgcttgtaatcccagctactcgggaggctgaggcaggaaaattgcttgaacccaggagacggaggttgctgtgagccatgattgcgagtgccattgtactccagcctgggcaacaagagcagaactccatcttaaaaaaaaaaaaaaaaaatcagtgattccactttccatgtgtctgcattactatgtaccaattcattgctatttggtgcagagctgcacaccacaagaagttcaagcaagagcatcagatcacatgcaatagtgaggggggaggatggaattcaaaaactgaaatgtcagctctatgtacacatgagaggtagcatctgtaattcttttctacactgcaagagaatttgaagtccaatccaaagaatcaccagagactagcggaagtatagtggaaatagtgattctagcatttggagagatgttaaacccaagtctggtcttaaacataggcagtggtcaccatgaagttattcaaggtaactttaaggatgactatttgctcaaaatattgcctcatggtcaccatttgagtgaaaaggatagtaggtaagaaatatcaagggagtctcaggtaaatacaaatgtagcctctatcagtaactctgaaatccaaccagtgatcagtcactctcagggacatttattttaaaatggagactcaggctctttgcccttagagtctctgatgtaataaacctaggttagtaccaagaaatctgcatttttttttttgacttggagtctcagtcttatgcccaggctggagtgcagtggcgtgatctcagctcactgtaacctctgcctccygggttcaagtgattctcctgcctcagcctcccgagtagctgggattacaggtgcacaccaccacacccagctaatttttgtatttttagtagagacactgtttcgatttcaccatgttgtccaggatggtctcaatttcctgacctcatgattcaccccccytcggcctcccaaagtgctgggattacaagcgtcagtaagtttaaatgatcagcatacaggatattatgtgtgtaatgcttaaacagaaatgtgagctgagctactgcagctggtgatgtgtcatgtcacccatatttttgccccatggtgggaatctgtagtcagtttaaaaacaatccctgagttagctgtttctcttggttcataaataaagaggaactagargcttatgtcccaagtgcatacatccattatagtttgttgcagactttcagtcctaattgtataattatatatacatatatataattatatatgtatatatatatataaaaataaaatagttctcataccacagtgtgggattaaaaactttcaactaatctttctattatcatcttaaaatcatgagttatacaatcttgttgttactgttttatatattctaaataggggaagctaccttttttattatattcaaaattgtgcatgggcaaaatcagacacataacatttcttaccaaatgacaccttaagaaagtgcatttcttttttcgttactgtattttcgtttgtttttacaagttttatagtagagmcagggtctcactatgttgccaagctggcctctaactcctggtctgaagcaatcttcccacctcatcccagcaaagtgctgggtttgcagatgggagccactgtgcccagccaagaaagtgcatttctttctagatagacttacatattacctgggagtggtctctgtgttttttctatttgtacattaactaagaattgaccatcagattatctactttagtggtttttcttctatggcattacttcaagctctagggattcatttgatcctctgtgaacaygtaaggagtgagcaaaggtctgatgactgcagtcttcccaacccgcatttttcattcagtgaacttttgcgactctcagtattgccccaaaagttccatattcaagaactttgcatgttgagtttctgtttgtggctttattggaaaatgggttctacatttaaaaagaggatgttcgagactttgaaaatcactggatttagccatccagcattcacaaatgcatgaaaattagccattctgacaggctgatgtttctggaatcaaagctggataagcctcaggcattcattgtcaaaaagtaataaaatttgcccaaaggttttagaaagtcttctctgggcggtgacagttaaagtgaggtttaaaaacaaatagcagtttgtcagatggtgttgggaggaagacattgctgcaatgagggcatcatataaaaggacctgaacattgtgaataatgttgcaatgaccacagatgcacaaatattgcttccagatcctgatatcagttcttttggatatatgcctaaaagtgagattgctggatcatatgataatcagaattttttaaaaaattttttaggggcctccacatttcttcccatggtagctgcaccgttttacatccccacaacagtgcgaaaggatactgtgtgatttcacttatatgaggtatctgaaacagtcaaagtggaaaatagaatggtagttgccaggggatgggaggtagggggaaatggagataaaatttcatttttagtagatgaatatgttctagagatctactgtacaacataatgcctaaaattaataatacagtattgtgcacttaaaaatttgttgataatatttcatattaaatgttcttaccatgaaaaactaaaataaatgaacacaaggaaacttttggaggtgatggatatatttaatatcttgactgtgccagtgatatcatgggtgtatgcatatttccaaaatcatgaaatcgtatatgttaaacactttgtatgacagatgcatccgacagcattaactcaagcataccctgagaatgactgtatggtctaagaagaatatgtgttcagagtctaagctaaggaatccgggaatggccaacccagagagattcacttcttatctgtgaaggacacttgaactccctgcctgtccgttggaactcaggatgtgcaaggaaccaaggccttttatttkgggttaaatggaggttgctaagtggagagtgctaagtagaaatgttatataaactacatactctttacaaatagtagcggtcctgtccagcccactgmcactggaccacatctgtatttaagtcctaaataaaccctatgtcccattcactggctctgggtctcttcttggacaaggcgccatccctgttggaatcaatagggctccagcatgacacatgtgcaggatttttwaaattatatcaattatatctcaataaagctgttgaaatttttaaagggcctgacctgtcctggaatrgggaaaaacttaatgtgacaaaaatgtaggttrtagtgaagggaacaggaaatggtactgggaccatttttactccagctaaaaaatttgaatttaagaaatttggatatagataggaaggagctaatgttaagcaggaagtaagttgataagagttttctgttaaatgtgatggcaaagyggtaggtgagtatgggctccagtgggacagaacttgtggcagagaaaccaggtcaaaagttaaagttggatttggtgagtaattaaagagagtagtagcatttccaagacagaaattaatgagctttgcttacatgaaaagattaagaggataagcttaagaacaataagtaccataaaaatgggtggcaatgatgatacattaggggtggaggacctagggtcataaggttgcccgtggcgacttggagtgaagtgttgagatgatatgcccatttcatggggagaagtagaaagaasagaaaaaccacttttactttagttctggtgtaactatgaagaaaaaaaagcctaattgaggacaagaatagacctcgtttctatgggcaacaggcatattctgctccctatttcattatttcgcttaaaaaacacttggtgaagacttgatscagattgtcctcttggaatctctgatcctgatgtttatttaagtggcagagtggtggcttttccatggtatatagtcagattcttttttttttttttttgaggtggagtctcacgctgttgcccaggctggagtgcagtgttgagatcttggctcaatgcaatctccacctcacaggtagctgggactacaggcacctgccaccacgcctggctaatttttgtatttttagtagagatggggtttcaccatattggtcaggctggtcttgaactcctgaccttgtgaccgcccgcctcrgcctcccaaagtgttgggattatagtcgtgagccaccgtgcccgtcctagagtcagattttaaatcttcaaatattcaagaccggtttattagctatttgaggttgtgaacgcttctccttccttacaagtgcaaagcctaactcattgaatgtgtggattacaaaacaagraaayattaacttattgcaacagagkctggtttaattaataaatctttttggaagttttctttgacagatcctayataaataaatatagttttaaaagtggacttttaaacatcagtttttcctttccgtcatggttttcctacgacaaggataaaagacccctcttccttatttgaaaattctcgcaatcaactagaactgaaattatgaacaccaactctgtcaaaactatacttttgttacttcttggtgagcaagagaaatgaagaaaacaaaagaaaatcatgtgctattttaatgtaatttatcctatacttttttcaaaaagtcacactcacgtctgcttgagagttttagaggaatataatgtatgaaagaaaattccaataacataatgtacaaaaatgttgtcacatacagaagagcaaaaatctacgtattggggactwttgctgtgggaagaagggcctgatcttcatactcatcttcytcattgagtaccatgaccccttcyaattcatcymtactacaccatcatctgtgccatgctttgccatgtcccaggtgtactgtccaccccagtagtatctgcygtttggattggctgcatgacatctattataccaccatccaycaccgtcttctttagaacactgttttctgggatctgatgttaacctgaaagaaaatgtgtttggcgttattagaaacagaactacggtggtcaagttacgttttgcagattacccataaaagactgctacactcgtgtgcacagtagtctttcctttgggtgctatacatagagtcacactaatacaccaaagacctcctgtgccctatagcaagaaagagagataactgggcctttgtggccaatccatctagggactgtgtttgttactttatactggaataatagcttttacaacccttagtatcagagaaccctggaaatgaaaatgaaagttttcacacacactttagaatatagagatataggtatttatctaaatgctcattattcagaaagtaactgygctcaaattctagttttatctctgggtagttgtgtgacattggacaaatcaygtaatctctctaaatctcatctgtaaaatgagaataagaatgtctaccttatagttgaaatgctttcgagtgatgcataaagagcttaggacagtggctgacagtaagtgcccaggaagtggtagctattaaaaatattgttaatgattctgagtaatgatattagtgtgatttttaaagcaggagcaaagagtgccacacataccagccgtcattgtctctgtcatacgtgctgaagaacatgccgttgtgaatggtcrtggtcctgttttctcccatcagctgagatgctccatccatgmgggcattaccggctgttcctctrtatttgttcacygagatctggtatttgttggyttcattctgtacagtgaatcctccatagtgagcctttactttgtctcctttccagtmctccatttctatcaaaagttctgtgggtcccatcctggtaagctggctaattttatcatttccaagccaatattcacctaaaagaaaaacaaaataaaatctcaccaaaaataaaattttgggaaactaaaaactgcctttcttcccttatctttagcttccacatttttgtcaggaaactcctcttaactgcctaaaacaggcttccaacaatgaatgttttttaattaaaaaaaatcccatttcaaatagaatgattttattttgcatgcctgttcgttacctggtaggccacagtaattcttcccatctgtgttggttgcaacatttccaaatccctgtttatatggatcccatttcctgccaaagtcaacactaccgtcttgayggttctgaatmactgtccatcctttggttgacagaaacaaaaagagcatatattaaccaacagcaaataatgtcactttgaaaataatatctgaatcccctgtccattccatttagtatatatttggtgctctaaaatagacacaataaggaaataaatatgagaggtaaacttgtaaaatctttggaaactgcaagtgctttatcttaccccaaattgtgaattatagatattttataactttwtaaatatcaggttgaattccacatcaaattactctttgtcagctatgttagatgttagagctaagtcttgtttcctggctttttaattaatttttytttttgagacaggatctcactatcctctgttgcccaggctacagttcagtagcatgatcaagactccaggttgtgggctcaggtgatctcccatctcagcctcctggatagctgggactacaggcacatactaccaacacagctgattttttttttttttggtattttttttttttttgtagagttagggtctcattatgttgcccaggctagtttcaaactcctaggctcaagctatcagcccactttggcctcccaaggtgctggaattacaggtatgagccaccacacctggccttgtttcctggcattttacggtatccaaataattacagatcaacaggtcaacaactgtcgaaagcttacctccattttctgtattcatgtcacagtatactctatacrgtttgacagaactgtcaggttgaatgagatacatttcagatgtttcacctcctttcctgataatttcctcacattctgcaaatgtaagacaacattatgttcaggggtttatgacataattactttgtatttagtcaccaattctttaaaataacattacataagttactaaggagtgtgttattatagacctttgaaaataatataacaaatattagattttcattttamtttagtaagtccaacccagttttgaggacgtttatctgctaagaggatgaacaaagctcttctccaccttttgtgtcctggaatatccatgagctcccagaacacacaaaatggagaaacttctacatctatctgtggttctgccatctgttcaagccagtaygcagatgcacacatcagccacccctgggactacctgtgccccatccwgctcatcaaaaccagcaaatgcaccaggccagtccaaaacacaactggctaaggatatttttatgatgtacygtaatgtcaytatgatctgttgggaaaatccacttagcatttttgttgttgttgttgttctcttatttttggtgtgtgagttcttctggaactctctaaaaatatgtttatgaatcagttacctttgccagacaccacaggaatattgcaactgacagtgcatggggtgcgacaatattccatttgagctgagacatcagattctaacttttgtattttgcttctcaggttttcyaggattgaacgaagcacacraaggttagttgsgataytrctattcacagtctcatctatatataattggtgcttttccagttctgaggagtactcatkgactacattttcattatctggaaaaatgaaattatgtagaaatagttagcatttttgcctcataaaactaatgtatttaactatacaattttgattttctgagaataaactattaaacactgagctatcaccaagcagttatgatatatagtcatatttagtggaaatgatttggcgcatgacatatacaaattaacataaatcctaaccaccatactagtaatttaccataggtatacgctaaagattgtgtccagtaataaatgaaataggttgtttatttctttggtgagggaaaagaggagaaagcagtattggggtcttccatctgagaagttcaatcttacagagtggatatgcttgatttatttatccatttcacataagtatagcagaaccttgaaatttataagatgtcatgattcctttgatttctttgaaaaatttccaactgtgggtatgctactcactgagatgcctgtgccaggctcacgcactagctgtttcctgaccaccaagtcaacagcactcaacattctgacctcaagattcacaggttaggtgtcattatccacaacacaattgaatatattatggataactctctcattcaaaacctcaaatgttaaaactataaatgctaggggtttttttccactctgtaaatattatcttctgagtcacaagttwcttgtatacttaaaataaggagtcatagtagaatttttcatagaaaatcacacttgctgatgtcagactgggaataagagctgaatartgcttatctggcaagttgcaggggaaggtgcccaaaagcgtatgaatgctattcactaacccagaaatgttaatcttctcacaaccatgcattctcrtggcagtctaacggttccaattttatagctgaaaatcgaatggaaagcacaaggatatctaccttttacttgcttctgcctcttttgccacaggtctttcagcaaatacatgtactgaaaggaagaagaggaggtctgggaaacagcttccacattgttatttaactcatcaacactatttctgattggcctttcctgttgtagcaaagcctcttgcaactgacatcctgtaggrcacaacaccccctaaaaacaaagaaaatagcaggcattagatgaaggatttgggtcatggacatttgttaaaatagcacataggaaaattcagcgatacgattagccaacataaaaatttattatttgrttttctgtaagaccagaaattcgaaagtcatcatcatactctcatagagatttaaaatattacttaccccagaaaaaatataattgggctatgaaaattttaccaactaaacaaaggcagtggcaaaatacaaatggaaaggtggcacccacatatcctaatttgaaatttkgggcccagaccaaagaaaacaagaaagaaagcctaaaccaaaggcccaatatgtttatgttttgaattttatttccaaaataaacaaacaaaataacagtgatggtaatgtgggtcagtgaaacattagsagactgccatgactacaggctttctctgcatgagagagccaccactgcaagaaacatcagtgcacccaccaggtctgrgtcagyrtgaagacagcctccagcatcaggggcttttctttctactttcttttgagtggcagctgctttggctggacragcccgatagccacctccactgatgggcggtggggcaggcctcaggctgggagcctcttctctcttcttgtcaaggggycgatgacmacrggcactgaagaaaccctacaaggaatgaggcagaaatataatacagagtgttatagaagatttggaatgtaactattccaacaccctcattttataatttaggttatcacaagcttgataatttgcttaagatccatcaactggctggttggtgatagtgaatctgtaggttgcttactgttcagtaacagyagaaagaccaactgcacaaaaaagctatgatgcagtgtagtttttaaagagaggycttaggataaagctgtatcagattatgaatagtaatgacctcatattcctaaaacatacattggaacttacgaaattgtaargaatctatactgtcaagaagaatgaatattctcaagccacttggattgttagattcctatgattattgttaatcatttccctactttcatttttgtgaattggtgattagactcctatat

SEQ ID NO: 13285 - DNA, 28933 bp, Homo sapiens
cttcagggtcttttctctgaaaatgacaggctagcaaggagacctgggtcccctgcctcttccattccagatgccttgagtccacccaaataggggatgtgatgtttggagctgcagcagccgccctacggttgggagtcagagaagagccggtgttccagggacaatgcagcagaggctgagcccaggcctgctgtcctgagaggtggctggatcactgacactttggcagtggtgctggggtttatgtcatgacctgcagctgagcctacttccaatgamcgtgagatctgaaagactgttttgagggcgtagcctctgccatgattgtggggaatgctgtcctgtttcctcccttggccctgctcagcccagcgagaggctgaggcrcacgtggctccccgggtgcccacaggcagcgtggctcaccagccgggcccttttccactgagccagaaccccccaaagccttcaatgcaggcaccacggtgagcccacgagaaaccctgcttgccacctcccacacccccacccccaagttcaaaggaaatggtccctgaaccaagggctgagatcagctgtgggtccagctgtcctggggagctgtactggagcccaccacggtgggactgttggtccggcggtgacccccacctccatgtctgtggccgcagctggacaggccactccctgggccacagagatgttttacctctcgcagccctcgggcacacattgagcagatgtgtgtgtgtgtgcgtgtgtgggtgggtgcgcatttgtgtgtgcctgtgtgtgtgcgcatgtggtgtgggtgcacgtgtgtgcacgtgtgtgggtaaacattgtgtgtgcgcatacgtgtgtgggtaaacatttgtatgtgcacgcgtgtgtgggtaaacgtgtgtgygcacgtatgtatgtgtgtacatttgtatgtgtgtacatttgtatgcatgtgtgcctgtgtgtgtgtgcctgtgtgtgtgggtgcacatttgtgtgtgtgtgtgtgcctgtgtgtgtgtgtgcacgtatgtatgtgtgcacacttgtatgcatgtgtgcctgtgtgtgtgggtgcacatttgtgtgtgtgtgcctgtgtgtgtgggtgcacatttgtgtgtgtgggtgcacatttgtgtgtgtgtgcgcctgtgtgggtgcacatttgtgtgtgtgtgtgcctgtgtgtgtgcctgtgtgtgtgggtgcctgtgtgtgtggggcacatttgtgtgtgtgtgtgcctgtgtgtgggtgcacatttgtgtgtgtgcctctgtgtgtgtgcctgtgtgtgggggtgcacatttgtgtgtgcgcctgtgtgtgggggtgcacatttgtgtgtgcgcctgtgtgtgtgggtgcacatttgtgtgtgtgtgcgcctgtgtgtgtgggtgcctgtgtgtgtgtggggcacatttgtgtgtgtgtgtgtgcctgtgtgtgggtgcacatttgtgtgtgtgcctgtgtgtgtgtgcctgtgtgtgggggtgcacatttgtgtgtgtgtgtgcctgtgtgtgggggtgcacatttgtgtgtgtgtgtgcctgtgtgtgtgggtgcacatttgtgtgtgtgtgtgcctgtgtgtgtgggtgcacatttgtgtgtgtgtgcctgtgtgtgtgggtgcacatttgtgtgtgtgtgtgcctgtgtgtgtgggtgcacatttgtgtgtgtgcctgtgtgtgggtgcacatttgtgtgtgtgtgcctgtgtgtgtgtgcctgtgtgtgtgggtgcacatttgtgtgtgtgtgtgcctgtgtgtgtgggtgcacatttgtgtgtgtgtgtgtgcctgtgtgtgtgttgcaggccctggatgccagccacagagataaacgcaggaagacgtctgtcttcattctcctcgtgggtcgctggtccagaaacacctggatggaaagtgctctgcaggaacggtgcctctgcctgtggcggggaccctggtgagcggatgggccagccccacgtgtcttccggccactcagcatgcagtgtttccaggggcactaagagaccaaaatcgagatatgattagctgtaggatgtcatctaatcacagatcatcccgaggctaatttatctcccccatgaccataacacatcaaaaagttgactttttgcagctcggctgtgcctcatcttcccacgaagccccgacaggcacatccagtgaggaaccacagtgggagtcctgtggcagggtcaccccacttccgatgccctccagctgcatcttggcacgaaaaaggctgcccagttctcatgccctttcaagtcccgggctggggggtagcagtggaggctggggttaaccgccgtccgtctcaaaggcctcattgtggagctgcaaacacgaacgtccttgaaatgtgaggggacagtgctctggggcaggggctgctcactggttcatggccagaggtgagcgggctctgggtctgggtctgtraggtgctgtggacgtcgggggtgctcctggggcagggacacagccacggccctcacaccagtggagccgtcttccttcccgaggcagaggcttggccttctcacaccttgggacccttctctcccctgtgctcatgctggaagcacagcgtgagggggcaaaggtcatgggaggcaaaaggctgggctgaggccgaggctctgtggctgtggccggayaccaggtcctgtggtggtgtgggcagggcgcgctctctcctctgagcagcctggggctgcgtgtgtgaacagaaacaggcctgccratttgaagatggtttgaccaagtctcccaaagctgaagagaggtccctgcccatgtcccccgggtggcaatccacagacgcacctgtgtccatcagacggtatcgttgatagggagtctgaagccacccagacgtggtctgttcacgccgtggacaccacggtctgaggcagacggttacagccaccggcataggcgaatctcagccagagagagtgaactgggacaccattcacgtgatgggccagatgggctggcagcggctcgctggagccgtccgggtgggaacgctgtgtctgttggtctggtgctgcttatgtggctggttcaggtctgtcatccgtcaacctgcatatttatcactggtgcattttcatgtatgttgtacctcaattaaaacattttaggsccgggcgcggtggctcacgcctgtaatcccagcactgtgggaggcggaggcgggaggatcatgaggtcaggagatcaagaccgtcctggccaacatggtgaaaccccatctctactaaaaaaaatacaaaaatttgccgggtgtggcggcacgygcctgtagttccagctactcaggaggctgaggtatgagaattacttgaacccagtaggcagaggctaccgtgagccaagatcatgccactgcactccagcctgggtgacagtgagacttcgtctcaaaaaaaaaaaaaaaaaattaaagcagatggggtgtgggggctcatccctgtaatctcagcattttgggaggctgaggcggaccgatcacctgaggtcaggagttcaagaccagcctggtcaacatggtgaaacctcatctctacaaaaaatacaaaaaatagccaggtgtggtagtgggtgccgtagtcccagctagttgggaggctgaggcataagtattgcttgaayccagaaggtggaggttgcagtgagccaagaatgcaccactacactccagcctgcgcgacagagtgaaactgtctcaaaataaataaatacataaaattatatrtatatatatatatatatatatttttttttttttgagactgtatytctgtttcccaggctggagtgcagtggtgtgatctcggctcactgcaacctccgcctcctgggttcaagcaattctgcctcagcctcccaagtagctgggattataggcgtgygccaccacgcctggctratttttgtatttttagtagagatggagtttcaccatattacccaagctggtcttgaactcctgacctcatgatccgcctgcctcagcctcccaaagtgctgagattataggggtgagccactgtgcccggcaataataatwtttttttttttgagacagagttttgctcttgttgcccaggctggagtgcaatggtgcaatctcggctcacggcaacctccgcctctcatgttcaagctattatcctgactcagctgggattacaggcacccaccaccacacctggstgattttggtatttttagtagagacggggtttctccatgtcggccaggctggtctcgaactcctgacctcaggtgatccmcccgccttgggctcccaaagtgctgggattacagccctgagccaccatggctgacaataataaaaaattttaaagcaaaactaaagatttataaattgtaaaatgcggttgtaacaagtatttactgtaccagtaaatatgaaaaatattaatgtcctcacacacatggaggtggcttgwgagtggtgtgagcatttcatggtcagagtttggcagttggrcgagagacaggatggattttaactcgaacatcgcagacacaaaactgaaaaccctgatgcggtgcctgcaccgttgcctcctttcctgcagctgtaaatgggacgagtaattccatccccctcccgcttccacccttcagcacagacgcagtcttcagcaaggaagtgctgggaacgccctggagtgaacccaggaagatgcctgcagtgggtgccagggcccctcyccaccgtycctgctgggcttcggggccacgcccgactgctgtgaacggcctgcggagcaccacgtgcgacggctggaggcgagaggtctgcctttgatgtggctgttggtgcagggcctgtggtgcsttccgcagcggaaatggcgcgccgcccggggagggcgggagcagcgtcccgggtgcccctgtgaggatgagcgacgagatgactggagggtccctgaagacctcacyagggtgcccccagccggtccgctcccaggaagcgacacccccacagccccagggctgcagctgagggggtcgccactctggctgggcgaggctgggcccttgggggcaggcgccagagtggcctcaggctctacragatgcctgaaaacaccaacctctccagggctcactagcattggacgctttcacgctctgccctggccggaagccccctcaccccgcgcgatgtgcaaactcctgcagggctcactcagtttccagaactttaattattggaaagttctccctggtccagcccccaaatctgccgtgaacgttgacagctgagttgctgctccatgcgtgctttggctgagagcagaggggacccctgtcctccctgagctgctgacgaggggaggggtgaagggtggggcctctggagagggcaggtcccggggaagctccggactcctagaggggcggccaggtgggggccctggtgaccaggacagactgtggtgttttttaacgtaaaggagatccgyggtgtgagggaccccctgggtcctgcacgccgcctggtggcaggcygggccatggtgggtgctcacgcccccggcatgtggccgcyctcartgggaggggctctgagaacgactttttaaaacgcagagaaaagctccattcttcccaggacctcagcgcagccctggcccaggaaggcrggagacagaggccaggacggtccagaggtgtcraaatgtcctggggacctgagcagcagccaccagggaagaggcagggagggagctgaggaccaggcttggttgtgagaatccctgagcccaggcggtwgatgccaggaggtgtctggactggctgggccatgcctgggctgacctgtccagccagggagagggtgtgagggcagatctgggggtgcccagatggaaggaggcaggcatgggggacacccaaggccccctggcagcaccatgaactaagcaggacacctggaggggaagaactgtggggacctggaggcctccaacgactccttcctgcttcctggacaggactatggctgtgcagggatcccagagaagacttctgggctccctcaactccacccccacagccatccccyagctggggctggctgccaaccagacaggagcccggtgcctggaggtgtccatctctgacgggctcytcctcagcctggggctggtgagcttggtggagaacgcgctggtgktggccaccatcgccaagaaccggaacctgcactcacccatgtactgcttcatctgctgcctggccttgyyggamctgctggtgagcgggagcracrtgctggagacggccgtcatcctcctgctggaggccrgtgcactrgtggcccgggctgyggtgctgcagcagctggacaatgtcattgacgtgatcacctgcagctccatgctgtccagcctctgcttcctgggcgccatcgccgtggaccrctacatctccatcttctacgcactgygctamcacagcaycstgaccctgccgyrggcgcggcragccgttgcggccatytgggtgkmcagtgtcgtcttcagcacgctcttcatcgcctactacgaccacgtggccgtcctgctgtgcctcgtggtcttcytcctggctatgctggtgctcatggccgtgctgtacgtccacatgctggccygggcctgccagcacgcccagggcatcgcccggctccacaagaggcagcgcccggtccaccagggctttggccttaaaggygctgtcaccctcaccatcctgctgggcattttcttcctctgctggggcyccttcttcctgcmtctcacactcatcgtcctctgccccgagcaccccaygtgcggctgcatcttcaagaacttcaacctctttctcgccctcatcatctgcaatgccatcatcsaccccctcatctacgccttycacagccaggagctccgcaggaygctcaaggaggtgctgacrygctcctggtgagcgcggtgcacrcggctttaagtgtgctgggcagagggaggtggtgatattgtgtggtctggttcctgtgtgaccctgggcagttccttacctccctggtccccgtttgtcaaagaggatggactaaatgatctctgaargtgttgaagcgcggacmcttctgggtccagggaggggtccctgcaaaactccaggcaggacttctcaccagcagtcgtggggaacggaggaggacatggggaggttgtggggcctcaggctccgggcaccaggggccaacctcaggctcctaaagagacattttccgcccactcctgggacactccgtctgctccartgactgagcagcatccaccccaccccatctttgctgccagctctcaggaccgtgccctcgtcagctgggatgtgaagtctctgggtggaagtgtgtgccaagagctactcccacagcagccccaggagaaggggctttgtgaccagaaagcttcatccacagccttgcagcggctcctgcaaaaggaggtgaaatccctgcctcaggccaagggaccaggtttgcaggagcccccctagtggtrtggggctgagccctcctgagggccggttctaaggctcagactgggcactggggcctcagcctgctttcctgcagcagtcgcccaagcagacagccctggcaaatgcctgactcagtgaccagtgcctgtgagcatggggccaggaaagtctggtaataaatgtgactcagcatcacccaccttagccccttccagaaagtgcttgaagtttgcgggtggagggatgggggaggggaaggtgggcaggggtgagagtcgagagggaagaaaggagtcccggaaaacgtggctgcctccccaggtgaggaagccacagccccagaggccccaaatgcctggggagtgtggaggtcccaaccaggcttgcgctgaccctgcttctcggttttctctccgtgctgacaaaccccagcctagaggaaggacgagcaggtgcagcagggccccagtcccctccactcttgacgctgtcctagctgcagaagaggcgggttcccagccttccctgtgaccacatgtgacctcagscgggacacatccctttgctggccctggccctgagtccctccagccatgatgagccgtgaatgggaccatccctgtccactctgagatgcctggaagggggctcagtgcaggtgggctgggggctgggtctgctgtctgcccagcactgccattctgggagtaggcaggtggggaaggggtcgggggtggagggtctgtgttcagccagtcctgggaaatgcttgatgtgaggcttctgaagatggcagtgaggsagaggcccagccggcggagaagtccctgggagtgagtacctggggatgaactatgctgcctggtgctggggagcagtggcgcccctgggccatccctctgctgaarcctgggcgtctcgctgaagagaccacctccatttcctctgcwgagactgagcactcagtcagcccccttcctgggacaggctcaatggaggctgcagggccatcagccgactccwwcgcaggctcagtcagcagccccctggccagccccacccctgactgccggcctcagaactgggagctgcttcctggcagggcccgcctctgctgggagaccggacggtgagtcagccttaagcccggcaccagacccctctgaggatggagcaggagctggctgccctgaggctgcaaaacttcttccctcgtggagacagggaggcacctcagacactcaccccggactcccttgaacagggacagggaggaaccccaggcagctagaccccagcagcagccacacgagcacactgtggggcagggaggggcatctcttgagaacaaaagatccatttctmgactttccaaactggagagcttcttgagasaaaagagagagacaggtacaggtccacgccacccacacacagccctgtgcacacagaccggacacaggcrtccacaggcaagttcgcagctgctcattttgtgaagtgaatgctgatttgggggccgggtggggttcgtctgtacatcgtgcactgtcagacccttcctgaaggatttttgttactgaagtatcagaaggcccttgttctaaggtggtggcactgtaatatctggcccaggaggaggtcagtgccgtgccggcgagtcctttgctcccttccttctctgaccagtaaacgcatctccagtcgctcccccgaggcccccctgcacgcagwctccgacctcagagagtgagtcagatagaagccgctgcccaccctcccccaccctggccgggttcttgcctggcttgtgcgtccttgtgacaattcctgacacggatgcgcaccgggcagtggcacgtccaggtgctgtgcgcgcccgggcccacaaagctcctttggacgctcatggcagccccttggtggaggaggtcgggtgcccaccccctccccgcccactgcggaagccggcgacccacggagctcgctctcggccgccgccacccctctgtgttcgcgcccttccgagctctgatccgacgctttgtttcttctcagtgggttcagggcctgggccagcctttacctacctcccccacccaaaaccggcaaaagctcagagcaccttgtctgccaaaagacagggagctggsatggtgcgggttggtctctaaaccggcgtggggaaaaaagaccctccgtacaaagccgcagggtggggctgtcgcaagggcggaaccgagagggtagctgggggcggggttcccagggccaagaggggccattgtcctccctggagcccggcgcccccacagccagctcctctgggagacagcccctcctttcgaatgcgcggggccctcagaccgcgcccggcccagcgctgggggatccttggctgcgggaggggcgccgcattgcgcgcggcgggcggggacgcgcggtgcggagcctgcgggccgggcggggctctgcggcggcgcctcccgattggccacccgcggtgacatcagccgatgcgaagggcggggccgcggctataagagcgcgcggccgcggtccccgaccctcagcagccagcccggcccgcccgcgcccgtccgcagccgcccgccagacgcgcccagtatgagggagatcgtgcacatccaggccggccagtgcggcaaccagatcggggccaaggtgaggctgcgcgccccggcctgtcccgggccccggggcgggaggagggaggcgccgtgccccgcgggccgcacctccagctgcccccgcccctgcgaacctgcaacaaagggatgcgcccagcgccgcgccgggcggccgggacgcggggcccccgccctgggactctcgcctgcacctctctgcccctgcccaggtgacctcgggctgtcgaggcgcagctcacgtcagtcgcgaagcctcagccccctccacacctgcgccccctccacacctgcaccccctccaccgggcctccgcaggtgcagctgggagccctgtctgggcgtggccctcttttttggggccgcggcatagccttgagtgagacgggtggggtaggcaggtttgggtggggtggggggttctcctcacagccgtgatttcctcggcccgaaccccccactggagtagccgaacgtcccccgagaggctagagccgccccgatttccccagcctgctccgacacccctcggcgtcctagctccaccctgtccctttgttggaggggttgggcctggactcgagatgaccttggtccaggaccaggctctccatcggcgcagccgctcctgggcaacccccgcggggcttgaccgcgcccacccagggtctaccagtctggggattggatgtgggaacaaagccgggctgtggggtgtggaggctgcaccgtggcgcgcccctccctccattgttagcccacctcgcagatgttggggccacgcagaaaggggcgttggtgcagctgtgcagggacccctgcctaaatcattaaggggacgtcgtgtcccctggtcctgggaggctgtccctggcccaaggtcacacagcaggtgcgagagagctgggctggcccttggttctcatcccctgcaggagccaacctggggctcgggcggggcgggttgggggcgctgcttgccaaaggatctgccctccgaacagtgttggggaacaggggatcggggggggaggctggctttgtcaggaccaaggccagggacccagctcagggctggtgcagcgctgattctgggaaggagggggtgcaggagacggtcctggaggggaaggggccagagaaaggcagcctccggaggctgttgccatggaaaccaggcaggaacaaaaagctaattacaacagggccagccacgtggctgacatgtaaattgcaactttggctccgggtggaggcgcctctgagggtgggaggcccagtagtggggagactctaatcacccaagragacagctgtgcctgccaaggagagcctgggggaggggagacctgggggacagtggcctcaaatcaaaccaggactcccggagcagcctctgacagctgccttggcctgatgggaggggctgagggctcattaatgtggtcactggggccaagcctcccctgagcatctgctcctgggagggtcaggggtcgctggggggagggagggcaggcagccctggggctcctgggagggtcaggggtctctggggagagggagggcaggcagccctggggcccacctggggtttctccttctatggctgggatgggcccagagctgtggtcccacaaggcacttgtcaggcaagagctgggatctagaagtcaggtgcacatgcagacwtcccctgaggctccacgggtagcagagggagcccttgtcccctggaccgtgtccttsgctgccttgtgctctgcttctgaacactggagctcttagtttgcccgctactttttattccttttgagttgtttgttttttcttaatatatttctttttaaaaattaatacctggccgggcacggtggatgaggaatctcatgtaatcccagcactttgggagactgaaactggaggatcactttagcgaaggagttcaagaccagccgggataacatggtgaaactccgtttcttaaaaaaaaaaaaaaaaaaattagcctggcgtggtgggccgcgcctgtagtcccagctacctgggaggctgagatgggagcattgcttcagcgtgggaggtcgaggctgcaatgaactatgaccgcaccactgtactccagactaggcgatagagtgagatcctgtctcacagtaataatagtatctgattctttttaacaatgaaagcaacagagaaggaaattttctcgggggcgkgggcggcaagagcgtgttcctttgctctgctgcccttgtggaatcaatgggaagttccttggccgttctcggcctccactcccgcagctgatagggggtgcaacgcggctgcttccctgtctggggtcctcgggcggtgcctggctgggcaggaaggcccgtgcastctgggcagagggaagtcggggtgactcgaggccgggagcaaagccgggtcccgggcggtcacgcggcagcgcggacgactcaccgcggtcacccctgcgctgggagccgagcccccggcagctcgcggggatgcagtaagccgggcgcagcccgccgggaggatgagaaaacccgaagcccggaaagccgagcggccgcctgcagtcaccccggggggggcaggggcgggccgggctatgcagaaacaccggggcccgcgggacacaggacgctgccccactgccgcagagctgaatctggacccccgggctttgctttcctggggcctgtgctcctccctccccggggcggggttcgcctgcagcggcggaggggggagcctttgtcctccgcgcgggctgcggcaccgcctcctcgcggctgcggggcggggctgggggcggggcctggccgtctcagccaatgggaggcggagtccctggctcgccccgccctctcgcctgaaagacctgcggagccgcgggccgggcgggaaccgcattcgggtcctggaggggcttggaggccccagtctcgcagccccttcatcggggacccccgctcccacctgccttggccactgccctcaaagcccggccccgctttccccaggaccccaagcgctgcgcgaggtcagcaccaaggacagcgcccgggccgagcgcctggcctcgaacgccgggttctgctttgtgtttccaggtttttgtttttggttatgagaggaggcctggctctgtcgcccgggctggcgtccagaggcgcgatctcggctcactgcagcctcggcctcccgagtagctgggaccgcaggcgctcaccaccacgcctggccacaattttccttttttcttattttcttttagatggagtttggctcttgttgcccaggctggagtgcagtggcgcgatctcggctcattgmamcctccacttcctgggttcaagctattctcctgcctcagcctcctgagtagctgggattacaggcgcccgccaccacacctggcttattttgtacttttactagagatggggtttctccatcttggtcaggctggtctcaaactcctgacctcaggtgattcacctgcctcagcctcccaaagtgctgggattgcaggcatgagccaccacgccgggccgatttccttttctgtagtgatgttaacaatttagtttataaaattatattttattgtttattaaatatgtaacataggccaggtgcggtggctcacacctgtaatcccagcactttgggaggccgaggygggtgratcacctgaggtcagcacttcagggccagcctgggcaacatggcaagactccgtscctacaaaaaataaaaaacaaaaaaaattagctggacatggaggcacgccggcctgtggtcccagctacttgggagrcagaggtgggaggatcacctgggggaggtgggcagaggttaaagtgagctgaggtcatgcccctgcattctagcctgggcaatagagcaagaccytayctaaaaaaaaaaaaggaacaatatattttattactttatctcaaattataattttattaattttaactacaaaagcaattaatatattstcctggttaaaaaaaaccttaaatattgcagataaacctggtgcccatctagccacctctctctatccaagtgggaacaaatttctttttctatccttctggtccattttttttaagtgacctgtgcatatggttttaaaactttaaatagtatctaaaacatttgaacaaaatgaagccaacatgtgctgaatgttttcatgtcaagctttgtgctaaggcctggatgtgggcaccattcacacgttcatctcacagatgagaaaacaggtcctgcgaggcacgcgcctggcccacagctgtgctcgtgctgggtcttgaatccactctgctccattgctcctgctgccctgtgcctcgctctgcagaggacttcccatagatgtgttactctctccacccctcctttacaggggctggtggttgtgggttccctggaaccataaatttggggtgtcccagtgctttggggagcaaggtccccgactcaagtggactgccagcaactaaattaatgggggatcctcaaagagastgttagggaggcaagcagtaggtgggaagcttggacaagccccaaatgcctcagggacctttctgtattttttttttgagacaggctcttactctgtcgcctggactggcatgatctaggctcactgcaacctccacccccctggctcaagtgatcctcccacctcagcctcctgagtagctggggctataggcatgcgtcaccatgcccaactaatttttttgttttttggtagagacagggtttcaccatgttgcccaggctggtcttgaactcctggactcaagtgatccacctctcttggcctcccaaactgctgggattataaatatgagccaccatggccagctgatttttttgtttgtttgtttgagatggagtctcactctgtcactcaggctggagtgcagtggagtgatctcggctcactgcaacctccacctcctgggttcaagcaattctcctgccttagcctcctgagtagctgggattacaggcacccrtcaccacactggctaattttttttttttttttttgaggcggagtctctatctgttgcccaggctggagcacggtggcacaatctcggttcactgcaagctccgcctcccaggttcacgccattctcctgagtcagcctcccaagtagctgggactacaggtgcccgccaccrcgcctggctaattttttgtatttttagtagagacagggtttcactgtgccagccaggatggtctcgatctcctgacctcatgatccgcccacctcggcctcccaaagtgctaggaccacagacaggcgtgagccactgcgtctggcctaatttttgtatttttagtagagatggggtttcaccatgttggtcaggctggtctcgaactactgacctcgtgatccacccgccttggcctcccaaagtgctgggattgcaggcgtgagccaccgcgcccggccttttttttttttttttttaagatagggtttcactcttgtcccacaggctggtgtgcagtggcttgatctcagctcactgcaacctctgccccctgggttcaagcgattctcgtgtctcagactctgaaacaactgaaattacaggtgcgcgctaccacgcccggctaatttttgtatttttagtagggacagggttttgccctgttgtccaggttggtcctgaactcctgacttcaagtgatctgcctgcctcagcctcccaaagtgctgggattataggcatgagccaccacacccagcytgaatcatttttgtaatttaaaaatttaacgcaaaaagaataaaacttagcaataacaaaaatgcacaaaagatggaaagaaatccacccctgacctttgtggagagatgacctctgatracagtctcagggtgaacgggcacctctgataacagtctcagggtgaacgggcatcccgagacactgttagcagaggtggtccatgtccatgctgtccgcgttacaataattacactatgtttattcttaaggttttaaaaacatttatttttaacaaattttctttgaaaagctaccgtgtgcacgtgagaaaatctcaacaagaccacagggcacccgtgagaagaagctcctcccagtctggggcccctccccaggcacagccttccacacatctaccagaggcacccacgcatagagaagcacccacaagcagttttctttctttcttttatttgagacggtgtttccttctgttgcccaggcttgagtgcagtggcatgacataagctcactgcaacctccacctcccgagttcgtgtgattctccgcctcagcctcccaagcagctgggattacaggtgctcgccaccacgcctggctaatttttgtatttttagtagagacagggttttgccatgttggccaggctggtcttgaactcctgacctcagatgatccacygcctcagcctcccaaagtactgggattacaggcgtgagccaccgtgcctggcacaagcagttttctccccttccttccttccttccttccttccttccttccttccttccttcctctctctctctctttcctttctttcttccttcattccttccttccttccttccttcctttctttctgacagtctcgcactattgcccaggctggagtgcagtggcgcgatctcgactcaccacaacctctgcctcctgggttcaagcaattctcctgcctcagcctctcgagtagctgggagtacaggtgcgcgccaccatgcctggctaatttttgtatttttgggagagatggagtttcactatgttggccaggctggtctcgaactcctgacctcgtgacccacccgcctctgcctcccaaagtgcagggattatgggggtgagccacygtgcccagctatgagyggttttgtttctatttatttattattattctatgagacagagtctcactctgtcgcccacgctggagtacagtggtgcaatcttggcttactgcaacctccgtctcctgggttcaagcaattcttctgcctcagcttccggagtagctggaacgtgtgagccaccacccctggctaatttttgtatttttagtagagacaggctggtctcgaactcctgacttccggtgatctgcccacctcagcctcccaaattgttggtattacaggcgtgagccaccgcacctggcctctatttatttatttattttgagatggggtcttgatatgaattcctagactcatgcttctcatgcttgctaccacccagtcctgcctcctgcacagcagtttccactaaagtcacccctttacgagaggcatcttttttttttttttgagatggtgtctcactctgtcgcccaggctggagtgcaatggcatgatctcagctcactgcaagctccrcctcctgggttcaagtgattctcctgcttcagcctcccgagtagctgggactacaggcrcccgccaccattcccggctaattttttgtatctttagtagagacggggtttcaccatgttagccaggatggtctcgatctcctgacttcgtgatccacccgcctcggcctcccaaagtgttgggattacaggcatgagccactgtacctggcctactagaggcatcttaaaacacatctcctgtgtctccattccaaagcgcatctttgtctacactcctggggtcctcccacgtcagcctcccaaagtgctgggattacagtcatgagccactgtgcccggccccaccaaattgttttctaacctgcttttttcttgaggaatcttctgcagcacatgactcacatgtagagccccttgtttcttgaggccttcatacccgtcagctcatctaaaagtcactcctgaggagtaagggcaaggggcattgggagaggtcaggcagccctgggaagcctcccagcgtgtgtcccaggaggcctgctgcctgcagacactgctcccagacgcagcggcctcggccatcagagcgtgtcccacgatgaggtggcaacttccctgaagggcttgctctcacccaggggtgtggttctccgtgtgcacacagatagatagttctacgtttgccatataccatttatatgcctcacacagattaacccactttcatttcaaaaagacctcctgtcatcgtgcccattgtacagatgaggacactgagacacggaatcctagtgacctgtgcaaggtcacacagctgggaagggtgagggaagcgtctgtgaacccagcaggcccagcccctgagtctaggctccgctcggcagctgtcatgggagcagagtccgagaagcactgcaggcacctgctctagggggagagaggtggaggtggcaggtagagagaggacgacccctgggagctgagacgatgccagcctcacacggacaggctgggtgacctcaggcaagtcgcttcccatttgggaccccaaggacccttctgcagacccagctgggggtccccgatgagactggctctcagagtccctgtgagtcccgtcagctgaggccagtaatgtcctggcaccatcactggacatggtttgctctcccatggaggggcaggtgtagcagccaaaagcgatcctgagctctgggcctctgaaccctgctctgccagctactgtgggtgtctctacccgctctgtgtctcagttccctttcctgaaaagaggggatagtaaaaactaaccctcaaggtgtttattaccaatgcccttcatggaggaatccgctgctccaggcccttgccagcagctgcacagctgggcctggggacctgggtgtgggtctgttgaaccttggcccaccctggggctgtggtcggcctggacgygtaggtgtggaggtrcatatttattatggcaattttctgacaggtaacagagtgtggggctctcttctgaatggggctcgtggaggccgtgggtcaaaagccctaattttgtagtgagggctaaaaggcttcacaagggaaagggcctggytggggctatgggccggtgccgaccccysctctcccactttgtttgcagttctgggaagtcatcagtgatgagcatggcatcgaccccagcggcaactacgtgggcgactcggacttgcagctggagcggatcagcgtctactacaacgaggcctcttgtgagtgcctgycccagcctccctatcccagccctggactgaccaggtctcagcgtctgactgaccaggtctcagcacctggactcaccagctctcagcatmtctgtcctcccatgggttaggttggctgagatgccagcaggcgtaactggatgtcaggcatccagacgcacagaacagacaataaatcacagtcacaaaagtgagagccaaacatattagtgccatgagggcctgtgcgtgtccaggggcacagacagggatggggcaggccagagactttggaggccataagagggcctagagaaggggtcacctggagggcttagtcaggggctctttagcaactggtgtgaagtgatttccatatcaaagtggtgatacacccacctgcccacatggacatgtgatttaaaattttatttaatttaatagagacagtctcgatatgttgcccaggctggtctcgaactcctggactcaagcgatccacctgccttggcctcccaaagtgttgggagtgcagacacgagcccctgcatctggtggacgtctgactgaatcctgcctgtcctgctccgtcctgtcctgctccgtccttaaacacagtgaggcttaagggtgaagaaagttgctgaagcttgcctttggtccaggactctgacttcagagtacaggctcttaggatgtgagcaggaggatggcaggcgggcacagaattcagaaagaatgagggagaggctctggccctctgtgacccgaatcaccgagcccctctctcccctcagctcacaagtacgtgcctcgagccattctggtggacctggaacccggaaccatggacagtgtccgctcaggggcctttggacatctcttcaggcctgacaatttcatctttggtaagttccccctgctccaagctctgatggcagaccccatcacaggcaagcccaggtcggtggacggggacggctgtgagaaacaaggaatggtcagctcctcacatgatcctgaatggtgggaactcatctctccattttacagctgggcattggaggcccagagaaagggttctgtggggagaacagaaaccactcatgcatttcaagtggaatgaagtgtaaagcagacagaagcttacagaattgctagagagctggtgagacagaacggggcctccagaggactccggggtccaggagcacgaggccttgctgcggtcaagagatcaggacgttcccatgcctgtgtcctggggttgggccgtggatgccacgttcccaygtctgtgtcctggggcggggccgtggatgccacgttcccacgtctgtgtcctggggcggggccgtggatgccacgttcccacgtctgtgtcctggggcggggccgtggatgccacgttcccacgcctgtgtcctggggcggggccgtggatgccacgttcccacgcctgtgtcctggggcggggccgtggatgccacgttcccatgcctgtgtcctggggcggggccgtggatgccacgttcccatgcctgtgtcctggggcggggccgtggatgccacgttcccatgtctgtgtcctggggcggggccgtggaygcgccacagaaacaggagggcctcgcttcacttctgccttcccgaccgcagcacatccagctggtagatgccaactcgcatccagcccccagctgccagggattctggggtggctgtttgggctcctggcactgccagtcggaaggaaggtatgctggagcaggagggctgatccattcacccaggatcccctcaggaggcagagcctygctctgctgtgaccccaagttctcaagacyctgtccagagccctcgtcctgagcactcagcagcatsggctcagggaagccacggcgggtatgagaaggggtgctcagtggggcctactttacagaagacagaacaggcatggggctgccacggctgcccttgggatgttcaggcaggggctggaggtctggactgcagagtccctggcccctgtctcttacccctcttctccctgtacaggtcagagtggggccggcaacaactgggccaagggtcactacacggagggggcggagctggtggattcggtcctggatgtrgtgcggaaggagtgtgaaaactgcgactgcctgcagggcttccagctgacccactcgctggggggcggcmcgggctccggcatgggcacgttgctcatcagcaaggtgcgtgaggagtatcccgaccgcatcatgaacaccttcagcgtcgtgccctcacccaaggtgtcagacacggtggtggagccctacaacgccacgctgtccatccaccagctggtggagaacacggatgagacctactgcatcgacaacgaggcgctctacgacatctgcttccgcaccctcaagctggccacgcccacctayggggacctcaaccacctggtatcggccaccatgagcggagtcaccacctccttgcgcttcccgggccagctcaacgctgacctgcgcaagctggccgtcaacatggtgcccttcccgcgcctgcacttcttcatgcccggcttcgcccccctcacagcccggggcagccagcagtaccgggccctgaccgtgcccgagctcacccagcagatgttcgatgccaagaacatgatggccgcctgcgacccgcgccacggccgctacctgacggtggccaccgtgttccggggccgcatgtccatgaaggaggtggacgagcagatgctrgccatccagagcaagaacagcagctacttcgtggagtggatccccaacaacgtgaaggtggccgtgtgtgacatcccgccccgcggcctcaagatgtcctccaccttcatcgggaacagcacggccatccaggagctgttcaagcgcatctccgagcagttcacggccatgttccggcgcaaggccttcctgcactggtacacgggcgagggcatggacgagatggagttcaccgaggccgagagcaacatgaacgacctggtgtccgagtaccagcagtaccaggacgccacggccgaggaagagggcgagatgtacgaagacgacgaggaggagtcggaggcccagggccccaagtgaarctgctcgcagctggagtgagaggcaggtggcggccggggccgaagccagcagtgtctaaacccccggagccatctygctgccgacaccctgctttcccctcgccctagggctcccttgccgccctcctgcagtatttatggcctcrtcctccccacctaggccacgtgtgagctgctcctgtctctgtcttattgcagctccaggcctgacgttttacggktttgttttttactggtttgkgtttatattttcggggatacttaataaatctattgctgtcagatacccttgcttggtgccagagatgtccttttattctggaaagttgtgtccagtaggtggaggggctgacagggaggcccgggtggacaggcaagaagagctcatcctctcccaggctggcggctgagagaggcctgcgctgggggccggaatgtgtctcaaggcacagcccgtggggagacccyggaaacgggaagcccgggagaaggaacgggaagtacctcattccagacctcaagatgcagccctcccgacttggaaataaccccrcactcgttccctggcctcccacagagcggcttgcaccccagacttttctcccacctgtctgtaggctgaaagttggggcaggtggtccctcctgcggtggaaactgccatcagacctgaagcctcgggtcacaaccagggaggtagggaagggggccccgagtgctccctgaaaaagacggtgtgtttagtgtctcggggctgggccctgggaggggctgctgaggtcagggagatgcggccacaggacgcaggcctgggctgccgggagggacgtatcagtcctcccgcccccggcagccccttcctggggtgcatgatacttgstgtccagccacacagggcatggcctgaggagccgctcacctggttccccacatcctcctacagggacagagcctggagcccagagaggccgactgcccagccctccacagtcgcctccctgccaccccgccccttggagctgaggggcatcagcagcctcagtctcccaggttctgcccagtggtaccctgagagcggccccttcttcttgaatcacccttcaacctggcaatgggcgcagaagaagacaggccgtgtgcactgcrggccccagcttcagatgcgagggctgcaggccccagaggccgccatctcgagttctggccctgacacccccaacatggatggggccggggatgtgtctcctccgccggctgctgctgtgtaacaaatcaccccaaatctacctgaaacagcacgggatcctttctctagacacagcgtgttagctggatccttctgctcctcacaatgttgggaggggccagctgcaagctctgacatctcactcttggggttgtcctccgcacggctgcctggccgacccctcgcatggtggggmggaggctggaaccacgtcttacatggcaccggttctttttttctttgtgacagagtctcgctctgtcgcctaggctggagtgcagtggcgcaatctcagctcactgcaagctccgcctcccgggttcacgccattctcctgcctcagcctcctgagtagcagggactacrggcgcccgccaccatgcccggctaattttttgtatttttagtagagatggggtttcaccrtgttagccaggatggtctcsatctcctgacctcaggatccgcccaccttggcctcccaaagtgctgggattacaggcgtgagccaccgtcactgattcttaagtgtgccagacccatgtcaatcacaggcctggcatcactgtcccatattcagtgggttcaagcaagaccagagccagtgcagatgcaggcagggagggaaaagccctgtggtgcggactctggggtgtggttcctgggaggctgcctgaacacagcctggcttgcacctgcaactccacacatgcggagctgagctcctgacccccagccctgcttctccacatccctcaggttggtgatgccaaccacgacaccccaggtgctcagggcaaacagccggggtcaccaggtatagggtccagccccatagggtcggtgggtctctccctgtgtgcggcgatgacagagtgtagaaataaagacacaagacaaagagataaaagaaaaggcagctgggcccgggggaccaccaccagcaagacgcggagaccggtagtggccccgaatgtctggctgcgctgttatttactggatacagagcaaaaggggcagggtaaagagtgtgagtcatctccaatgayaggtraggtcacgtgggtcacrtgtccactggacagggggcccttccctgcctggcagccraggcagagagagagagggagagagagagacagcttacaccattatttctgcatatcaagagacttttatactttcactaatttgctactgctatctggaaggcagagccaggtgtacaggatggaacatgaaggtggactaggagcgtgaccactgaagcacagcatcacagggagatggtaaggcctccggataactaatgattaatgatattcatatataatcatgtctatgatctatatctagtataactcctgttgttttatatattttattatactggaacagctcgtgccctcggtctcttgcctcggcacctggatggcttgccgcccacaaccaggggcttttcttcccctcaggtccacatctgctttgacagcaaatctggccagctgcaccttcagaacacgcccacagcccagcacccctcatgtctgctgctgcctcgggtcttcctcgtcccgtccgtgcgattgtctcctcactgggctcccacagctgcctggccgctcctcacatgcaatttggcatctgctcccgtgccacgctgtccttcatatcctcttgttatatatgccccgtccacaccacgtccctaatgttctagaacattggggcccggggaatgccctccacttgagtgtcctccctgcagatatccgacggcatcaccctaggggacccttcctggccccccgtgctctgaactctcctcccagagctgctttctgtgcagcactcagcacccacttcaggagactgtgccttcaggggaggggtcaacaaagagggtcgaatggcaggaatgggcctaattaaggggtcctggagcactgaaggtgaaggggtgggagggctggaccctggtgagaactggagcyacaggagaggccaccccggctgagctgaggtctctgaagggtaagaaccccatcagagcagagggagccccggagccaacaccctgacctctctctcctccgtccccyrgyctccaggcaccctgacytctctctcctccgycctccrgcctcttgctgagctcagctggaagtcaggggacgtccaggtcagcctccaggcagagaggagggccaggaggcgtgagaggtgggtctggggccagtggaaggtgagaacctggcccaggtctaatgtgtcatttagtccccaagtgtctcctccacggggtcagctccacaagggacttctgtgttgttcccgttggaccccttaacctagaagaatgcctgactcatggtaggtaaagatttccggaaaaaatggcttgaattgtggtctttcatgtaacaacagactggacatggagcagttccagggtggggctgtgtgttggtctcatccttactgggtgagccccttcgtccgagaaaacggcccctgctccagttgttagaaaaccgcctttacaggccaggtgtggtggctcacacctgtaatcccagcacttcaggaggccaaggcagacaggtcatgaggtcaggaaatggagaccatcctggctaacaaggtgaaaccccgtaactamtaaaaatacaaaaaaattagctgggcgtggtggcgggcgcctttagtcccaactactcgggaggctgaggcagaagaatcacttgaacccaggaggtggaggttgcagtgagctgagatcccgccactgcactacagcccgggtgacagagtaagactctgtctcaaaaaaaaaaaaaatgtgattgctatgtaaaatgattgtgtgccacagagatgaccaggtttcttgtggatttcatcttaactgtggctgtcctaagacttttgtcatccacagataactgttgtcttgtttcaccatttttttttttgttttgagacgaagtttcgctctgttgcccaggctggagtgcagtggcgcgatctcggctcactgcaatctccgttccctgggttcaagcgattctcctgcctcagcctcctgagtagctggggttacaggcatgcgccaccacacccagctaatttttttgtatttttagtagagacgggagttcaccatgttggtcaggctggtctcaaactcctgacctcgtgatctgcctgcctcgrcctcccaaagtgctgggattgcaggtgtgagccactgtgcctggccacattactgattctttttgttttgtttttcagagtcaagaaaaccttttttcttttgagctatttacagcttttagcagttgagtaaagtacacccctgtgaccaaaacttggtgcatttttctttctctacctgagttctccagattttggaaactgtctgtgagtattcttttttatttatttatttatttttaaaatttcagtaggttttagctggtgtttggttacatgaatgagttctttagtggtgttttctgagattttggtccatccattacctgagcagtatacactgtatccartatgtagcytttatccctaaccctctcccaccctttcccytgagttcccaaactccttcatatcattattattattgttattattattattgaaacagtgtctccctctgtcacccaggctggagtgcagwggcacgatctcacctcattgcaacctccacctcctgagttcaagcagttctcctgcctcagtctcctgggtagctgggattacaggcacacaccaccacacctggctaatttttgtgtttcttagtagagatggagtttcaccttgttggccaggctggtcttgaattcctgatctcaagtgatctgcccgctggcttccaaaatgctggaattacaggtgtgagccaccatacctggcctattggatcattcttaagcctttgcatcctcatagcttagctcccatttatgattgagaatataggatgtttgctttaccattaacgtattcttttcttctctttttttttttttttttttttttgagatggagttttgctcttgttgcccaggctggagtgcaatggcgtggtcctggtccactgcaacctccacctcccgtgttcaagcgattctcctgcctcagcctcctaagtagctggaattacaggcacctgccaccacacccggctagtttttgtatttgtatttttatttaatttaatttatttatttattttgagacgagtctcgctctgtctcccaggctggagtgcagtggtgcgatctcggctcactgcaagctccgcctcccgggttcacgccattctcctgcctcagcctcctgagtagctgggactacaggcgcccaccaccgtgcccggctaattttctgtatttttagtagagacggggtttcaccgtgttagccaggatggtctcaatctcctgaccttgtgatccgcccgcctcggcctcccaaagtgctgggattacaggcctgagccaccccgccgggcccacactaatactttcaaatttgtcttttgtttttctgacctggactcaatgaaattgctactaactttttcccgaggcccagaaagttgaggttattctttgtaacacaggtgagaacattgtgtcagactgccaggggcttcctgctctgtaactaaagatgctttgagtctaacatctggatagatcgtgtccaacaataaacttcgtttttcttctgttttcatagaaatacctcttattaaaaatctgttcaccttcctcatatacataagtttagcccatctgcaacctcctgytatgggaaatagctgtttaacggaactgatcttgtctcaggaccaggaaatcactacaaagatatgtgacagtgtatctaaatttgttctttcctgtctatcccaatgtgtcttttttttttttttttttgagacagagtcttgctgttgtctcccaggctgaagtgcagcgatctcagctcactgcaacctccgcctcccgtgttga
